US006962989B1

(12) United States Patent
Pompejus et al.

(10) Patent No.: US 6,962,989 B1
(45) Date of Patent: Nov. 8, 2005

(54) *CORYNEBACTERIUM GLUTAMICUM* GENES ENCODING NOVEL PROTEINS

(75) Inventors: Markus Pompejus, Freinsheim (DE); Burkhard Kröger, Limburgerhof (DE); Hartwig Schröder, Nussloch (DE); Oskar Zelder, Speyer (DE); Gregor Haberhauer, Limburgerhof (DE)

(73) Assignee: BASF Aktiengesellschaft, Ludwigshafen (DE)

( * ) Notice: Subject to any disclaimer, the term of this patent is extended or adjusted under 35 U.S.C. 154(b) by 303 days.

(21) Appl. No.: 09/605,703

(22) Filed: Jun. 27, 2000

Related U.S. Application Data

(60) Provisional application No. 60/152,318, filed on Sep. 3, 1999, and provisional application No. 60/142,764, filed on Jul. 8, 1999.

(51) Int. Cl.[7] .................. C07H 21/02; C07H 21/04; C07K 14/34
(52) U.S. Cl. ..................... 536/23.7; 530/350
(58) Field of Search .................. 536/23.7, 24.32; 530/350; 435/253.1, 41

(56) References Cited

U.S. PATENT DOCUMENTS 5,554,534 A * 9/1996 Michaels et al. ........ 435/252.3
5,665,872 A * 9/1997 Saito et al. ................ 536/23.5

OTHER PUBLICATIONS

GenBank Accession No. AC008261, *Arabidopsis thaliana* chromosome III BAC T4P13 genomic sequence, complete sequence, Oct. 30, 2002.

* cited by examiner

*Primary Examiner*—Marjorie Moran
(74) *Attorney, Agent, or Firm*—Lahive & Cockfield, LLP; Elizabeth A. Hanley; Maria Laccotripe Zacharakis

(57) ABSTRACT

Isolated nucleic acid molecules, designated MCP nucleic acid molecules, which encode novel MCP proteins from *Corynebacterium glutamicum* are described. The invention also provides antisense nucleic acid molecules, recombinant expression vectors containing MCP nucleic acid molecules, and host cells into which the expression vectors have been introduced. The invention still further provides isolated MCP proteins, mutated MCP proteins, fusion proteins, antigenic peptides and methods for the improvement of production of a desired compound from *C. glutamicum* based on genetic engineering of MCP genes in this organism.

5 Claims, No Drawings

CORYNEBACTERIUM GLUTAMICUM GENES ENCODING NOVEL PROTEINS

RELATED APPLICATIONS

This application claims benefit of prior filed U.S. Provisional Patent Application Ser. No. 60/142,764, filed Jul. 8, 1999, and U.S. Provisional Patent Application Ser. No. 60/152,318, filed Sep. 3, 1999. The entire contents of both of the aforementioned applications are hereby expressly incorporated herein by reference.

BACKGROUND OF THE INVENTION

Certain products and by-products of naturally-occurring metabolic processes in cells have utility in a wide array of industries, including the food, feed, cosmetics, and pharmaceutical industries. These molecules, collectively termed 'fine chemicals', include organic acids, both proteinogenic and non-proteinogenic amino acids, nucleotides and nucleosides, lipids and fatty acids, diols, carbohydrates, aromatic compounds, vitamins and cofactors, and enzymes. Their production is most conveniently performed through the large-scale culture of bacteria developed to produce and secrete large quantities of one or more desired molecules. One particularly useful organism for this purpose is *Corynebacterium glutamicum*, a gram positive, nonpathogenic bacterium. Through strain selection, a number of mutant strains have been developed which produce an array of desirable compounds. However, selection of strains improved for the production of a particular molecule is a time-consuming and difficult process.

SUMMARY OF THE INVENTION

The invention provides novel bacterial nucleic acid molecules which have a variety of uses. These uses include the identification of microorganisms which can be used to produce fine chemicals, the modulation of fine chemical production in *C. glutamicum* or related bacteria, the typing or identification of *C. glutamicum* or related bacteria, as reference points for mapping the *C. glutamicum* genome, and as markers for transformation. These novel nucleic acid molecules encode proteins, referred to herein as marker and fine chemical production (MCP) proteins.

*C. glutamicum* is a gram positive, aerobic bacterium which is commonly used in industry for the large-scale production of a variety of fine chemicals, and also for the degradation of hydrocarbons (such as in petroleum spills) and for the oxidation of terpenoids. The MCP nucleic acid molecules of the invention, therefore, can be used to identify microorganisms which can be used to produce fine chemicals, e.g., by fermentation processes. Modulation of the expression of the MCP nucleic acids of the invention, or modification of the sequence of the MCP nucleic acid molecules of the invention, can be used to modulate the production of one or more fine chemicals from a microorganism (e.g., to improve the yield or production of one or more fine chemicals from a *Corynebacterium* or *Brevibacterium* species).

The MCP nucleic acids of the invention may also be used to identify an organism as being *Corynebacterium glutamicum* or a close relative thereof, or to identify the presence of *C. glutamicum* or a relative thereof in a mixed population of microorganisms. The invention provides the nucleic acid sequences of a number of *C. glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present. Although *Corynebacterium glutamicum* itself is nonpathogenic, it is related to species pathogenic in humans, such as *Corynebacterium diphtheriae* (the causative agent of diphtheria); the detection of such organisms is of significant clinical relevance.

The MCP nucleic acid molecules of the invention may also serve as reference points for mapping of the *C. glutamicum* genome, or of genomes of related organisms. Similarly, these molecules, or variants or portions thereof, may serve as markers for genetically engineered *Corynebacterium* or *Brevibacterium* species.

The MCP proteins encoded by the novel nucleic acid molecules of the invention may be involved, for example, in the direct or indirect production of one or more fine chemicals from *C. glutamicum*. The MCP proteins of the invention may also participate in the degradation of hydrocarbons or the oxidation of terpenoids. These proteins may also be utilized for the identification of *Corynebacterium glutamicum* or organisms related to *C. glutamicum*; the presence of an MCP protein specific to *C. glutamicum* and related species in a mixture of proteins may indicate the presence of one of these bacteria in the sample. Further, these MCP proteins may have homologues in plants or animals which are involved in a disease state or condition; these proteins thus may serve as useful pharmaceutical targets for drug screening and the development of therapeutic compounds.

Given the availability of cloning vectors for use in *Corynebacterium glutamicum*, such as those disclosed in Sinskey et al., U.S. Pat. No. 4,649,119, and techniques for genetic manipulation of *C. glutamicum* and the related *Brevibacterium* species (e.g., *lactofermentum*) (Yoshihama et al, *J. Bacteriol.* 162: 591–597 (1985); Katsumata et al., *J. Bacteriol.* 159: 306–311 (1984); and Santamaria et al., *J. Gen. Microbiol.* 130: 2237–2246 (1984)), the nucleic acid molecules of the invention may be utilized in the genetic engineering of this organism to modulate the production of one or more fine chemicals. This modulation may be due to a direct effect of manipulation of a gene of the invention, or it may be due to an indirect effect of such manipulation. For example, by modifying the activity of a protein involved in the biosynthesis or degradation of a fine chemical (i.e., through mutagenesis of the corresponding gene), one may directly modulate the ability of the cell to synthesize or to degrade this compound, thereby modulating the yield and/or efficiency of production of the fine chemical. Similarly, by modulating the activity of a protein which regulates a fine chemical metabolic pathway, one may directly influence whether the production of the desired compound is up- or down-regulated, either of which will modulate the yield or efficiency of production of the fine chemical from the cell.

Indirect modulation of fine chemical production may also result by modifying the activity of a protein of the invention (i.e., by mutagenesis of the corresponding gene) such that the overall ability of the cell to grow and divide or to remain viable and productive is increased. The production of fine chemicals from *C. glutamicum* is generally accomplished by the large-scale fermentative culture of these microorganisms, conditions which are frequently suboptimal for growth and cell division. By engineering a protein of the invention (e.g., a stress response protein, a cell wall protein, or proteins involved in the metabolism of compounds necessary for cell growth and division to occur, such as nucleotides and amino acids) such that it is better able to survive, grow, and multiply in such conditions, it may be possible to increase the number and productivity of such engineered C. glutamicum cells in large-scale culture, which in turn should result in increased yields and/or efficiency of production of one or more desired fine chemicals. Further, the metabolic pathways of any cell are necessarily interrelated and coregulated. By altering the activity or regulation of any one metabolic pathway in C. glutamicum (i.e., by altering the activity of one of the proteins of the invention which participates in such a pathway), it is possible to concomitantly alter the activity or regulation of other metabolic pathways in this microorganism, which may be directly involved in the synthesis or degradation of a fine chemical. The invention provides novel nucleic acid molecules which encode proteins, referred to herein as MCP proteins, which are capable of, for example, modulating the production or efficiency of production of one or more fine chemicals from C. glutamicum, or of serving as identifying markers for C. glutamicum or related organisms. Nucleic acid molecules encoding an MCP protein are referred to herein as MCP nucleic acid molecules. In a preferred embodiment, the MCP protein is capable of modulating the production or efficiency of production of one or more fine chemicals from C. glutamicum, or of serving as identifying markers for C. glutamicum or related organisms. Examples of such proteins include those encoded by the genes set forth in Table 1.

Accordingly, one aspect of the invention pertains to isolated nucleic acid molecules (e.g., cDNAs, DNAs, or RNAs) comprising a nucleotide sequence encoding an MCP protein or biologically active portions thereof, as well as nucleic acid fragments suitable as primers or hybridization probes for the detection or amplification of MCP-encoding nucleic acid (e.g., DNA or mRNA). In particularly preferred embodiments, the isolated nucleic acid molecule comprises one of the nucleotide sequences set forth in Appendix A or the coding region or a complement thereof of one of these nucleotide sequences. In other particularly preferred embodiments, the isolated nucleic acid molecule of the invention comprises a nucleotide sequence which hybridizes to or is at least about 50%, preferably at least about 60%, more preferably at least about 70%, 80% or 90%, and even more preferably at least about 95%, 96%, 97%, 98%, 99% or more homologous to a nucleotide sequence set forth in Appendix A, or a portion thereof. In other preferred embodiments, the isolated nucleic acid molecule encodes one of the amino acid sequences set forth in Appendix B. The preferred MCP proteins of the present invention also preferably possess at least one of the MCP activities described herein.

In another embodiment, the isolated nucleic acid molecule encodes a protein or portion thereof wherein the protein or portion thereof includes an amino acid sequence which is sufficiently homologous to an amino acid sequence of Appendix B, e.g., sufficiently homologous to an amino acid sequence of Appendix B such that the protein or portion thereof maintains an MCP activity. Preferably, the protein or portion thereof encoded by the nucleic acid molecule maintains the ability to modulate the production or efficiency of production of one or more fine chemicals from C. glutamicum, or of serving as an identifying marker for C. glutamicum or related organisms. In one embodiment, the protein encoded by the nucleic acid molecule is at least about 50%, preferably at least about 60%, and more preferably at least about 70%, 80%, or 90% and most preferably at least about 95%, 96%, 97%, 98%, or 99% or more homologous to an amino acid sequence of Appendix B (e.g., an entire amino acid sequence selected from those sequences set forth in Appendix B). In another preferred embodiment, the protein is a fill length C. glutamicum protein which is substantially homologous to an entire amino acid sequence of Appendix B (encoded by an open reading frame shown in Appendix A).

In another preferred embodiment, the isolated nucleic acid molecule is derived from C. glutamicum and encodes a protein (e.g., an MCP fusion protein) which includes biologically active domain which is at least about 50% or more homologous to one of the amino acid sequences of Appendix B and is able to modulate the yield, production, and/or efficiency of production of one or more fine chemicals from C. glutamicum, to degrade hydrocarbons, to oxidize terpenoids, to serve as a target for drug development, or to serve as an identifying marker for C. glutamicum or related organisms, and which also includes heterologous nucleic acid sequences encoding a heterologous polypeptide or regulatory regions.

In another embodiment, the isolated nucleic acid molecule is at least 15 nucleotides in length and hybridizes under stringent conditions to a nucleic acid molecule comprising a nucleotide sequence of Appendix A. Preferably, the isolated nucleic acid molecule corresponds to a naturally-occurring nucleic acid molecule. More preferably, the isolated nucleic acid encodes a naturally-occurring C. glutamicum MCP protein, or a biologically active portion thereof.

Another aspect of the invention pertains to vectors, e.g., recombinant expression vectors, containing the nucleic acid molecules of the invention, and host cells into which such vectors have been introduced. In one embodiment, such a host cell is used to produce an MCP protein by culturing the host cell in a suitable medium. The MCP protein can then be isolated from the medium or the host cell.

Yet another aspect of the invention pertains to a genetically altered microorganism in which an MCP gene has been introduced or altered. In one embodiment, the genome of the microorganism has been, altered by introduction of a nucleic acid molecule of the invention encoding wild-type or mutated MCP sequence as a transgene. In another embodiment, an endogenous MCP gene within the genome of the microorganism has been altered, e.g., functionally disrupted, by homologous recombination with an altered MCP gene. In another embodiment, an endogenous or introduced MCP gene in a microorganism has been altered by one or more point mutations, deletions, or inversions, but still encodes a functional MCP protein. In still another embodiment, one or more of the regulatory regions (e.g., a promoter, repressor, or inducer) of an MCP gene in a microorganism has been altered (e.g., by deletion, truncation, inversion, or point mutation) such that the expression of the MCP gene is modulated. In a preferred embodiment, the microorganism belongs to the genus Corynebacterium or Brevibacterium, with Corynebacterium glutamicum being particularly preferred. In a preferred embodiment, the microorganism is also utilized for the production of a desired compound, such as an amino acid, with lysine being particularly preferred.

In another aspect, the invention provides a method of identifying the presence or activity of Cornyebacterium diphtheriae in a subject. This method includes detection of one or more of the nucleic acid or amino acid sequences of the invention (e.g., the sequences set forth in Appendix A or Appendix B) in a subject, thereby detecting the presence or activity of Corynebacterium diphtheriae in the subject.

Still another aspect of the invention pertains to an isolated MCP protein or a portion, e.g., a biologically active portion, thereof. In a preferred embodiment, the isolated MCP protein or portion thereof is capable of modulating the production or efficiency of production of one or more fine chemicals from C glutamicum, or of serving as an identifying marker for *C. glutamicum* or related organisms. In another preferred embodiment, the isolated MCP protein or portion thereof is sufficiently homologous to an amino acid sequence of Appendix B such that the protein or portion thereof maintains the ability to, for example, modulate the production or efficiency of production of one or more fine chemicals from *C. glutamicum*, or to serve as identifying markers for *C. glutamicum* or related organisms.

The invention also provides an isolated preparation of an MCP protein. In preferred embodiments, the MCP protein comprises an amino acid sequence of Appendix B. In another preferred embodiment, the invention pertains to an isolated full length protein which is substantially homologous to an entire amino acid sequence of Appendix B (encoded by an open reading frame set forth in Appendix A). In yet another embodiment, the protein is at least about 50%, preferably at least about 60%, and more preferably at least about 70%, 80%, or 90%, and most preferably at least about 95%, 96%, 97%, 98%, or 99% or more homologous to an entire amino acid sequence of Appendix B. In other embodiments, the isolated MCP protein comprises an amino acid sequence which is at least about 50% or more homologous to one of the amino acid sequences of Appendix B and is able to modulate the yield, production, and/or efficiency of production of one or more fine chemicals from *C. glutamicum*, to degrade hydrocarbons, to oxidize terpenoids, to serve as a target for drug development, or to serve as an identifying marker for *C. glutamicum* or related organisms.

Alternatively, the isolated MCP protein can comprise an amino acid sequence which is encoded by a nucleotide sequence which hybridizes, e.g., hybridizes under stringent conditions, or is at least about 50%, preferably at least about 60%, more preferably at least about 70%, 80%, or 90%, and even more preferably at least about 95%, 96%, 97%, 98,%, or 99% or more homologous, to a nucleotide sequence of Appendix B. It is also preferred that the preferred forms of MCP proteins also have one or more of the MCP bioactivities described herein.

The MCP polypeptide, or a biologically active portion thereof, can be operatively linked to a non-MCP polypeptide to form a fusion protein. In preferred embodiments, this fusion protein has an activity which differs from that of the MCP protein alone. In other preferred embodiments, this fusion protein is capable of modulating the yield, production and/or efficiency of production of one or more fine chemicals from *C. glutamicum*, or of serving as an identifying marker for *C. glutamicum* or related organisms. In particularly preferred embodiments, integration of this fusion protein into a host cell modulates production of a desired compound from the cell.

In another aspect, the invention provides methods for screening molecules which modulate the activity of an MCP protein, either by interacting with the protein itself or a substrate or binding partner of the MCP protein, or by modulating the transcription or translation of an MCP nucleic acid molecule of the invention.

Another aspect of the invention pertains to a method for producing a fine chemical. This method involves the culturing of a cell containing a vector directing the expression of an MCP nucleic acid molecule of the invention, such that a fine chemical is produced. In a preferred embodiment, this method further includes the step of obtaining a cell containing such a vector, in which a cell is transfected with a vector directing the expression of an MCP nucleic acid. In another preferred embodiment, this method further includes the step of recovering the fine chemical from the culture. In a particularly preferred embodiment, the cell is from the genus *Corynebacterium* or *Brevibacterium*, or is selected from those strains set forth in Table 3.

Another aspect of the invention pertains to methods for modulating production of a molecule from a microorganism. Such methods include contacting the cell with an agent which modulates MCP protein activity or MCP nucleic acid expression such that a cell associated activity is altered relative to this same activity in the absence of the agent. In a preferred embodiment, the cell is modulated for one or more *C. glutamicum* MCP protein activities, such that the yield, production, and/or efficiency of production of a desired fine chemical by this microorganism is improved. The agent which modulates MCP protein activity can be an agent which stimulates MCP protein activity or MCP nucleic acid expression. Examples of agents which stimulate MCP protein activity or MCP nucleic acid expression include small molecules, active MCP proteins, and nucleic acids encoding MCP proteins that have been introduced into the cell. Examples of agents which inhibit MCP activity or expression include small molecules and antisense MCP nucleic acid molecules.

Another aspect of the invention pertains to methods for modulating yields, production, and/or efficiency of production of a desired compound from a cell, involving the introduction of a wild-type or mutant MCP gene into a cell, either maintained on a separate plasmid or integrated into the genome of the host cell. If integrated into the genome, such integration can be random, or it can take place by homologous recombination such that the native gene is replaced by the introduced copy, causing the production of the desired compound from the cell to be modulated. In a preferred embodiment, said yields are increased. In another preferred embodiment, said chemical is a fine chemical. In a particularly preferred embodiment, said fine chemical is an amino acid. In especially preferred embodiments, said amino acid is L-lysine.

DETAILED DESCRIPTION OF THE INVENTION

The present invention provides MCP nucleic acid and protein molecules. These MCP nucleic acid molecules may be utilized in the identification of *Corynebacterium glutamicum* or related organisms, in the mapping of the *C. glutamicum* genome (or a genome of a closely related organism), or in the identification of microorganisms which may be used to produce fine chemicals, e.g., by fermentation processes. The proteins encoded by these nucleic acids may be utilized in the direct or indirect modulation of the production or efficiency of production of one or more fine chemicals from *C. glutamicum*, as identifying markers for *C. glutamicum* or related organisms, in the oxidation of terpenoids or the degradation of hydrocarbons, or as targets for the development of therapeutic pharmaceutical compounds. Aspects of the invention are further explicated below.

I. Fine Chemicals

The term 'fine chemical' is art-recognized and includes molecules produced by an organism which have applications in various industries, such as, but not limited to, the pharmaceutical, agriculture, and cosmetics industries. Such compounds include organic acids, such as tartaric acid, itaconic acid, and diaminopimelic acid, both proteinogenic and non-proteinogenic amino acids, purine and pyrimidine bases, nucleosides, and nucleotides (as described e.g. in Kuninaka, A. (1996) Nucleotides and related compounds, p. 561–612, in Biotechnology vol. 6, Rehm et al., eds. VCH: Weinheim, and references contained therein), lipids, both saturated and unsaturated fatty acids (e.g., arachidonic acid), diols (e.g., propane diol, and butane diol), carbohydrates (e.g., hyaluronic acid and trehalose), aromatic compounds (e.g., aromatic amines, vanillin, and indigo), vitamins and cofactors (as described in Ullmann's Encyclopedia of Industrial Chemistry, vol. A27, "Vitamins", p. 443–613 (1996) VCH: Weinheim and references therein; and Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research Asia, held Sep. 1–3, 1994 at Penang, Malaysia, AOCS Press, (1995)), enzymes, polyketides (Cane et al. (1998) *Science* 282: 63–68), and all other chemicals described in Gutcho (1983) Chemicals by Fermentation, Noyes Data Corporation, ISBN: 0818805086 and references therein. The metabolism and uses of certain of these fine chemicals are further explicated below.

A. Amino Acid Metabolism and Uses

Amino acids comprise the basic structural units of all proteins, and as such are essential for normal cellular functioning in all organisms. The term "amino acid" is art-recognized. The proteinogenic amino acids, of which there are 20 species, serve as structural units for proteins, in which they are linked by peptide bonds, while the nonproteinogenic amino acids (hundreds of which are known) are not normally found in proteins (see Ulmann's Encyclopedia of Industrial Chemistry, vol. A2, p. 57–97 VCH: Weinheim (1985)). Amino acids may be in the D- or L- optical configuration, though L-amino acids are generally the only type found in naturally-occurring proteins.

Biosynthetic and degradative pathways of each of the 20 proteinogenic amino acids have been well characterized in both prokaryotic and eukaryotic cells (see, for example, Stryer, L. Biochemistry, 3rd edition, pages 578–590 (1988)). The 'essential' amino acids (histidine, isoleucine, leucine, lysine, methionine, phenylalanine, threonine, tryptophan, and valine), so named because they are generally a nutritional requirement due to the complexity of their biosyntheses, are readily converted by simple biosynthetic pathways to the remaining 11 'nonessential' amino acids (alanine, arginine, asparagine, aspartate, cysteine, glutarnate, glutamine, glycine, proline, serine, and tyrosine). Higher animals do retain the ability to synthesize some of these amino acids, but the essential amino acids must be supplied from the diet in order for normal protein synthesis to occur.

Aside from their function in protein biosynthesis, these amino acids are interesting chemicals in their own right, and many have been found to have various applications in the food, feed, chemical, cosmetics, agriculture, and pharmaceutical industries. Lysine is an important amino acid in the nutrition not only of humans, but also of monogastric animals such as poultry and swine. Glutamate is most commonly used as a flavor additive (mono-sodium glutamate, MSG) and is widely used throughout the food industry, as are aspartate, phenylalanine, glycine, and cysteine. Glycine, L-methionine and tryptophan are all utilized in the pharmaceutical industry. Glutamine, valine, leucine, isoleucine, histidine, arginine, proline, serine and alanine are of use in both the pharmaceutical and cosmetics industries. Threonine, tryptophan, and D/L-methionine are common feed additives. (Leuchtenberger, W. (1996) Amino aids— technical production and use, p. 466–502 in Rehm et al. (eds.) Biotechnology vol. 6, chapter 14a, VCH: Weinheim). Additionally, these amino acids have been found to be useful as precursors for the synthesis of synthetic amino acids and proteins, such as N-acetylcysteine, S-carboxymethyl-L-Cysteine, (S)-5-hydroxytryptophan, and others described in Ulmann's Encyclopedia of Industrial Chemistry, vol. A2, p. 57–97, VCH: Weinheim, 1985.

The biosynthesis of these natural amino acids in organisms capable of producing them, such as bacteria, has been well characterized (for review of bacterial amino acid biosynthesis and regulation thereof, see Umbarger, H. E.(1978) *Ann. Rev. Biochem.* 47: 533–606). Glutamate is synthesized by the reductive amination of $\alpha$-ketoglutarate, an intermediate in the citric acid cycle. Glutamine, proline, and arginine are each subsequently produced from glutamate. The biosynthesis of serine is a three-step process beginning with 3-phosphoglycerate (an intermediate in glycolysis), and resulting in this amino acid after oxidation, transamination, and hydrolysis steps. Both cysteine and glycine are produced from serine; the former by the condensation of homocysteine with serine, and the latter by the transferal of the side-chain $\beta$-carbon atom to tetrahydrofolate, in a reaction catalyzed by serine transhydroxymethylase. Phenylalanine, and tyrosine are synthesized from the glycolytic and pentose phosphate pathway precursors erythrose 4-phosphate and phosphoenolpyruvate in a 9-step biosynthetic pathway that differ only at the final two steps after synthesis of prephenate. Tryptophan is also produced from these two initial molecules, but its synthesis is an 11-step pathway. Tyrosine may also be synthesized from phenylalanine, in a reaction catalyzed by phenylalanine hydroxylase. Alanine, valine, and leucine are all biosynthetic products of pyruvate, the final product of glycolysis. Aspartate is formed from oxaloacetate, an intermediate of the citric acid cycle. Asparagine, methionine, threonine, and lysine are each produced by the conversion of aspartate. Isoleucine is formed from threonine. A complex 9-step pathway results in the production of histidine from 5-phosphoribosyl-1-pyrophosphate, an activated sugar.

Amino acids in excess of the protein synthesis needs of the cell cannot be stored, and are instead degraded to provide intermediates for the major metabolic pathways of the cell (for review see Stryer, L. Biochemistry 3rd ed. Ch. 21 "Amino Acid Degradation and the Urea Cycle" p. 495–516 (1988). Although the cell is able to convert unwanted amino acids into useful metabolic intermediates, amino acid production is costly in terms of energy, precursor molecules, and the enzymes necessary to synthesize them. Thus it is not surprising that amino acid biosynthesis is regulated by feedback inhibition, in which the presence of a particular amino acid serves to slow or entirely stop its own production (for overview of feedback mechanisms in amino acid biosynthetic pathways, see Stryer, L. Biochemistry, $3^{rd}$ ed. Ch. 24: "Biosynthesis of Amino Acids and Heme" p. 575–600 (1988)). Thus, the output of any particular amino acid is limited by the amount of that amino acid present in the cell.

B. Vitamin, Cofactor and Nutraceutical Metabolism and Uses

Vitamin, cofactors, and nutraceuticals comprise another group of molecules which the higher animals have lost the ability to synthesize and so must ingest, although they are readily synthesized by other organisms such as bacteria. These molecules are either bioactive substances themselves, or are precursors of biologically active substances which may serve as electron carriers or intermediates in a variety of metabolic pathways. Aside from their nutritive value, these compounds also have significant industrial value as coloring agents, antioxidants, and catalysts or other processing aids. (For an overview of the structure, activity, and industrial applications of these compounds, see, for example, Ullman's Encyclopedia of Industrial Chemistry, "Vitamins" vol. A27, p. 443–613, VCH: Weinheim, 1996.) The term "vitamin" is art-recognized, and includes nutrients which are required by an organism for normal functioning, but which that organism cannot synthesize by itself. The group of vitamins may encompass cofactors and nutraceutical compounds. The language "cofactor" includes nonproteinaceous compounds required for a normal enzymatic activity to occur. Such compounds may be organic or inorganic; the cofactor molecules of the invention are preferably organic. The term "nutraceutical" includes dietary supplements having health benefits in plants and animals, particularly humans. Examples of such molecules are vitamins, antioxidants, and also certain lipids (e.g., polyunsaturated fatty acids).

The biosynthesis of these molecules in organisms capable of producing them, such as bacteria, has been largely characterized (Ullman's Encyclopedia of Industrial Chemistry, "Vitamins" vol. A27, p. 443–613, VCH: Weinheim, 1996; Michal, G. (1999) Biochemical Pathways: An Atlas of Biochemistry and Molecular Biology, John Wiley & Sons; Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1–3, 1994 at Penang, Malaysia, AOCS Press: Champaign, Ill. X, 374 S).

Thiamin (vitamin $B_1$) is produced by the chemical coupling of pyrimidine and thiazole moieties. Riboflavin (vitamin $B_2$) is synthesized from guanosine-5'-triphosphate (GTP) and ribose-5'-phosphate. Riboflavin, in turn, is utilized for the synthesis of flavin mononucleotide (FMN) and flavin adenine dinucleotide (FAD). The family of compounds collectively termed 'vitamin $B_6$' (e.g., pyridoxine, pyridoxamine, pyridoxa-5'-phosphate, and the commercially used pyridoxin hydrochloride) are all derivatives of the common structural unit, 5-hydroxy-6-methylpyridine. Pantothenate (pantothenic acid, (R)-(+)—N-(2,4-dihydroxy-3,3-dimethyl-β-oxobutyl)-α-alanine) can be produced either by chemical synthesis or by fermentation. The final steps in pantothenate biosynthesis consist of the ATP-driven condensation of β-alanine and pantoic acid. The enzymes responsible for the biosynthesis steps for the conversion to pantoic acid, to β-alanine and for the condensation to panthotenic acid are known. The metabolically active form of panthotenate is Coenzyme A, for which the biosynthesis proceeds in 5 enzymatic steps. Pantothenate, pyridoxal-5'-phosphate, cysteine and ATP are the precursors of Coenzyme A. These enzymes not only catalyze the formation of panthothante, but also the production of (R)-pantoic acid, (R)-pantolacton, (R)-panthenol (provitamin $B_5$), pantetheine (and its derivatives) and coenzyme A.

Biotin biosynthesis from the precursor molecule pimeloyl-CoA in microorganisms has been studied in detail and several of the genes involved have been identified. Many of the corresponding proteins have been found to also be involved in Fe-cluster synthesis and are members of the nifS class of proteins. Lipoic acid is derived from octanoic acid, and serves as a coenzyme in energy metabolism, where it becomes part of the pyruvate dehydrogenase complex and the α-ketoglutarate dehydrogenase complex. The folates are a group of substances which are all derivatives of folic acid, which is turn is derived from L-glutamic acid, p-aminobenzoic acid and 6-methylpterin. The biosynthesis of folic acid and its derivatives, starting from the metabolism intermediates guanosine-5'-triphosphate (GTP), L-glutamic acid and p-amino-benzoic acid has been studied in detail in certain microorganisms.

Corrinoids (such as the cobalamines and particularly vitamin $B_{12}$) and porphyrines belong to a group of chemicals characterized by a tetrapyrole ring system The biosynthesis of vitamin $B_{12}$ is sufficiently complex that it has not yet been completely characterized, but many of the enzymes and substrates involved are now known. Nicotinic acid (nicotinate), and nicotinamide are pyridine derivatives which are also termed 'niacin'. Niacin is the precursor of the important coenzymes NAD (nicotinamide adenine dinucleotide) and NADP (nicotinamide adenine dinucleotide phosphate) and their reduced forms.

The large-scale production of these compounds has largely relied on cell-free chemical syntheses, though some of these chemicals have also been produced by large-scale culture of microorganisms, such as riboflavin, Vitamin $B_6$, pantothenate, and biotin. Only Vitamin $B_2$ is produced solely by fermentation, due to the complexity of its synthesis. In vitro methodologies require significant inputs of materials and time, often at great cost.

C. Purine, Pyrimidine, Nucleoside and Nucleotide Metabolism and Uses

Purine and pyrimidine metabolism genes and their corresponding proteins are important targets for the therapy of tumor diseases and viral infections. The language "purine" or "pyrimidine" includes the nitrogenous bases which are constituents of nucleic acids, co-enzymes, and nucleotides. The term "nucleotide" includes the basic structural units of nucleic acid molecules, which are comprised of a nitrogenous base, a pentose sugar (in the case of RNA, the sugar is ribose; in the case of DNA, the sugar is D-deoxyribose), and phosphoric acid. The language "nucleoside" includes molecules which serve as precursors to nucleotides, but which are lacking the phosphoric acid moiety that nucleotides possess. By inhibiting the biosynthesis of these molecules, or their mobilization to form nucleic acid molecules, it is possible to inhibit RNA and DNA synthesis; by inhibiting this activity in a fashion targeted to cancerous cells, the ability of tumor cells to divide and replicate may be inhibited. Additionally, there are nucleotides which may serve as energy stores (e.g., ADP, ATP) or as coenzymes (i.e., FAD and NAD).

Several publications have described the use of these chemicals for these medical indications, by influencing purine and/or pyrimidine metabolism (e.g. Christopherson, R. I. and Lyons, S. D. (1990) "Potent inhibitors of de novo pyrimidine and purine biosynthesis as chemotherapeutic agents." Med. Res. Reviews 10: 505–548). Studies of enzymes involved in purine and pyrimidine metabolism have been focused on the development of new drugs which can be used, for example, as immunosuppressants or antiproliferants (Smith, J. L., (1995) "Enzymes in nucleotide synthesis." Curr. Opin. Struct. Biol. 5: 752–757; (1995) Biochem Soc. Transact. 23: 877–902). However, purine and pyrimidine bases, nucleosides and nucleotides have other utilities: as intermediates in the biosynthesis of several fine chemicals (e.g., thiamine, S-adenosyl-methionine, folates, or riboflavin), as energy carriers for the cell (e.g., ATP or GTP), and for chemicals themselves, commonly used as flavor enhancers (e.g., IMP or GMP) or for several medicinal applications (see, for example, Kuninaka, A. (1996) Nucleotides and Related Compounds in Biotechnology vol. 6, Rehm et al., eds. VCH: Weinheim, p. 561–612). Also, enzymes involved in purine, pyrimidine, nucleoside, or nucleotide metabolism are increasingly serving as targets against which chemicals for crop protection, including fungicides, herbicides and insecticides, are developed.

The metabolism of these compounds in bacteria has been characterized (for reviews see, for example, Zalkin, H. and Dixon, J. E. (1992) "de novo purine nucleotide biosynthesis", in: Progress in Nucleic Acid Research and Molecular Biology, vol. 42, Academic Press:, p. 259–287; and Michal, G. (1999) "Nucleotides and Nucleosides", Chapter 8 in: Biochemical Pathways: An Atlas of Biochemistry and Molecular Biology, Wiley: New York). Purine metabolism has been the subject of intensive research, and is essential to the normal functioning of the cell. Impaired purine metabolism in higher animals can cause severe disease, such as gout. Purine nucleotides are synthesized from ribose-5-phosphate, in a series of steps through the intermediate compound inosine-5'-phosphate (IMP), resulting in the production of guanosine-5'-monophosphate (GMP) or adenosine-5'-monophosphate (AMP), from which the triphosphate forms utilized as nucleotides are readily formed. These compounds are also utilized as energy stores, so their degradation provides energy for many different biochemical processes in the cell. Pyrimidine biosynthesis proceeds by the format ion of uridine-5'-monophosphate (UMP) from ribose-5-phosphate. UMP, in turn, is converted to cytidine-5'-triphosphate (CTP). The deoxy- forms of all of these nucleotides are produced in a one step reduction reaction from the diphosphate ribose form of the nucleotide to the diphosphate deoxyribose form of the nucleotide. Upon phosphorylation, these molecules are able to participate in DNA synthesis.

D. Trehalose Metabolism and Uses

Trehalose consists of two glucose molecules, bound in α, α-1,1 linkage. It is commonly used in the food industry as a sweetener, an additive for dried or frozen foods, and in beverages. However, it also has applications in the pharmaceutical, cosmetics and biotechnology industries (see, for example, Nishimoto et al., (1998) U.S. Pat. No. 5,759,610; Singer, M. A. and Lindquist, S. (998) Trends Biotech. 16: 460–467; Paiva, C. L. A. and Panek, A. D. (1996) Biotech. Ann. Rev. 2: 293–314; and Shiosaka, M. (1997) J. Japan 172: 97–102). Trehalose is produced by enzymes from many microorganisms and is naturally released into the surrounding medium, from which it can be collected us ing met hods known in the art.

II. Elements and Methods of the Invention

The present invention is based, at least in part, on the discovery of novel molecules, referred to herein as MCP nucleic acid molecules. These MCP nucleic acid molecules are useful not only for the identification of C. glutamicum or related bacterial species, but also as markers for the mapping of the C. glutamicum genome and in the identification of bacteria useful for the production of fine chemicals by, e.g., fermentative processes. The present invention is also based, at least in part, on the MCP protein molecules encoded by these MCP nucleic acid molecules. These MCP proteins are capable of modulating the yield, production, and/or efficiency of production of one or more fine chemicals from C. glutamicum, of serving as identifying markers for C. glutamicum or related organisms, of degrading hydrocarbons, and of serving as targets for the development of therapeutic pharmaceutical compounds. In one embodiment, the MCP molecules of the invention directly or indirectly participate in one or more fine chemical metabolic pathways in C. glutamicum. In a preferred embodiment, the activity the MCP molecules of the invention to indirectly or directly participate in such metabolic pathways has an impact on the production of a desired fine chemical by this microorganism. In a particularly preferred embodiment, the MCP molecules of the invention are modulated in activity, such that the C. glutamicum metabolic pathways in which the MCP proteins of the invention participate are modulated in efficiency or output, which either directly or indirectly modulates the production or efficiency of production of a desired fine chemical by C. glutamicum.

The language, "MCP protein" or "MCP polypeptide" includes proteins which are able to modulate the yield, production, and/or efficiency of production of one or more fine chemicals from C. glutamicum, to degrade hydrocarbons, to oxidize terpenoids, to serve as a target protein for drug screening or design, or to serve as identifying markers for C. glutamicum or related organisms. Examples of MCP proteins include those encoded by the MCP genes set forth in Table 1 and Appendix A. The terms "MCP gene" or "MCP nucleic acid sequence" include nucleic acid sequences encoding an MCP protein, which consist of a coding region and also corresponding untranslated 5' and 3' sequence regions. Examples of MCP genes include those set forth in Table 1. The terms "production" or "productivity" are art-recognized and include the concentration of the fermentation product (for example, the desired fine chemical) formed within a given time and a given fermentation volume (e.g., kg product per hour per liter). The term "efficiency of production" includes the time required for a particular level of production to be achieved (for example, how long it takes for the cell to attain a particular rate of output of a fine chemical). The term "yield" or "product/carbon yield" is art-recognized and includes the efficiency of the conversion of the carbon source into the product (ie., fine chemical). This is generally written as, for example, kg product per kg carbon source. By increasing the yield or production of the compound, the quantity of recovered molecules, or of useful recovered molecules of that compound in a given amount of culture over a given amount of time is increased. The terms "biosynthesis" or a "biosynthetic pathway" are art-recognized and include the synthesis of a compound, preferably an organic compound, by a cell from intermediate compounds in what may be a multistep and highly regulated process. The terms "degradation" or a "degradation pathway" are art-recognized and include the breakdown of a compound, preferably an organic compound, by a cell to degradation products (generally speaking, smaller or less complex molecules) in what may be a multistep and highly regulated process. The language "metabolism" is art-recognized and includes the totality of the biochemical reactions that take place in an organism. The metabolism of a particular compound, then, (e.g., the metabolism of an amino acid such as glycine) comprises the overall biosynthetic, modification, and degradation pathways in the cell related to this compound.

In another embodiment, the MCP molecules of the invention are capable of modulating the production of a desired molecule, such as a fine chemical, in a microorganism such as C. glutamicum, either directly or indirectly. Using recombinant genetic techniques, one or more of the MCP proteins of the invention may be manipulated such that its function is modulated. Such modulation of function may result in the modulation of the yield, production, and/or efficiency of production of one or more fine chemicals from C. glutamicum.

For example, by modifying the activity of a protein involved in the biosynthesis or degradation of a fine chemical (i.e., through mutagenesis of the corresponding gene), one may directly modulate the ability of the cell to synthesize or to degrade this compound, thereby modulating the yield and/or efficiency of production of the fine chemical. Similarly, by modulating the activity of a protein which regulates a fine chemical metabolic pathway, one may directly influence whether the production of the desired compound is up- or down-regulated, either of which will modulate the yield or efficiency of production of the fine chemical from the cell.

Indirect modulation of fine chemical production may also result by modifying the activity of a protein of the invention (i.e., by mutagenesis of the corresponding gene) such that the overall ability of the cell to grow and divide or to remain viable and productive is increased. The production of fine chemicals from *C. glutamicum* is generally accomplished by the large-scale fermentative culture of these microorganisms, conditions which are frequently suboptimal for growth and cell division. By engineering a protein of the invention (e.g., a stress response protein, a cell wall protein, or proteins involved in the metabolism of compounds necessary for cell growth and division to occur, such as nucleotides and amino acids) such that it is better able to survive, grow, and multiply in such conditions, it may be possible to increase the number and productivity of such engineered *C. glutamicum* cells in large-scale culture, which in turn should result in increased yields and/or efficiency of production of one or more desired fine chemicals. Further, the metabolic pathways of any cell are necessarily interrelated and coregulated. By altering the activity or regulation of any one metabolic pathway in *C. glutamicum* (i.e., by altering the activity of one of the proteins of the invention which participates in such a pathway), it is possible to concomitantly alter the activity or regulation of other metabolic pathways in this microorganism, which may be directly involved in the synthesis or degradation of a fine chemical.

The isolated nucleic acid sequences of the invention are contained within the genome of a *Corynebacterium glutamicum* strain available through the American Type Culture Collection, given designation ATCC 13032. The nucleotide sequences of the isolated *C. glutamicum* MCP nucleic acid molecules and the predicted amino acid sequences of the *C. glutamicum* MCP proteins are shown in Appendices A and B, respectively. Computational analyses were performed which classified and/or identified many of these nucleotide sequences as sequences having homology to *E. coli* or *Bacillus subtilis* genes.

The present invention also pertains to proteins which have an amino acid sequence which is substantially homologous to an amino acid sequence of Appendix B.

As used herein, a protein which has an amino acid sequence which is substantially homologous to a selected amino acid sequence is least about 50% homologous to the selected amino acid sequence, e.g., the entire selected amino acid sequence. A protein which has an amino acid sequence which is substantially homologous to a selected amino acid sequence can also be least about 50–60%, preferably at least about 60–70%, and more preferably at least about 70–80%, 80–90%, or 90–95%, and most preferably at least about 96%, 97%, 98%, 99% or more homologous to the selected amino acid sequence.

The MCP protein or a biologically active portion or fragment thereof of the invention is able to modulate the yield, production, and/or efficiency of production of one or more fine chemicals from *C. glutamicum*, to degrade hydrocarbons, to oxidize terpenoids, to serve as a target for drug development, or to serve as an identifying marker for *C. glutamicum* or related organisms.

Various aspects of the invention are described in further detail in the following subsections:

A. Isolated Nucleic Acid Molecules

One aspect of the invention pertains to isolated nucleic acid molecules that encode MCP polypeptides or biologically active portions thereof, as well as nucleic acid fragments sufficient for use as hybridization probes or primers for the identification or amplification of MCP-encoding nucleic acid (e.g., MCP DNA). These nucleic acid molecules may be used to identify *C. glutamicum* or related organisms, to map the genome of *C. glutamicum* or closely related bacteria, or to identify microorganisms useful for the production of fine chemicals, e.g., by fermentative processes. As used herein, the term "nucleic acid molecule" is intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of the gene: at least about 100 nucleotides of sequence upstream from the 5' end of the coding region and at least about 20 nucleotides of sequence downstream from the 3' end of the coding region of the gene. The nucleic acid molecule can be single-stranded or double-stranded, but preferably is double-stranded DNA. An "isolated" nucleic acid molecule is one which is separated from other nucleic acid molecules which are present in the natural source of the nucleic acid. Preferably, an "isolated" nucleic acid is free of sequences which naturally flank the nucleic acid (ie., sequences located at the 5' and 3' ends of the nucleic acid) in the genomic DNA of the organism from which the nucleic acid is derived. For example, in various embodiments, the isolated MCP nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived (e.g, a *C. glutamicum* cell). Moreover, an "isolated" nucleic acid molecule, such as a DNA molecule, can be substantially free of other cellular material, or culture medium when produced by recombinant techniques, or chemical precursors or other chemicals when chemically synthesized.

A nucleic acid molecule of the present invention, e.g., a nucleic acid molecule having a nucleotide sequence of Appendix A, or a portion thereof, can be isolated using standard molecular biology techniques and the sequence information provided herein. For example, a *C. glutamicum* MCP DNA can be isolated from a *C. glutamicum* library using all or portion of one of the sequences of Appendix A as a hybridization probe and standard hybridization techniques (e.g., as described in Sambrook, J., Fritsh, E. F., and Maniatis, T. *Molecular Cloning: A Laboratory Manual.* 2nd ed, Cold Spring Harbor Laboratory, Cold Spring Harbor Laboratory Press, Cold Spring Harbor, N.Y., 1989). Moreover, a nucleic acid molecule encompassing all or a portion of one of the sequences of Appendix A can be isolated by the polymerase chain reaction using oligonucleotide primers designed based upon this sequence (e.g., a nucleic acid molecule encompassing all or a portion of one of the sequences of Appendix A can be isolated by the polymerase chain reaction using oligonucleotide primers designed based upon this same sequence of Appendix A). For example, mRNA can be isolated from normal endothelial cells (e.g., by the guanidinium-thiocyanate extraction procedure of Chirgwin et al. (1979) *Biochemistry* 18: 5294–5299) and DNA can be prepared using reverse transcriptase (e.g., Moloney MLV reverse transcriptase, available from Gibco/BRL, Bethesda, Md., or AMV reverse transcriptase, available from Seikagaku America, Inc., St. Petersburg, Fla.) and random polynucleotide primers or oligonucleotide primers based upon one of the nucleotide sequences shown in Appendix A. Synthetic oligonucleotide primers for polymerase chain reaction amplification can be designed based upon one of the nucleotide sequences shown in Appendix A. A nucleic acid of the invention can be amplified using cDNA or, alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to an MCP nucleotide sequence can be prepared by standard synthetic techniques, e.g., using an automated DNA synthesizer.

In a preferred embodiment, an isolated nucleic acid molecule of the invention comprises one of the nucleotide sequences shown in Appendix A. The sequences of Appendix A correspond to the *Corynebacterium glutamicum* MCP DNAs of the invention. This cDNA comprises sequences encoding MCP proteins (i.e., the "coding region", indicated in each sequence in Appendix A), as well as 5' untranslated sequences and 3' untranslated sequences, also indicated in Appendix A. Alternatively, the nucleic acid molecule can comprise only the coding region of any of the sequences in Appendix A.

For the purposes of this application, it will be understood that each of the sequences set forth in Appendix A has an identifying RXA or RXN number having the designation "RXA" or "RXN" followed by 5 digits (ie., RXA00003 or RXN00022). Each of these sequences comprises up to three parts: a 5' upstream region, a coding region, and a downstream region. Each of these three regions is identified by the same RXA or RXN designation to eliminate confusion. The recitation "one of the sequences in Appendix A", then, refers to any of the sequences in Appendix A, which may be distinguished by their differing RXA or RXN designations. The coding region of each of these sequences is translated into a corresponding amino acid sequence, which is set forth in Appendix B. The sequences of Appendix B are identified by the same RXA or RXN designations as Appendix A, such that they can be readily correlated. For example, the amino acid sequence in Appendix B designated RXA00003 is a translation of the coding region of the nucleotide sequence of nucleic acid molecule RXA00003 in Appendix A, and the amino acid sequence in Appendix B designated RXN00022 is a translation of the coding region of the nucleotide sequence of nucleic acid molecule RXN00022 in Appendix A. Each of the RXA and RXN nucleotide and amino acid sequences of the invention has also been assigned a SEQ ID NO, as indicated in Table 1.

Several of the genes of the invention are "F-designated genes". An F-designated gene includes those genes set forth in Table 1 which have an 'F' in front of the RXA designation. For example, SEQ ID NO:3, designated, as indicated on Table 1, as "F RXA01638", is an F-designated gene, as are SEQ ID NOs: 5, 9, and 11 (designated on Table 1 as "F RXA01639", "F RXA01590", and "F RXA01542", respectively).

In one embodiment, the nucleic acid molecules of the present invention are not intended to include those compiled in Table 2.

In another preferred embodiment an isolated nucleic acid molecule of the invention comprises a nucleic acid molecule which is a complement of one of the nucleotide sequences shown in Appendix A, or a portion thereof. A nucleic acid molecule which is complementary to one of the nucleotide sequences shown in Appendix A is one which is sufficiently complementary to one of the nucleotide sequences shown in Appendix A such that it can hybridize to one of the nucleotide sequences shown in Appendix A, thereby forming a stable duplex.

In still another preferred embodiment, an isolated nucleic acid molecule of the invention comprises a nucleotide sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to a nucleotide sequence shown in Appendix A, or a portion thereof. Ranges and identity values intermediate to the above-recited ranges, (e.g., 70–90% identical or 80–95% identical) are also intended to be encompassed by the present invention. For example, ranges of identity values using a combination of any of the above values recited as upper and/or lower limits are intended to be included. In an additional preferred embodiment, an isolated nucleic acid molecule of the invention comprises a nucleotide sequence which hybridizes, e.g., hybridizes under stringent conditions, to one of the nucleotide sequences shown in Appendix A, or a portion thereof.

Moreover, the nucleic acid molecule of the invention can comprise only a portion of the coding region of one of the sequences in Appendix A, for example a fragment which can be used as a probe or primer or a fragment encoding a biologically active portion of an MCP protein. The nucleotide sequences determined from the cloning of the MCP genes from *C. glutamicum* allows for the generation of probes and primers designed for use in identifying and/or cloning MCP homologues in other cell types and organisms, as well as MCP homologues from other *Corynebacteria* or related species. The probe/primer typically comprises substantially purified oligonucleotide. The oligonucleotide typically comprises a region of nucleotide sequence that hybridizes under stringent conditions to at least about 12, preferably about 25, more preferably about 40, 50 or 75 consecutive nucleotides of a sense strand of one of the sequences set forth in Appendix A, an anti-sense sequence of one of the sequences set forth in Appendix A, or naturally occurring mutants thereof. Primers based on a nucleotide sequence of Appendix A can be used in PCR reactions to clone MCP homologues. Probes based on the MCP nucleotide sequences can be used to detect transcripts or genomic sequences encoding the same or homologous proteins. In preferred embodiments, the probe further comprises a label group attached thereto, e.g. the label group can be a radioisotope, a fluorescent compound, an enzyme, or an enzyme cofactor. Such probes can be used as a part of a diagnostic test kit for identifying cells which misexpress an MCP protein, such as by measuring a level of an MCP-encoding nucleic acid in a sample of cells, e.g., detecting MCP mRNA levels or determining whether a genomic MCP gene has been mutated or deleted.

In one embodiment, the nucleic acid molecule of the invention encodes a protein or portion thereof which includes an amino acid sequence which is sufficiently homologous to an amino acid sequence of Appendix B such that the protein or portion thereof maintains the ability to modulate the yield, production, and/or efficiency of production of one or more fine chemicals from *C. glutamicum*, to degrade hydrocarbons, to oxidize terpenoids, to serve as a target for drug development, or to serve as an identifying marker for *C. glutamicum* or related organisms. As used herein, the language "sufficiently homologous" refers to proteins or portions thereof which have amino acid sequences which include a minimum number of identical or equivalent (e.g., an amino acid residue which has a similar side chain as an amino acid residue in one of the sequences of Appendix B) amino acid residues to an amino acid sequence of Appendix B such that the protein or portion thereof is able to modulate the yield, production, and/or efficiency of production of one or more fine chemicals from *C. glutamicum*, to degrade hydrocarbons, to oxidize terpenoids, to serve as a target for drug development, or to serve as an identifying marker for *C. glutamicum* or related organisms. Examples of such activities are also described herein. Thus, "the function of an MCP protein" contributes to the overall regulation of one or more fine chemical metabolic pathways, or to the degradation of a hydrocarbon, or to the oxidation of a terpenoid.

In another embodiment, the protein is at least about 50–60%, preferably at least about 60–70%, and more preferably at least about 70–80%, 80–90%, 90–95%, and most preferably at least about 96%, 97%, 98%, 99% or more homologous to an entire amino acid sequence of Appendix B.

Portions of proteins encoded by the MCP nucleic acid molecules of the invention are preferably biologically active portions of one of the MCP proteins. As used herein, the term "biologically active portion of an MCP protein" is intended to include a portion, e.g., a domain/motif, of an MCP protein that modulates the yield, production, and/or efficiency of production of one or more fine chemicals from *C. glutamicum*, that degrades hydrocarbons, that oxidizes terpenoids, that may serve as a target for drug development, or that may serve as an identifying marker for *C. glutamicum* or related organisms. To determine whether an MCP protein or a biologically active portion thereof can modulate the yield, production, and/or efficiency of production of one or more fine chemicals from *C. glutamicum*, can degrade hydrocarbons, or can oxidize terpenoids, an assay of activity may be performed. Such assay methods are well known to those of ordinary skill in the art, as detailed in Example 8 of the Exemplification.

Additional nucleic acid fragments encoding biologically active portions of an MCP protein can be prepared by isolating a portion of one of the sequences in Appendix B, expressing the encoded portion of the MCP protein or peptide (e.g., by recombinant expression in vitro) and assessing the activity of the encoded portion of the MCP protein or peptide.

The invention further encompasses nucleic acid molecules that differ from one of the nucleotide sequences shown in Appendix A (and portions thereof) due to degeneracy of the genetic code and thus encode the same MCP protein as that encoded by the nucleotide sequences shown in Appendix A. In another embodiment, an isolated nucleic acid molecule of the invention has a nucleotide sequence encoding a protein having an amino acid sequence shown in Appendix B. In a still further embodiment, the nucleic acid molecule of the invention encodes a full length *C. glutamicum* protein which is substantially homologous to an amino acid sequence of Appendix B (encoded by an open reading frame shown in Appendix A).

It will be understood by one of ordinary skill in the art that in one embodiment the sequences of the invention are not meant to include the sequences of the prior art, such as those Genbank sequences set forth in Tables 2 or 4 which were available prior to the present invention. In one embodiment, the invention includes nucleotide and amino acid sequences having a percent identity to a nucleotide or amino acid sequence of the invention which is greater than that of a sequence of the prior art (e.g., a Genbank sequence (or the protein encoded by such a sequence) set forth in Tables 2 or 4). For example, the invention includes a nucleotide sequence which is greater than and/or at least 39% identical to the nucleotide sequence designated RXA00008 (SEQ ID NO: 1549), a nucleotide sequence which is greater than and/or at least 42% identical to the nucleotide sequence designated RXA00059 (SEQ ID NO: 1571), and a nucleotide sequence which is greater than and/or at least 39% identical to the nucleotide sequence designated RXA00096 (SEQ ID NO:93). One of ordinary skill in the art would be able to calculate the lower threshold of percent identity for any given sequence of the invention by examining the GAP-calculated percent identity scores set forth in Table 4 for each of the three top hits for the given sequence, and by subtracting the highest GAP-calculated percent identity from 100 percent. One of ordinary skill in the art will also appreciate that nucleic acid and amino acid sequences having percent identities greater than the lower threshold so calculated (e.g., at least 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more identical) are also encompassed by the invention.

In addition to the *C. glutamicum* MCP nucleotide sequences shown in Appendix A, it will be appreciated by those of ordinary skill in the art that DNA sequence polymorphisms that lead to changes in the amino acid sequences of MCP proteins may exist within a population (e.g., the *C. glutamicum* population). Such genetic polymorphism in the MCP gene may exist among individuals within a population due to natural variation. As used herein, the terms "gene" and "recombinant gene" refer to nucleic acid molecules comprising an open reading frame encoding an MCP protein, preferably a *C. glutamicum* MCP protein. Such natural variations can typically result in 1–5% variance in the nucleotide sequence of the MCP gene. Any and all such nucleotide variations and resulting amino acid polymorphisms in MCP that are the result of natural variation and that do not alter the functional activity of MCP proteins are intended to be within the scope of the invention.

Nucleic acid molecules corresponding to natural variants and non-*C. glutamicum* homologues of the *C. glutamicum* MCP DNA of the invention can be isolated based on their homology to the *C. glutamicum* MCP nucleic acid disclosed herein using the *C. glutamicum* DNA, or a portion thereof, as a hybridization probe according to standard hybridization techniques under stringent hybridization conditions. Accordingly, in another embodiment, an isolated nucleic acid molecule of the invention is at least 15 nucleotides in length and hybridizes under stringent conditions to the nucleic acid molecule comprising a nucleotide sequence of Appendix A. In other embodiments, the nucleic acid is at least 30, 50, 100, 250 or more nucleotides in length. As used herein, the term "hybridizes under stringent conditions" is intended to describe conditions for hybridization and washing under which nucleotide sequences at least 60% homologous to each other typically remain hybridized to each other.

Preferably, the conditions are such that sequences at least about 65%, more preferably at least about 70%, and even more preferably at least about 75% or more homologous to each other typically remain hybridized to each other. Such stringent conditions are known to those of ordinary skill in the art and can be found in *Current Protocols in Molecular Biology*, John Wiley & Sons, N.Y. (1989), 6.3.1–6.3.6. A preferred, non-limiting example of stringent hybridization conditions are hybridization in 6× sodium chloride/sodium citrate (SSC) at about 45° C., followed by one or more washes in 0.2×SSC, 0.1% SDS at 50–65° C.

Preferably, an isolated nucleic acid molecule of the invention that hybridizes under stringent conditions to a sequence of Appendix A corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein). In one embodiment, the nucleic acid encodes a natural *C. glutamicum* MCP protein.

In addition to naturally-occurring variants of the MCP sequence that may exist in the population, one of ordinary skill in the art will further appreciate that changes can be introduced by mutation into a nucleotide sequence of Appendix A, thereby leading to changes in the amino acid sequence of the encoded MCP protein, without altering the functional ability of the MCP protein. For example, nucleotide substitutions leading to amino acid substitutions at "non-essential" amino acid residues can be made in a sequence of Appendix A. A "non-essential" amino acid residue is a residue that can be altered from the wild-type sequence of one of the MCP proteins (Appendix B) without altering the activity of said MCP protein, whereas an "essential" amino acid residue is required for MCP protein activity. Other amino acid residues, however, (e.g., those that are not conserved or only semi-conserved in the domain having MCP activity) may not be essential for activity and thus are likely to be amenable to alteration without altering MCP activity.

Accordingly, another aspect of the invention pertains to nucleic acid molecules encoding MCP proteins that contain changes in amino acid residues that are not essential for MCP activity. Such MCP proteins differ in amino acid sequence from a sequence contained in Appendix B yet retain at least one of the MCP activities described herein. In one embodiment, the isolated nucleic acid molecule comprises a nucleotide sequence encoding a protein, wherein the protein comprises an amino acid sequence at least about 50% homologous to an amino acid sequence of Appendix B and is able to modulate the yield, production, and/or efficiency of production of one or more fine chemicals from *C. glutamicum*, to degrade hydrocarbons, to oxidize terpenoids, to serve as a target for drug development, or to serve as an identifying marker for *C. glutamicum* or related organisms. Preferably, the protein encoded by the nucleic acid molecule is at least about 50–60% homologous to one of the sequences in Appendix B, more preferably at least about 60–70% homologous to one of the sequences in Appendix B, even more preferably at least about 70–80%, 80–90%, 90–95% homologous to one of the sequences in Appendix B, and most preferably at least about 96%, 97%, 98%, or 99% homologous to one of the sequences in Appendix B.

To determine the percent homology of two amino acid sequences (e.g., one of the sequences of Appendix B and a mutant form thereof) or of two nucleic acids, the sequences are aligned for optimal comparison purposes (e.g., gaps can be introduced in the sequence of one protein or nucleic acid for optimal alignment with the other protein or nucleic acid). The amino acid residues or nucleotides at corresponding amino acid positions or nucleotide positions are then compared. When a position in one sequence (e.g., one of the sequences of Appendix B) is occupied by the same amino acid residue or nucleotide as the corresponding position in the other sequence (e.g. a mutant form of the sequence selected from Appendix B), then the molecules are homologous at that position (i.e., as used herein amino acid or nucleic acid "homology" is equivalent to amino acid or nucleic acid "identity"). The percent homology between the two sequences is a function of the number of identical positions shared by the sequences (i.e., % homology=# of identical positions/total # of positions×100).

An isolated nucleic acid molecule encoding an MCP protein homologous to a protein sequence of Appendix B can be created by introducing one or more nucleotide substitutions, additions or deletions into a nucleotide sequence of Appendix A such that one or more amino acid substitutions, additions or deletions are introduced into the encoded protein. Mutations can be introduced into one of the sequences of Appendix A by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in an MCP protein is preferably replaced with another amino acid residue from the same side chain family. Alternatively, in another embodiment, mutations can be introduced randomly along all or part of an MCP coding sequence, such as by saturation mutagenesis, and the resultant mutants can be screened for an MCP activity described herein to identify mutants that retain MCP activity. Following mutagenesis of one of the sequences of Appendix A, the encoded protein can be expressed recombinantly and the activity of the protein can be determined using, for example, assays described herein (see Example 8 of the Exemplification).

In addition to the nucleic acid molecules encoding MCP proteins described above, another aspect of the invention pertains to isolated nucleic acid molecules which are antisense thereto. An "antisense" nucleic acid comprises a nucleotide sequence which is complementary to a "sense" nucleic acid encoding a protein, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire MCP coding sand, or to only a portion thereof. In one embodiment, an antisense nucleic acid molecule is antisense to a "coding region" of the coding strand of a nucleotide sequence encoding an MCP protein. The term "coding region" refers to the region of the nucleotide sequence comprising codons which are translated into amino acid residues (e.g., the entire coding region of SEQ ID NO. 1 (RXN01638) comprises nucleotides 1 to 900°). In another embodiment, the antisense nucleic acid molecule is antisense to a "noncoding region" of the coding strand of a nucleotide sequence encoding MCP. The term "noncoding region" refers to 5' and 3' sequences which flank the coding region that are not translated into amino acids (i.e., also referred to as 5' and 3' untranslated regions).

Given the coding strand sequences encoding MCP disclosed herein (e.g., the sequences set forth in Appendix A), antisense nucleic acids of the invention can be designed according to the rules of Watson and Crick base pairing. The antisense nucleic acid molecule can be complementary to the entire coding region of MCP mRNA, but more preferably is an oligonucleotide which is antisense to only a portion of the coding or noncoding region of MCP mRNA. For example, the antisense oligonucleotide can be complementary to the region surrounding the translation start site of MCP mRNA. An antisense oligonucleotide can be, for example, about 5, 10, 15, 20, 25, 30, 35, 40, 45 or 50 nucleotides in length. An antisense nucleic acid of the invention can be constructed by chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6 isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a cell or generated in situ such that they hybridize with or bind to cellular mRNA and/or genomic DNA encoding an MCP protein to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) Nucleic Acids. Res. 15:6625–6641). The antisense nucleic acid molecule can also comprise a 2'-o-methylribonucleotide (Inoue et al. (1987) Nucleic Acids Res. 15:6131–6148) or a chimeric RNA-DNA analogue (Inoue et al. (1987) FEBS Lett. 215:327–330).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) Nature 334:585–591)) can be used to catalytically cleave MCP mRNA transcripts to thereby inhibit translation of MCP mRNA. A ribozyme having specificity for an MCP-encoding nucleic acid can be designed based upon the nucleotide sequence of an MCP DNA disclosed herein (i.e., SEQ ID NO. 1 (RXN01368) in Appendix A). For example, a derivative of a *Tetrahymena* L-19 IVS RNA can be constructed in which the nucleotide sequence of the active site is complementary to the nucleotide sequence to be cleaved in an MCP-encoding mRNA. See, e.g., Cech et al. U.S. Pat. No. 4,987,071 and Cech et al U.S. Pat. No. 5,116,742. Alternatively, MCP mRNA can be used to select a catalytic RNA having a specific ribonuclease activity from a pool of RNA molecules. See, e.g., Bartel, D. and Szostak, J. W. (1993) Science 261:1411–1418.

Alternatively, MCP gene expression can be inhibited by targeting nucleotide sequences complementary to the regulatory region of an MCP nucleotide sequence (e.g., an MCP promoter and/or enhancers) to form triple helical structures that prevent transcription of an MCP gene in target cells. See generally, Helene, C. (1991) Anticancer Drug Des. 6(6):569–84; Helene, C. et al. (1992) Ann. N.Y. Acad. Sci. 660:2736; and Maher, L. J. (1992) Bioassays 14(12):807–15.

B. Recombinant Expression Vectors and Host Cells

Another aspect of the invention pertains to vectors, preferably expression vectors, containing a nucleic acid encoding an MCP protein (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, repressor binding sites, activator binding sites, enhancer regions and other expression control elements (e.g., terminators, other elements of mRNA secondary structure, or polyadenylation signals). Such regulatory sequences are described, for example, in Goeddel; *Gene Expression Technology: Methods in Enzymology* 185, Academic Press, San Diego, Calif. (1990). Regulatory sequences include those which direct constitutive expression of a nucleotide sequence in many types of host cell and those which direct expression of the nucleotide sequence only in certain host cells. Preferred regulatory sequences are, for example, promoters such as cos-, tac-, trp-, tet-, trp-tet-, lpp-, lac-, lpp-lac-, lacI$^q$-, T7-, T5-, T3-, gal-, trc-, ara-, SP6-, arny, SPO2, λ- $P_R$- or λ$P_L$, which are used preferably in bacteria. Additional regulatory sequences are, for example, promoters from yeasts and fungi, such as ADC1, MFα, AC, P-60, CYC1, GAPDH, TEF, rp28, ADH, promoters from plants such as CaMV/35S, SSU, OCS, lib4, usp, STLS1, B33, nos or ubiquitin- or phaseolin-promoters. It is also possible to use artificial promoters. It will be appreciated by those of ordinary skill in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., MCP proteins, mutant forms of MCP proteins, fusion proteins, etc.).

The recombinant expression vectors of the invention can be designed for expression of MCP proteins in prokaryotic or eukaryotic cells. For example, MCP genes can be expressed in bacterial cells such as C glutamicum, insect cells (using baculovirus expression vectors), yeast and other fungal cells (see Romanos, M. A. et al. (1992) "Foreign gene expression in yeast: a review", Yeast 8: 423–488; van den Hondel, C. A. M. J. J. et al. (1991) "Heterologous gene expression in filamentous fungi" in: More Gene Manipulations in Fungi, J. W. Bennet & L. L. Lasure, eds., p. 396–428: Academic Press: San Diego; and van den Hondel, C. A. M. J. J. & Punt, P. J. (1991) "Gene transfer systems and vector development for filamentous fungi, in: Applied Molecular Genetics of Fungi, Peberdy, J. F. et al., eds., p. 1–28, Cambridge University Press: Cambridge), algae and multicellular plant cells (see Schmidt, R. and Willmitzer, L. (1988) High efficiency *Agrobacterium tumefactiens*— mediated transformation of *Arabidopsis thaliana* leaf and cotyledon explants" *Plant Cell Rep.*: 583–586), or mammalian cells. Suitable host cells are discussed further in Goeddel, *Gene Expression Technology: Methods in Enzymology* 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase.

Typical fusion expression vectors include pGEX (Pharmacia Biotech Inc; Smith, D. B. and Johnson, K. S. (1988) *Gene* 67:31–40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. In one embodiment, the coding sequence of the MCP protein is cloned into a pGEX expression vector to create a vector encoding a fusion protein comprising, from the N-terminus to the C-terminus, GST-thrombin cleavage site-X protein. The fusion protein can be purified by affinity chromatography using glutathione-agarose resin. Recombinant MCP protein unfused to GST can be recovered by cleavage of the fusion protein with thrombin.

Examples of suitable inducible non-fusion *E. coli* expression vectors include pTrc (Amann et al., (1988) *Gene* 69:301–315), pLG338, pACYC184, pBR322, pUC18, pUC19, pKC30, pRep4, pHS1, pHS2, pPLc236, pMBL24, pLG200, pUR290, pIN-III113-B1, λgt11, pBdCl, and pET 11d (Studier et al., *Gene Expression Technology: Methods in Enzymology* 185, Academic Press, San Diego, Calif. (1990) 60–89; and Pouwels et al., eds. (1985) Cloning Vectors. Elsevier: N.Y. IBSN 0 444 904018). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174 (DE3) from a resident λ prophage harboring a T7 gn1 gene under the transcriptional control of the lacUV 5 promoter. For transformation of other varieties of bacteria, appropriate vectors may be selected. For example, the plasmids pIJ101, pIJ364, pIJ702 and pIJ361 are known to be useful in transforming *Streptomyces*, while plasmids pUB110, pC194, or pBD214 are suited for transformation of *Bacillus* species. Several plasmids of use in the transfer of genetic information into Corynebacterium include pHM 1519, pBL1, pSA77, or pAJ667 (Pouwels et al., eds. (1985) Cloning Vectors. Elsevier: N.Y. IBSN 0 444 904018).

One strategy to maximize recombinant protein expression is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy is to alter the nucleic acid sequence of the nucleic acid to be inserted into an expression vector so that the individual codons for each amino acid are those preferentially utilized in the bacterium chosen for expression, such as *C. glutamicum* (Wada et al. (1992) *Nucleic Acids Res.* 20:2111–2118). Such alteration of nucleic acid sequences of the invention can be carried out by standard DNA synthesis techniques.

In another embodiment, the MCP protein expression vector is a yeast expression vector. Examples of vectors for expression in yeast *S. cerevisiae* include pYepSec1 (Baldari, et al., (1987) *Embo J* 6:229–234), 2μ, pAG-1, Yep6, Yep13, pEMBLYe23, pMFa (Kurjan and Herskowitz, (1982) *Cell* 30:933–943), pJRY88 (Schultz et al., (1987) *Gene* 54:113–123), and pYES2 (Invitrogen Corporation, San Diego, Calif.). Vectors and methods for the construction of vectors appropriate for use in other fungi, such as the filamentous fungi, include those detailed in: van den Hondel, C. A. M. J. J. & Punt, P. J. (1991) "Gene transfer systems and vector development for filamentous fungi, in: Applied Molecular Genetics of Fungi, J. F. Peberdy, et al., eds., p. 1–28, Cambridge University Press: Cambridge, and Pouwels et al, eds. (1985) Cloning Vectors. Elsevier: N.Y. (IBSN 0 444 904018).

Alternatively, the MCP proteins of the invention can be expressed in insect cells using baculovirus expression vectors. Baculovirus vectors available for expression of proteins in cultured insect cells (e.g., Sf 9 cells) include the pAc series (Smith et al (1983) *Mol. Cell Biol* 3:2156–2165) and the pVL series (Lucklow and Summers (1989) *Virology* 170:31–39).

In another embodiment, the MCP proteins of the invention may be expressed in unicellular plant cells (such as algae) or in plant cells from higher plants (e.g., the spermatophytes, such as crop plants). Examples of plant expression vectors include those detailed in: Becker, D., Kemper, E., Schell, J. and Masterson, R. (1992) "New plant binary vectors with selectable markers located proximal to the left border", *Plant Mol. Biol.* 20: 1195–1197; and Bevan, M. W. (1984) "Binary *Agrobacterium* vectors for plant transformation", *Nucl. Acid Res.* 12: 8711–8721, and include pLGV23, pGHlac+, pBIN19, pAK2004, and pDH51 (Pouwels et al., eds. (1985) Cloning Vectors. Elsevier: N.Y. IBSN 0 444 904018).

In yet another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et al (1987) *EMBO J.* 6:187–195). When used in mammalian cells, the expression vector's control functions are often provided by viral regulatory elements.

For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J., Fritsh, E. F., and Maniatis, T. *Molecular Cloning: A Laboratory Manual.* 2nd, ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268–277), lymphoid-specific promoters (Calame and Eaton (1988) *Adv. Immunol.* 43:235–275), in particular promoters of T cell receptors (Winoto and Baltimore (1989) *EMBO J.* 8:729–733) and immunoglobulins (Banerji et al. (1983) *Cell* 33:729–740; Queen and Baltimore (1983) Cell 33:741–748), neuron-specific promoters (e.g., the neurofilament promoter; Byrne and Ruddle (1989) PNAS 86:5473–5477), pancreas-specific promoters (Edlund et al (1985) *Science* 230:912–916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374–379) and the α-fetoprotein promoter (Campes and Tilghman (1989) *Genes Dev.* 3:537–546).

The invention further provides a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to MCP mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see Weintraub, H. et al. (1986) "Antisense RNA as a molecular tool for genetic analysis", *Reviews—Trends in Genetics*, Vol. 1(1).

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, an MCP protein can be expressed in bacterial cells such as *C. glutamicum*, insect cells, yeast or mammalian cells (such as Chinese hamster ovary cells (CHO) or COS cells). Other suitable host cells are known to those of ordinary skill in the art. Microorganisms related to *Corynebacterium glutamicum* which may be conveniently used as host cells for the nucleic acid and protein molecules of the invention are set forth in Table 3.

Vector DNA can be introduced into prokaryotic or eukaryotic cells via conventional transformation or transfection techniques. As used herein, the terms "transformation", "transfection", "conjugation" and "transduction" are intended to refer to a variety of art-recognized techniques for introducing foreign nucleic acid (e.g., linear DNA or RNA (e.g., a linearized vector or a gene construct alone without a vector) or nucleic acid in the form of a vector (e.g., a plasmid, phage, plasmid, phagemid, transposon or other DNA) into a host cell, including using natural competence, chemical mediated transfer, calcium phosphate or calcium chloride co-precipitation, DEAE-dextran-mediated transfection, lipofection, or electroporation. Suitable methods for transforming or transfecting host cells can be found in Sambrook, et al. (*Molecular Cloning: A Laboratory Manual* 2nd, ed, Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding an MCP protein or can be introduced on a separate vector. Cells stably transfected with the introduced nucleic acid can be identified by, for example, drug selection (e.g., cells that have incorporated the selectable marker gene will survive, while the other cells die).

To create a homologous recombinant microorganism, a vector is prepared which contains at least a portion of an MCP gene into which a deletion, addition or substitution has been introduced to thereby alter, e.g., functionally disrupt, the MCP gene. Preferably, this MCP gene is a *Corynebacterium glutamicum* MCP gene, but it can be a homologue from a related bacterium or even from a mammalian, yeast, or insect source. In a preferred embodiment, the vector is designed such that, upon homologous recombination, the endogenous MCP gene is functionally disrupted (i.e., no longer encodes a functional protein; also referred to as a "knock out" vector). Alternatively, the vector can be designed such that, upon homologous recombination, the endogenous MCP gene is mutated or otherwise altered but still encodes functional protein (e.g., the upstream regulatory region can be altered to thereby alter the expression of the endogenous MCP protein). In the homologous recombination vector, the altered portion of the MCP gene is flanked at its 5' and 3' ends by additional nucleic acid of the MCP gene to allow for homologous recombination to occur between the exogenous MCP gene carried by the vector and an endogenous MCP gene in a microorganism. The additional flanking MCP nucleic acid is of sufficient length for successful homologous recombination with the endogenous gene. Typically, less than one kilobase of flanking DNA (both at the 5' and 3' ends) is included in the vector (see e.g., Thomas, K. R., and Capecchi, M. R. (1987) *Cell* 51: 503 for a description of homologous recombination vectors). The vector is introduced into a microorganism (e.g., by electroporation) and cells in which the introduced MCP gene has homologously recombined with the endogenous MCP gene are selected, using art-known techniques.

In another embodiment, recombinant microorganisms can be produced which contain selected systems which allow for regulated expression of the introduced gene. For example, inclusion of an MCP gene on a vector placing it under control of the lac operon permits expression of the MCP gene in the presence of IPTG. Such regulatory systems are well known in the art.

In another embodiment, an endogenous MCP gene in a host cell is disrupted (e.g., by homologous recombination or other genetic means known in the art) such that expression of its protein product does not occur. In another embodiment, an endogenous or introduced MCP gene in a host cell has been altered by one or more point mutations, deletions, or inversions, but still encodes a functional MCP protein. In still another embodiment, one or more of the regulatory regions (e.g., a promoter, repressor, or inducer) of an MCP gene in a microorganism has been altered (e.g., by deletion, truncation, inversion, or point mutation) such that the expression of the MCP gene is modulated. One of ordinary skill in the art will appreciate that host cells containing more than one of the described MCP gene and protein modifications may be readily produced using the methods of the invention, and are meant to be included in the present invention.

A host cell of the invention, such as a prokaryotic or eukaryotic host cell in culture, can be used to produce (i.e., express) an MCP protein. Accordingly, the invention further provides methods for producing MCP proteins using the host cells of the invention. In one embodiment, the method comprises culturing the host cell of invention (into which a recombinant expression vector encoding an MCP protein has been introduced, or into which genome has been introduced a gene encoding a wild-type or altered MCP protein) in a suitable medium until MCP protein is produced. In another embodiment, the method further comprises isolating MCP proteins from the medium or the host cell.

C. Isolated MCP Proteins

Another aspect of the invention pertains to isolated MCP proteins, and biologically active portions thereof. An "isolated" or "purified" protein or biologically active portion thereof is substantially free of cellular material when produced by recombinant DNA techniques, or chemical precursors or other chemicals when chemically synthesized. The language "substantially free of cellular material" includes preparations of MCP protein in which the protein is separated from cellular components of the cells in which it is naturally or recombinantly produced. In one embodiment, the language "substantially free of cellular material" includes preparations of MCP protein having less than about 30% (by dry weight) of non-MCP protein (also referred to herein as a "contaminating protein"), more preferably less than about 20% of non-MCP protein, still more preferably less than about 10% of non-MCP protein, and most preferably less than about 5% non-MCP protein. When the MCP protein or biologically active portion thereof is recombinantly produced, it is also preferably substantially free of culture medium, ie., culture medium represents less than about 20%, more preferably less than about 10%, and most preferably less than about 5% of the volume of the protein preparation. The language "substantially free of chemical precursors or other chemicals" includes preparations of MCP protein in which the protein is separated from chemical precursors or other chemicals which are involved in the synthesis of the protein. In one embodiment, the language "substantially free of chemical precursors or other chemicals" includes preparations of MCP protein having less than about 30% (by dry weight) of chemical precursors or non-MCP chemicals, more preferably less than about 20% chemical precursors or non-MCP chemicals, still more preferably less than about 10% chemical precursors or non-MCP chemicals, and most preferably less than about 5% chemical precursors or non-MCP chemicals. In preferred embodiments, isolated proteins or biologically active portions thereof lack contaminating proteins from the same organism from which the MCP protein is derived. Typically, such proteins are produced by recombinant expression of, for example, a *C. glutamicum* MCP protein in a microorganism such as *C. glutamicum*.

An isolated MCP protein or a portion thereof of the invention is able to modulate the yield, production, and/or efficiency of production of one or more fine chemicals from *C. glutamicum*, to degrade hydrocarbons, to oxidize terpenoids, to serve as a target for drug development, or to serve as an identifying marker for *C. glutamicum* or related organisms. In preferred embodiments, the protein or portion thereof comprises an amino acid sequence which is sufficiently homologous to an amino acid sequence of Appendix B such that the protein or portion thereof maintains the ability to modulate the yield, production, and/or efficiency of production of one or more fine chemicals from *C. glutamicum*, to degrade hydrocarbons, to oxidize terpenoids, to serve as a target for drug development, or to serve as an identifying marker for *C. glutamicum* or related organisms. The portion of the protein is preferably a biologically active portion as described herein. In another preferred embodiment, an MCP protein of the invention has an amino acid sequence shown in Appendix B. In yet another preferred embodiment, the MCP protein has an amino acid sequence which is encoded by a nucleotide sequence which hybridizes, e.g., hybridizes under stringent conditions, to a nucleotide sequence of Appendix A. In still another preferred embodiment, the MCP protein has an amino acid sequence which is encoded by a nucleotide sequence that is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to one of the nucleic acid sequences of Appendix A, or a portion thereof. Ranges and identity values intermediate to the above-recited values, (e.g., 70–90% identical or 80–95% identical) are also intended to be encompassed by the present invention. For example, ranges of identity values using a combination of any of the above values recited as upper and/or lower limits are intended to be included. The preferred MCP proteins of the present invention also preferably possess at least one of the MCP activities described herein. For example, a preferred MCP protein of the present invention includes an amino acid sequence encoded by a nucleotide sequence which hybridizes, e.g., hybridizes under stringent conditions, to a nucleotide sequence of Appendix A, and which is able to modulate the yield, production, and/or efficiency of production of one or more fine chemicals from *C. glutamicum*, to degrade hydrocarbons, to oxidize terpenoids, to serve as a target for drug development, or to serve as an identifying marker for *C. glutamicum* or related organisms.

In other embodiments, the MCP protein is substantially homologous to an amino acid sequence of Appendix B and retains the functional activity of the protein of one of the sequences of Appendix B yet differs in amino acid sequence due to natural variation or mutagenesis, as described in detail in subsection I above. Accordingly, in another embodiment, the MCP protein is a protein which comprises an amino acid sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to an entire amino acid sequence of Appendix B and which has at least one of the MCP activities described herein. Ranges and identity values intermediate to the above-recited values, (e.g., 70–90% identical or 80–95% identical) are also intended to be encompassed by the present invention. For example, ranges of identity values using a combination of any of the above values recited as upper and/or lower limits are intended to be included. In another embodiment, the invention pertains to a full length *C. glutamicum* protein which is substantially homologous to an entire amino acid sequence of Appendix B.

Biologically active portions of an MCP protein include peptides comprising amino acid sequences derived from the amino acid sequence of an MCP protein, e.g., an amino acid sequence shown in Appendix B or the amino acid sequence of a protein homologous to an MCP protein, which include fewer amino acids than a full length MCP protein or the full length protein which is homologous to an MCP protein, and exhibit at least one activity of an MCP protein. Typically, biologically active portions (peptides, e.g., peptides which are, for example, 5, 10, 15, 20, 30, 35, 36, 37, 38, 39, 40, 50, 100 or more amino acids in length) comprise a domain or motif with at least one activity of an MCP protein. Moreover, other biologically active portions, in which other regions of the protein are deleted, can be prepared by recombinant techniques and evaluated for one or more of the activities described herein. Preferably, the biologically active portions of an MCP protein include one or more selected domains/motifs or portions thereof having biological activity.

MCP proteins are preferably produced by recombinant DNA techniques. For example, a nucleic acid molecule encoding the protein is cloned into an expression vector (as described above), the expression vector is introduced into a host cell (as described above) and the MCP protein is expressed in the host cell. The MCP protein can then be isolated from the cells by an appropriate purification scheme using standard protein purification techniques. Alternative to recombinant expression, an MCP protein, polypeptide, or peptide can he synthesized chemically using standard peptide synthesis techniques. Moreover, native MCP protein can be isolated from cells (e.g., endothelial cells, bacterial cells, fungal cells or other cells), for example using an anti-MCP antibody, which can be produced by standard techniques utilizing an MCP protein or fragment thereof of this invention.

The invention also provides MCP chimeric or fusion proteins. As used herein, an MCP "chimeric protein" or "fusion protein" comprises an MCP polypeptide operatively linked to a non-MCP polypeptide. An "MCP polypeptide" refers to a polypeptide having an amino acid sequence corresponding to an MCP protein, whereas a "non-MCP polypeptide" refers to a polypeptide having an amino acid sequence corresponding to a protein which is not substantially homologous to the MCP protein, e.g., a protein which is different from the MCP protein and which is derived from the same or a different organism. Within the fusion protein, the term "operatively linked" is intended to indicate that the MCP polypeptide and the non-MCP polypeptide are fused in-frame to each other. The non-MCP polypeptide can be fused to the N-terminus or C-terminus of the MCP polypeptide. For example, in one embodiment the fusion protein is a GST-MCP fusion protein in which the MCP sequences are fused to the C-terminus of the GST sequences. Such fusion proteins can facilitate the purification of recombinant MCP proteins. In another embodiment, the fusion protein is an MCP protein containing a heterologous signal sequence at its N-terminus. In certain host cells (e.g., mammalian host cells, bacterial host cells, fungal host cells), expression and/or secretion of an MCP protein can be increased through use of a heterologous signal sequence.

Preferably, an MCP chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). An MCP-encoding nucleic acid can be cloned into such an expression vector such that the fusion moiety is linked in-frame to the MCP protein.

Homologues of the MCP protein can be generated by mutagenesis, e.g., discrete point mutation or truncation of the MCP protein. As used herein, the term "homologue" refers to a variant form of the MCP protein which acts as an agonist or antagonist of the activity of the MCP protein. An agonist of the MCP protein can retain substantially the same, or a subset, of the biological activities of the MCP protein. An antagonist of the MCP protein can inhibit one or more of the activities of the naturally occurring form of the MCP protein, by, for example, competitively binding to a downstream or upstream member of a biochemical pathway which includes the MCP protein.

In an alternative embodiment, homologues of the MCP protein can be identified by screening combinatorial libraries of mutants, e.g., truncation mutants, of the MCP protein for MCP protein agonist or antagonist activity. In one embodiment, a variegated library of MCP variants is generated by combinatorial mutagenesis at the nucleic acid level and is encoded by a variegated gene library. A variegated library of MCP variants can be produced by, for example, enzymatically ligating a mixture of synthetic oligonucleotides into gene sequences such that a degenerate set of potential MCP sequences is expressible as individual polypeptides, or alternatively, as a set of larger fusion proteins (e.g., for phage display) containing the set of MCP sequences therein. There are a variety of methods which can be used to produce libraries of potential MCP homologues from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential MCP sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477.

In addition, libraries of fragments of the MCP protein coding can be used to generate a variegated population of MCP fragments for screening and subsequent selection of homologues of an MCP protein. In one embodiment, a library of coding sequence fragments can be generated by treating a double stranded PCR fragment of an MCP coding sequence with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the MCP protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of MCP homologues. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recrusive ensemble mutagenesis (REM), a new technique which enhances the frequency of functional mutants in the libraries, can be used in combination with the screening assays to identify MCP homologues (Arkin and Yourvan (1992) *PNAS* 89:7811–7815; Delgrave et al. (1993) *Protein Engineering* 6(3):327–331).

In another embodiment, cell based assays can be exploited to analyze a variegated MCP library, using methods well known in the art.

D. Uses and Methods of the Invention

The nucleic acid molecules, proteins, protein homologues, fusion proteins, primers, vectors, and host cells described herein can be used in one or more of the following methods: identification of *C. glutamicum* and related organisms; mapping of genomes of organisms related to *C. glutamicum*; identification and localization of C glutamicum sequences of interest; evolutionary studies; determination of MCP protein regions required for function; modulation of an MCP protein activity; modulation of the activity of one or more metabolic pathways; and modulation of cellular production of a desired compound, such as a fine chemical.

The MCP nucleic acid molecules of the invention have a variety of uses. First, they may be used to identify an organism as being *Corynebacterium glutamicum* or a close relative thereof. Also, they may be used to identify the presence of *C. glutamicum* or a relative thereof in a mixed population of microorganisms. The invention provides the nucleic acid sequences of a number of *C. glutamicum* genes, and probes based thereon; by probing the extracted genomic DNA of a culture of a unique or mixed population of microorganisms under stringent conditions with a probe spanning a region of a *C. glutamicum* gene which is unique to this organism, one can ascertain whether this organism is present. Although *Corynebacterium glutamicum* itself is nonpathogenic, it is related to pathogenic species, such as

*Corynebacterium diphtheriae. Corynebacterium diphtheriae* is the causative agent of diphtheria, a rapidly developing, acute, febrile infection which involves both local and systemic pathology. In this disease, a local lesion develops in the upper respiratory tract and involves necrotic injury to epithelial cells; the bacilli secrete toxin which is disseminated through this lesion to distal susceptible tissues of the body. Degenerative changes brought about by the inhibition of protein synthesis in these tissues, which include heart, muscle, peripheral nerves, adrenals, kidneys, liver and spleen, result in the systemic pathology of the disease. Diphtheria continues to have high incidence in many parts of the world, including Africa, Asia, Eastern Europe and the independent states of the former Soviet Union. An ongoing epidemic of diphtheria in the latter two regions has resulted in at least 5,000 deaths since 1990.

In one embodiment, the invention provides a method of identifying the presence or activity of *Corynebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject. *C. glutamicum* and *C. diphtheriae* are related bacteria, and many of the nucleic acid and protein molecules in *C. glutamicum* are homologous to *C. diphtheriae* nucleic acid and protein molecules, and can therefore be used to detect *C. diphtheriae* in a subject.

To detect the presence of *C. glutamicum* in a sample, techniques well known in the art may be employed. Specifically, the cells in the sample may optionally first be cultured in a suitable liquid or on a suitable solid culture medium to increase the number of cells in the sample. These cells are lysed, and the total DNA content extracted and optionally purified to remove debris and protein material which may interfere with subsequent analysis. The polymerase chain reaction or a similar technique known in the art is performed (for general reference on methodologies commonly used for the amplification of nucleic acid sequences, see Mullis et al., U.S. Pat. No. 4,683,195, Mullis et al., U.S. Pat. No. 4,965,188, and Innis, M. A., and Gelfand, D. H., (1989) PCR Protocols, A guide to Methods and Applications, Academic Press, p. 3–12, and (1988) Biotechnology 6:1197, and International Patent Application No. WO89/01050) in which primers specific to an MCP nucleic acid molecule of the invention are incubated with the nucleic acid sample such that, if present in the sample, that particular MCP nucleic acid sequence will be amplified. The particular MCP nucleic acid to be amplified is selected based on its uniqueness to the *C. glutamicum* genome, or to the genomes of *C. glutamicum* and only a few closely related bacteria. The presence of the desired amplified product is thus indicative of the presence of *C. glutamicum*, or an organism closely related to *C. glutamicum*.

Further, the nucleic acid and protein molecules of the invention may serve as markers for specific regions of the genome. It is possible, using techniques well known in the art, to ascertain the physical location on the *C. glutamicum* genome of the MCP nucleic acid molecules of the invention, which in turn provides markers on the genome which can be used to aid in the placement of other nucleic acid molecules and genes on the genome map. Also, the nucleic acid molecules of the invention may be sufficiently homologous to the sequences of related bacterial species that these nucleic acid molecules may similarly permit the construction of a genomic map in such bacteria (e.g., *Brevibacterium lactofermentum*).

The nucleic acid molecules of the invention have utility not only in the mapping of the genome, but also for functional studies of *C. glutamicum* proteins. For example, to identify the region of the genome to which a particular *C. glutamicum* DNA-binding protein binds, the *C. glutamicum* genome could be digested, and the fragments incubated with the DNA-binding protein. Those which bind the protein may be additionally probed with the nucleic acid molecules of the invention, preferably with readily detectable labels; binding of such a nucleic acid molecule to the genome fragment enables the localization of the fragment to the genome map of *C. glutamicum*, and, when performed multiple times with different enzymes, facilitates a rapid determination of the nucleic acid sequence to which the protein binds.

The MCP nucleic acid molecules of the invention are also useful for evolutionary and protein structural studies. The metabolic processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

The MCP protein molecules of the invention may also be utilized as markers for the classification of an unknown bacterium as *C. glutamicum*, or for the identification of *C. glutamicum* or closely related bacteria in a sample. For example, using techniques well known in the art, cells in a sample may optionally be amplified (e.g., by culturing in an appropriate medium) to increase the sample size, and then may be lysed to release proteins contained therein. This sample may optionally be purified to remove debris and nucleic acid molecules which may interfere with subsequent analysis. Antibodies specific for a selected MCP protein of the invention may be incubated with the protein sample in a typical Western assay format (see, e.g., Ausubel et al., (1988) Current Protocols in Molecular Biology, Wiley: New York) in which the antibody will bind to its target protein if this protein is present in the sample. An MCP protein is selected for this type of assay if it is unique or nearly unique to *C. glutamicum* or *C. glutamicum* and bacteria very closely related to *C. glutamicum*. Proteins in the sample are then separated by gel electrophoresis, and transferred to a suitable matrix, such as nitrocellulose. An appropriate secondary antibody having a detectable label (e.g., chemiluminescent or colorimetric) is incubated with this matrix, followed by stringent washing. The presence or absence of the label is indicative of the presence or absence of the target protein in the sample. If the protein is present, then this is indicative of the presence of *C. glutamicum*. A similar process enables the classification of an unknown bacterium as *C. glutamicum*; if a panel of proteins specific to *C. glutamicum* are not detected in protein samples prepared from the unknown bacterium, then that bacterium is not likely to be *C. glutamicum*.

The invention provides methods for screening molecules which modulate the activity of an MCP protein, either by interacting with the protein itself or a substrate or binding partner of the MCP protein, or by modulating the transcription or translation of an MCP nucleic acid molecule of the invention. In such methods, a microorganism expressing one or more MCP proteins of the invention is contacted with one or more test compounds, and the effect of each test compound on the activity or level of expression of the MCP protein is assessed.

Genetic manipulation of the MCP nucleic acid molecules of the invention may result in the production of MCP proteins having functional differences from the wild-type MCP proteins. These proteins may be improved in efficiency or activity, may be present in greater numbers in the cell than is usual, or may be decreased in efficiency or activity.

Such changes in activity may directly modulate the yield, production, and/or efficiency of production of one or more fine chemicals from C. glutamicum. For example, by modifying the activity of a protein involved in the biosynthesis or degradation of a fine chemical (i.e., through mutagenesis of the corresponding gene), one may directly modulate the ability of the cell to synthesize or to degrade this compound, thereby modulating the yield and/or efficiency of production of the fine chemical. Similarly, by modulating the activity of a protein which regulates a fine chemical metabolic pathway, one may directly influence whether the production of the desired compound is up- or down-regulated, either of which will modulate the yield or efficiency of production of the fine chemical from the cell.

Indirect modulation of fine chemical production may also result by modifying the activity of a protein of the invention (i.e., by mutagenesis of the corresponding gene) such that the overall ability of the cell to grow and divide or to remain viable and productive is increased. The production of fine chemicals from C. glutamicum is generally accomplished by the large-scale fermentative culture of these microorganisms, conditions which are frequently suboptimal for growth and cell division. By engineering a protein of the invention (e.g., a stress response protein, a cell wall protein, or proteins involved in the metabolism of compounds necessary for cell growth and division to occur, such as nucleotides and amino acids) such that it is better able to survive, grow, and multiply in such conditions, it may be possible to increase the number and productivity of such engineered C. glutamicum cells in large-scale culture, which in turn should result in increased yields and/or efficiency of production of one or more desired fine chemicals. Further, the metabolic pathways of any cell are necessarily interrelated and coregulated. By altering the activity or regulation of any one metabolic pathway in C. glutamicum (i.e., by altering the activity of one of the proteins of the invention which participates in such a pathway), it is possible to concomitantly alter the activity or regulation of other metabolic pathways in this microorganism, which may be directly involved in the synthesis or degradation of a fine chemical.

The aforementioned mutagenesis strategies for MCP proteins to result in increased yields of a fine chemical from C. glutamicum are not meant to be limiting; variations on these strategies will be readily apparent to one of ordinary skill in the art. Using such strategies, and incorporating the mechanisms disclosed herein, the nucleic acid and protein molecules of the invention may be utilized to generate C. glutamicum or related strains of bacteria expressing mutated MCP nucleic acid and protein molecules such that the yield, production, and/or efficiency of production of a desired compound is improved. This desired compound may be any natural product of C. glutamicum, which includes the final products of biosynthesis pathways and intermediates of naturally-occurring metabolic pathways, as well as molecules which do not naturally occur in the metabolism of C. glutamicum, but which are produced by a C. glutamicum strain of the invention.

This invention is further illustrated by the following examples which should not be construed as limiting. The contents of all references, patent applications, patents, published patent applications, Tables, Appendices, and the sequence listing cited throughout this application are hereby incorporated by reference.

Exemplification

EXAMPLE 1

Preparation of total genomic DNA of
Corynebacterium glutamicum ATCC 13032

A culture of Corynebacterium glutamicum (ATCC 13032) was grown overnight at 30° C. with vigorous shaking in BHI medium (Difco). The cells were harvested by centrifugation, the supernatant was discarded and the cells were resuspended in 5 ml buffer-I (5% of the original volume of the culture—all indicated volumes have been calculated for 100 ml of culture volume). Composition of buffer-I: 140.34 g/l sucrose, 2.46 g/l $MgSO_4 \times 7H_2O$, 10 ml/l $KH_2PO_4$ solution (100 g/l, adjusted to pH 6.7 with KOH), 50 ml/l M12 concentrate (10 g/l $(NH)_2SO_4$, 1 g/l NaCl, 2 g/l $MgSO_4 \times 7H_2O$, 0.2 µl $CaCl_2$, 0.5 g/l yeast extract (Difco), 10 ml/l trace-elements-mix (200 mg/l $FeSO_4 \times H_2O$, 10 mg/l $ZnSO_4 \times 7H_2O$, 3 mg/l $MnCl_2 \times 4\ H_2O$, 30 mg/l $H_3BO_3$ 20 mg/l $CoCl_2 \times 6H_2O$, 1 mg/l $NiCl_2 \times 6H_2O$, 3 mg/l $Na_2MoO_4 \times 2H_2O$, 500 mg/l complexing agent (EDTA or critic acid), 100 ml/l vitamins-mix (0.2 mg/l biotin, 0.2 mg/l folic acid, 20 mg/l p-amino benzoic acid, 20 mg/l riboflavin, 40 mg/l α-panthothenate, 140 mg/l nicotinic acid, 40 mg/l pyridoxole hydrochloride, 200 mg/l myo-inositol). Lysozyme was added to the suspension to a final concentration of 2.5 mg/ml. After an approximately 4 h incubation at 37° C., the cell wall was degraded and the resulting protoplasts are harvested by centrifugation. The pellet was washed once with 5 ml buffer-I and once with 5 ml TE-buffer (10 mM Tris-HCl, 1 mM EDTA, pH 8). The pellet was resuspended in 4 ml TE-buffer and 0.5 ml SDS solution (10%) and 0.5 ml NaCl solution (5 M) are added. After adding of proteinase K to a final concentration of 200 µg/ml, the suspension is incubated for ca. 18 h at 37° C. The DNA was purified by extraction with phenol, phenol-chloroform-isoamylalcohol and chloroform-isoamylalcohol using standard procedures. Then, the DNA was precipitated by adding 1/50 volume of 3 M sodium acetate and 2 volumes of ethanol, followed by a 30 min incubation at −20° C. and a 30 min centrifugation at 12,000 rpm in a high speed centrifuge using a SS34 rotor (Sorvall). The DNA was dissolved in 1 ml TE-buffer containing 20 µg/ml RNaseA and dialysed at 4° C. against 1000 ml TE-buffer for at least 3 hours. During this time, the buffer was exchanged 3 times. To aliquots of 0.4 ml of the dialysed DNA solution, 0.4 ml of 2 M LiCl and 0.8 ml of ethanol are added. After a 30 min incubation at −20° C., the DNA was collected by centrifigation (13,000 rpm, Biofuge Fresco, Heraeus, Hanau, Germany). The DNA pellet was dissolved in TE-buffer. DNA prepared by this procedure could be used for all purposes, including southern blotting or construction of genomic libraries.

EXAMPLE 2

Construction of genomic libraries in Escherichia coli of Corynebacterium glutamicum ATCC13032

Using DNA prepared as described in Example 1, cosmid and plasmid libraries were constructed according to known and well established methods (see e.g., Sambrook, J. et al. (1989) "Molecular Cloning: A Laboratory Manual", Cold Spring Harbor Laboratory Press, or Ausubel, F. M. et al. (1994) "Current Protocols in Molecular Biology", John Wiley & Sons.)

Any plasmid or cosmid could be used. Of particular use were the plasmids pBR322 (Sutcliffe, J. G. (1979) *Proc. Natl. Acad. Sci. USA*, 75:3737–3741); PACYC177 (Change & Cohen (1978) *J. Bacteriol* 134:1141–1156), plasmids of the pBS series (pBSSK+, pBSSK– and others; Stratagene, LaJolla, USA), or cosmids as SuperCos1 (Stratagene, LaJolla, USA) or Lorist6 (Gibson, T. J., Rosenthal A. and Waterson, R. H. (1987) *Gene* 53:283–286. Gene libraries specifically for use in *C. glutamicum* may be constructed using plasmid pSLI09 (Lee, H.-S. and A. J. Sinskey (1994) *J. Microbiol. Biotechnol.* 4: 256–263).

EXAMPLE 3

DNA Sequencing and Computational Functional Analysis

Genomic libraries as described in Example 2 were used for DNA sequencing according to standard methods, in particular by the chain termination method using ABI377 sequencing machines (see e.g., Fleischman, R. D. et al. (1995) "Whole-genome Random Sequencing and Assembly of *Haemophilus Influenzae* Rd., *Science*, 269:496–512). Sequencing primers with the following nucleotide sequences were used: 5'-GGAAACAGTATGACCATG-3' (SEQ ID NO:2933) or 5'-GTAAAACGACGGCCAGT-3' (SEQ ID NO:2934).

EXAMPLE 4

In Vivo Mutagenesis

In vivo mutagenesis of *Corynebacterium glutamicum* can be performed by passage of plasmid (or other vector) DNA through *E. coli* or other microorganisms (e.g. *Bacillus* spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D. (1996) DNA repair mechanisms, in: *Escherichia coli* and *Salmonella*, p. 2277–2294, ASM: Washington.) Such strains are well known to those of ordinary skill in the art. The use of such strains is illustrated, for example, in Greener, A. and Callahan, M. (1994) *Strategies* 7: 32–34.

EXAMPLE 5

DNA Transfer Between *Escherichia coli* and *Corynebacterium glutamicum*

Several *Corynebacterium* and Brevibacterium species contain endogenous plasmids (as e.g., pHM 1519 or pBL1) which replicate autonomously (for review see, e.g., Martin, J. F. et al. (1987) Biotechnology, 5: 137–146). Shuttle vectors for *Escherichia coli* and *Corynebacterium glutamicum* can be readily constructed by using standard vectors for *E. coli*(Sambrook, J. et al. (989), "Molecular Cloning: A Laboratory Manual", Cold Spring Harbor Laboratory Press or Ausubel, F. M. et al. (1994) "Current Protocols in Molecular Biology", John Wiley & Sons) to which a origin or replication for and a suitable marker from *Corynebacterium glutamicum* is added. Such origins of replication are preferably taken from endogenous plasmids isolated from *Corynebacterium* and *Brevibacterium* species. Of particular use as transformation markers for these species are genes for kanamycin resistance (such as those derived from the Tn5 or Tn903 transposons) or chloramphenicol (Winnacker, E. L. (1987) "From Genes to Clones— Introduction to Gene Technology, VCH, Weinheim). There are numerous examples in the literature of the construction of a wide variety of shuttle vectors which replicate in both *E. coli* and *C. glutamicum*, and which can be used for several purposes, including gene overexpression (for reference, see e.g., Yoshihama, M. et al. (1985) *J. Bacteriol.* 162:591–597, Martin J. F. et al. (1987) *Biotechnology,* 5:137–146 and *Eikmanns*, B. J et al. (1991) *Gene,* 102:93–98).

Using standard methods, it is possible to clone a gene of interest into one of the shuttle vectors described above and to introduce such a hybrid vectors into strains of *Corynebacterium glutamicum*. Transformation of *C. glutamicum* can be achieved by protoplast transformation (Kastsumata, R. et al. (1984) *J. Bacteriol.* 159306–311), electroporation (Liebl, E. et al. (1989) *FEMS Microbiol. Letters,* 53:399–303) and in cases where special vectors are used, also by conjugation (as described e.g. in Schäfer, A et al. (1990) *J. Bacteriol.* 172:1663–1666). It is also possible to transfer the shuttle vectors for *C glutamicum* to *E. coli* by preparing plasmid DNA from *C. glutamicum* (using standard methods well-known in the art) and transforming it into *E. coli*. This transformation step can be performed using standard methods, but it is advantageous to use an Mcr-deficient *E. coli* strain, such as NM522 (Gough & Murray (1983) *J. Mol. Biol.* 166:1–19).

Genes may be overexpressed in *C. glutamicum* stains using plasmids which comprise pCG1 (U.S. Pat. No. 4,617, 267) or fragments thereof, and optionally the gene for kanamycin resistance from TN903 (Grindley, N. D. and Joyce, C. M. (1980) *Proc. Nat. Acad. Sci. USA* 77(12): 7176–7180). In addition, genes may be overexpressed in *C. glutamicum* strains using plasmid pSL109 (Lee, H.-S. and A. J. Sinskey (1994) *J. Microbiol Biotechnol.* 4: 256–263).

Aside from the use of replicative plasmids, gene overexpression can also be achieved by integration into the genome. Genomic integration in *C. glutamicum* or other *Corynebacterium* or *Brevibacterium* species may be accomplished by well-known methods, such as homologous recombination with genomic region(s), restriction endonuclease mediated integration (REMI) (see, e.g., DE Patent 19823834), or through the use of transposons. It is also possible to modulate the activity of a gene of interest by modifying the regulatory regions (e.g., a promoter, a repressor, and/or an enhancer) by sequence modification, insertion, or deletion using site-directed methods (such as homologous recombination) or methods based on random events (such as transposon mutagenesis or REMI). Nucleic acid sequences which function as transcriptional terminators may also be inserted 3' to the coding region of one or more genes of the invention; such terminators are well-known in the art and are described, for example, in Winnacker, E. L. (1987) From Genes to Clones—Introduction to Gene Technology. VCH: Weinheim.

EXAMPLE 6

Assessment of the Expression of the Mutant Protein

Observations of the activity of a mutated protein in a transformed host cell rely on the fact that the mutant protein is expressed in a similar fashion and in a similar quantity to that of the wild-type protein. A useful method to ascertain the level of transcription of the mutant gene (an indicator of the amount of mRNA available for translation to the gene product) is to perform a Northern blot (for reference see, for example, Ausubel et al. (1988) Current Protocols in Molecular Biology, Wiley: New York), in which a primer designed to bind to the gene of interest is labeled with a detectable tag (usually radioactive or chemiluminescent), such that when the total RNA of a culture of the organism is extracted, run on gel, transferred to a stable matrix and incubated with this probe, the binding and quantity of binding of the probe indicates the presence and also the quantity of mRNA for this gene. This information is evidence of the degree of transcription of the mutant gene. Total cellular RNA can be prepared from *Corynebacterium glutamicum* by several methods, all well-known in the art, such as that described in Bormann, E. R. et al. (1992) *Mol. Microbiol.* 6: 317–326.

To assess the presence or relative quantity of protein translated from this mRNA, standard techniques, such as a Western blot, may be employed (see, for example, Ausubel et al. (1988) Current Protocols in Molecular Biology, Wiley: New York). In this process, total cellular proteins are extracted, separated by gel electrophoresis, transferred to a matrix such as nitrocellulose, and incubated with a probe, such as an antibody, which specifically binds to the desired protein. This probe is generally tagged with a chemiluminescent or calorimetric label which may be readily detected. The presence and quantity of label observed indicates the presence and quantity of the desired mutant protein present in the cell.

EXAMPLE 7

Growth of Genetically Modified *Corynebacterium glutamicum*—Media and Culture Conditions Genetically modified *Corynebacteria* are cultured in synthetic or natural growth media. A number of different growth media for *Corynebacteria* are both well-known and readily available (Lieb et al. (1989) *Appl. Microbiol. Biotechnol.*, 32:205–210; von der Osten et al. (1998) *Biotechnology Letters*, 11:11–16; Patent DE 4,120,867; Liebl (1992) "The Genus *Corynebacterium*, in: The Procaryotes, Volume II, Balows, A. et al., eds. Springer-Verlag). These media consist of one or more carbon sources, nitrogen sources, inorganic salts, vitamins and trace elements. Preferred carbon sources are sugars, such as mono-, di-, or polysaccharides. For example, glucose, fructose, mannose, galactose, ribose, sorbose, ribulose, lactose, maltose, sucrose, raffinose, starch or cellulose serve as very good carbon sources. It is also possible to supply sugar to the media via complex compounds such as molasses or other by-products from sugar refinement. It can also be advantageous to supply mixtures of different carbon sources. Other possible carbon sources are alcohols and organic acids, such as methanol, ethanol, acetic acid or lactic acid. Nitrogen sources are usually organic or inorganic nitrogen compounds, or materials which contain these compounds. Exemplary nitrogen sources include ammonia gas or ammonia salts, such as $NH_4Cl$ or $(NH_4)_2SO_4$, $NH_4OH$, nitrates, urea, amino acids or complex nitrogen sources like corn steep liquor, soy bean flour, soy bean protein, yeast extract, meat extract and others.

Inorganic salt compounds which may be included in the media include the chloride-, phosphorous- or sulfate- salts of calcium, magnesium, sodium, cobalt, molybdenum, potassium, manganese, zinc, copper and iron. Chelating compounds can be added to the medium to keep the metal ions in solution. Particularly useful chelating compounds include dihydroxyphenols, like catechol or protocatechuate, or organic acids, such as citric acid. It is typical for the media to also contain other growth factors, such as vitamins or growth promoters, examples of which include biotin, riboflavin, thiamin, folic acid, nicotinic acid, pantothenate and pyridoxin. Growth factors and salts frequently originate from complex media components such as yeast extract, molasses, corn steep liquor and others. The exact composition of the media compounds depends strongly on the immediate experiment and is individually decided for each specific case. Information about media optimization is available in the textbook "Applied Microbiol. Physiology, A Practical Approach (eds. P. M. Rhodes, P. F. Stanbury, IRL Press (1997) pp. 53–73, ISBN 0 19 963577 3). It is also possible to select growth media from commercial suppliers, like standard I (Merck) or BHI (grain heart infusion, DIFCO) or others.

All medium components are sterilized, either by heat (20 minutes at 1.5 bar and 121° C.) or by sterile filtration. The components can either be sterilized together or, if necessary, separately. All media components can be present at the beginning of growth, or they can optionally be added continuously or batchwise.

Culture conditions are defined separately for each experiment. The temperature should be in a range between 15° C. and 45° C. The temperature can be kept constant or can be altered during the experiment. The pH of the medium should be in the range of 5 to 8.5, preferably around 7.0, and can be maintained by the addition of buffers to the media. An exemplary buffer for this purpose is a potassium phosphate buffer. Synthetic buffers such as MOPS, HEPES, ACES and others can alternatively or simultaneously be used. It is also possible to maintain a constant culture pH through the addition of NaOH or $NH_4OH$ during growth. If complex medium components such as yeast extract are utilized, the necessity for additional buffers may be reduced, due to the fact that many complex compounds have high buffer capacities. If a fermentor is utilized for culturing the microorganisms, the pH can also be controlled using gaseous ammonia.

The incubation time is usually in a range from several hours to several days. This time is selected in order to permit the maximal amount of product to accumulate in the broth. The disclosed growth experiments can be carried out in a variety of vessels, such as microtiter plates, glass tubes, glass flasks or glass or metal fermentors of different sizes. For screening a large number of clones, the microorganisms should be cultured in microtiter plates, glass tubes or shake flasks, either with or without baffles. Preferably 100 ml shake flasks are used, filled with 10% (by volume) of the required growth medium. The flasks should be shaken on a rotary shaker (amplitude 25 mm) using a speed-range of 100–300 rpm. Evaporation losses can be diminished by the maintenance 110 of a humid atmosphere; alternatively, a mathematical correction for evaporation losses should be performed.

If genetically modified clones are tested, an unmodified control clone or a control clone containing the basic plasmid without any insert should also be tested. The medium is inoculated to an $OD_{600}$ of 0.5–1.5 using cells grown on agar plates, such as CM plates (10 g/l glucose, 2,5 g/l NaCl, 2 g/l urea, 10 g/l polypeptone, 5 g/l yeast extract, 5 g/l meat extract, 22 g/l NaCl, 2 g/l urea, 10 g/l polypeptone, 5 µl yeast extract, 5 gll meat extract, 22 g/l agar, pH 6.8 with 2M NaOH) that had been incubated at 30° C. Inoculation of the media is accomplished by either introduction of a saline suspension of *C. glutamicum* cells from CM plates or addition of a liquid preculture of this bacterium.

EXAMPLE 8

In vitro Analysis of the Function of Mutant Proteins

The determination of activities and kinetic parameters of enzymes is well established in the art. Experiments to determine the activity of any given altered enzyme must be tailored to the specific activity of the wild-type enzyme, which is well within the ability of one of ordinary skill in the art. Overviews about enzymes in general, as well as specific details concerning structure, kinetics, principles, methods, applications and examples for the determination of many enzyme activities may be found, for example, in the following references: Dixon, M., and Webb, E. C., (1979) Enzymes. Longmans: London; Fersht, (1985) Enzyme Structure and Mechanism. Freeman: New York; Walsh, (1979) Enzymatic Reaction Mechanisms. Freeman: San Francisco; Price, N. C., Stevens, L. (1982) Fundamentals of Enzymology. Oxford Univ. Press: Oxford; Boyer, P. D., ed. (1983) The Enzymes, $3^{rd}$ ed. Academic Press: New York; Bisswanger, H., (1994) Enzymkinetik, $2^{nd}$ ed. VCH: Weinheim (ISBN 3527300325); Bergmeyer, H. U., Bergmeyer, J., Graβl, M., eds. (1983–1986) Methods of Enzymatic Analysis, $3^{rd}$ ed., vol. I–XII, Verlag Chemie: Weinheim; and Ullmann's Encyclopedia of Industrial Chemistry (1987) vol. A9, "Enzymes". VCH: Weinheim, p. 352–363.

The activity of proteins which bind to DNA can be measured by several well-established methods, such as DNA band-shift assays (also called gel retardation assays). The effect of such proteins on the expression of other molecules can be measured using reporter gene assays (such as that described in Kolmar, H. et al. (1995) *EMBO J.* 14: 3895–3904 and references cited therein). Reporter gene test systems are well known and established for applications in both pro- and eukaryotic cells, using enzymes such as beta-galactosidase, green fluorescent protein, and several others.

The determination of activity of membrane-transport proteins can be performed according to techniques such as those described in Gennis, R. B. (1989) "Pores, Channels and Transporters", in Biomembranes, Molecular Structure and Function, Springer: Heidelberg, p. 85–137; 199–234; and 270–322.

EXAMPLE 9

Analysis of Impact of Mutant Protein the Production of the Desired Product

The effect of the genetic modification in *C. glutamicum* on production of a desired compound (such as an amino acid) can be assessed by growing the modified microorganism under suitable conditions (such as those described above) and analyzing the medium and/or the cellular component for increased production of the desired product (i.e., an amino acid). Such analysis techniques are well known to one of ordinary skill in the art, and include spectroscopy, thin layer chromatography, staining methods of various kinds, enzymatic and microbiological methods, and analytical chromatography such as high performance liquid chromatography (see, for example, Ullman, Encyclopedia of Industrial Chemistry, vol. A2, p. 89–90 and p. 443–613, VCH: Weinheim (1985); Fallon, A. et al., (1987) "Applications of HPLC in Biochemistry" in: Laboratory Techniques in Biochemistry and Molecular Biology, vol. 17; Rehm et al. (1993) Biotechnology, vol. 3, Chapter III: "Product recovery and purification", page 469–714, VCH: Weinheim; Belter, P. A. et al. (1988) Bioseparations: downstream process ing for biotechnology, John Wiley and Sons; Kennedy, J. F. and Cabral, J. M. S. (1992) Recovery processes for biological materials, John Wiley and Sons; Shaeiwitz, J. A. and Henry, J. D. (1988) Biochemical separations, in: Ulmann's Encyclopedia of Industrial Chemistry, vol. B3, Chapter 11, page 1–27, VCH: Weinheim; and Dechow, F. J. (1989) Separation and purification techniques in biotechnology, Noyes. Publications.)

In addition to the measurement of the final product of fermentation, it is also possible to analyze other components of the metabolic pathways utilized for the production of the desired compound, such as intermediates and side-products, to determine the overall efficiency of production of the compound. Analysis methods include measurements of nutrient levels in the medium (e.g., sugars, hydrocarbons, nitrogen sources, phosphate, and other ions), measurements of biomass composition and growth analysis of the production of common metabolites of biosynthetic pathways, and measurement of gasses produced during fermentation. Standard methods for these measurements are outlined in Applied Microbial Physiology, A Practical Approach, P. M. Rhodes and P. F. Stanbury, eds., IRL Press, p. 103–129; 131–163; and 165–192 (ISBN: 0199635773) and references cited therein.

EXAMPLE 10

Purification of the Desired Product from *C. glutamicum* Culture

Recovery of the desired product from the *C. glutamicum* cells or supernatant of the above-described culture an be performed by various methods well known in the art. If the desired product is not secreted from the cells, the cells can be harvested from the culture by low-speed centrifugation, the cells can be lysed by standard techniques, such as mechanical force or sonication. The cellular debris is removed by centrifugation, and the supernatant fraction containing the soluble proteins is retained for further purification of the desired compound. If the product is secreted from the *C. glutamicum* cells, then the cells are removed from the culture by low-speed centrifugation, and the supernate fraction is retained for further purification.

The supernatant fraction from either purification method is subjected to chromatography with a suitable resin, in which the de sired molecule is either retained on a chromatography resin while many of the impurities in the sample are not, or where the impurities are retained by the resin while the sample is not. Such chromatography steps may be repeated as necessary, using the same or different chromatography resins. One of ordinary skill in the art would be well-versed in the selection of appropriate chromatography resins and in their most efficacious application for a particular molecule to be purified. The purified product may be concentrated by filtration or ultrafiltration, and stored at a temperature at which the stability of the product is maximized.

There are a wide array of purification methods known to the art and the preceding method of purification is not meant to be limiting. Such purification techniques are described, for example, in Bailey, J. E. & Ollis, D. F. Biochemical Engineering Fundamentals, McGraw-Hill: New York (1986).

The identity and purity of the isolated compounds may be assessed by techniques standard in the art. These include high-performance liquid chromatography (HPLC), spectroscopic methods, staining methods, thin layer chromatography, NIRS, enzymatic assay, or microbiologically. Such analysis methods are reviewed in; Patek et al. (1994) *Appl. Environ. Microbiol.* 60:133–140; Malakhova et al. (1996) *Biotekhnologiya* 11: 27–32; and Schmidt et al. (1998) *Bioprocess Engineer.* 19: 67–70. Ulmann's Encyclopedia of Industrial Chemistry, (1996) vol. A27, VCH: Weinheim, p. 89–90, p. 521–540, p. 540–547, p. 559–566, 575–581 and p. 581–587; Michal, G. (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

EXAMPLES 11

Analysis of the Gene Sequences of the Invention

The comparison of sequences and determination of percent homology between two sequences are art-known techniques, and can be accomplished using a mathematical algorithm, such as the algorithm of Karlin and Altschul (1990) *Proc. Natl. Acad. Sci.* USA 87:2264–68, modified as in Karlin and Altschul (1993) *Proc. Natl. Acad. Sci.* USA 90:5873–77. Such an algorithm is incorporated into the NBLAST and XBLAST programs (version 2.0) of Altschul, et al. (1990) *J. Mol. Biol.* 215:403–10. BLAST nucleotide searches can be performed with the NBLAST program, score=100, wordlength=12 to obtain nucleotide sequences homologous to MCP nucleic acid molecules of the invention BLAST protein searches can be performed with the XBLAST program, score=50, wordlength=3 to obtain amino acid sequences homologous to MCP protein molecules of the invention. To obtain gapped alignments for comparison purposes, Gapped BLAST can be utilized as described in Altschul et al., (1997) *Nucleic Acids Res.* 25(17):3389–3402. When utilizing BLAST and Gapped BLAST programs, one of ordinary skill in the art will know how to optimize the parameters of the program (e.g., XBLAST and NBLAST) for the specific sequence being analyzed.

Another example of a mathematical algorithm utilized for the comparison of sequences is the algorithm of Meyers and Miller ((1988) *Comput. Appl Biosci.* 4: 11–17). Such an algorithm is incorporated into the ALIGN program (version 2.0) which is part of the GCG sequence alignment software package. When utilizing the ALIGN program for comparing amino acid sequences, a PAM 120 weight residue table, a gap length penalty of 12, and a gap penalty of 4 can be used. Additional algorithms for sequence analysis are known in the art, and include ADVANCE and ADAM. described in Torelli and Robotti (1994) *Comput. Appl. Biosci.* 10:3–5; and FASTA, described in Pearson and Lipman (1988) P. N. A. S. 85:2444–8.

The percent homology between two amino acid sequences can also be accomplished using the GAP program in the GCG software package (available at the Accelrys™ website), using either a Blosum 62 matrix or a PAM250 matrix, and a gap weight of 12, 10, 8, 6, or 4 and a length weight of 2, 3, or 4. The percent homology between two nucleic acid sequences can be accomplished using the GAP program in the GCG software package, using standard parameters, such as a gap weight of 50 and a length weight of 3.

A comparative analysis of the gene sequences of the invention with those present in Genbank has been performed using techniques known in the art (see, e.g., Bexevanis and Ouellette, eds. (11998) Boinformatics: A Practical Guide to the Analysis of Genes and Proteins. John Wiley and Sons: New York). The gene sequences of the invention were compared to genes present in Genbank in a three-step process. In a first step, a BLASTN analysis (e.g., a local alignment analysis) was performed for each of the sequences of the invention against the nucleotide sequences present in Genbank, and the top 500 hits were retained for further analysis. A subsequent FASTA search (e.g., a combined local and global alignment analysis, in which limited regions of the sequences are aligned) was performed on these 500 hits. Each gene sequence of the invention was subsequently globally aligned to each of the top three FASTA hits, using the GAP program in the GCG software package (using standard parameters). In order to obtain correct results, the length of the sequences extracted from Genbank were adjusted to the length of the query sequences by methods well-known in the art. The results of this analysis are set forth in Table 4. The resulting data is identical to that which would have been obtained had a GAP (global) analysis alone been performed on each of the genes of the invention in comparison with each of the references in Genbank, but required significantly reduced computational time as compared to such a database-wide GAP (global) analysis. Sequences of the invention for which no alignments above the cutoff values were obtained are indicated on Table 4 by the absence of alignment information. It will further be understood by one of ordinary skill in the art that the GAP alignment homology percentages set forth in Table 4 under the heading "% homology (GAP)" are listed in the European numerical format, wherein a ',' represents a decimal point. For example a value of "40,345" in this column represents "40.345%".

EXAMPLE 12

Construction and Operation of DNA Microarrays

The sequences of the invention may additionally be used in the construction and application of DNA microarrays (the design, method ology, and uses of DNA arrays are well known in the art, and are described, for example, in Schena, M. et al. (1995) *Science* 270: 467–470; Wodicka, L. et al. (1997) *Nature Biotechnology* 15: 1359–1367; DeSaizieu, A. et al. (1998) *Nature Biotechnology* 16: 45–48; and DeRisi, J. L. et al. (1997) *Science* 278: 680–686).

DNA microarrays are solid or flexible supports consisting of nitrocellulose, nylon, glass, silicone, or other materials. Nucleic acid molecules may be attached to the surface in an ordered manner. After appropriate labeling, other nucleic acids or nucleic acid mixtures can be hybridized to the immobilized nucleic acid molecules, and the label may be used to monitor and measure the individual signal intensities of the hybridized molecules at defined regions. This methodology allows the simultaneous quantification of the relative or absolute amount of all or selected nucleic acids in the applied nucleic acid sample or mixture. DNA microarrays, therefore, permit an analysis of the expression of multiple (as many as 6800 or more) nucleic acids in parallel (see, e.g., Schena, M. (1996) *BioEssays* 18(5): 427431).

The sequences of the invention may be used to design oligonucleotide primers which are able to amplify defined regions of one or more *C. glutamicum* genes by a nucleic acid amplification reaction such as the polymerase chain reaction. The choice and design of the 5' or 3' oligonucleotide primers or of appropriate linkers allows the covalent attachment of the resulting PCR products to the surface of a support medium described above (and also described, for example, Schena, M. et al. (1995) *Science* 270: 467–470).

Nucleic acid microarrays may also be constructed by in situ oligonucleotide synthesis as described by Wodicka, L. et al. (1997) *Nature Biotechnology* 15: 1359–1367. By photolithographic methods, precisely defined regions of the matrix are exposed to light. Protective groups which are photolabile are thereby activated and undergo nucleotide addition, whereas regions that are masked from light do not undergo any modification. Subsequent cycles of protection and light activation permit the synthesis of different oligonucleotides at defined positions. Small, defined regions of the genes of the invention may be synthesized on microarrays by solid phase oligonucleotide synthesis.

The nucleic acid molecules of the invention present in a sample or mixture of nucleotides may be hybridized to the microarrays. These nucleic acid molecules can be labeled according to standard methods. In brief, nucleic acid molecules (e.g., mRNA molecules or DNA molecules) are labeled by the incorporation of isotopically or fluorescently labeled nucleotides, e.g., during reverse transcription or DNA synthesis. Hybridization of labeled nucleic acids to microarrays is described (e.g., in Schena, M. et al. (1995) supra; Wodicka, L. et al. (1997), supra; and DeSaizieu A. et al. (1998), supra). The detection and quantification of the hybridized molecule are tailored to the specific incorporated label. Radioactive labels can be detected, for example, as described in Schena, M. et al. (1995) supra) and fluorescent labels may be detected, for example, by the method of Shalon et al. (1996) *Genome Research* 6: 639–645).

The application of the sequences of the invention to DNA microarray technology, as described above, permits comparative analyses of different strains of *C. glutamicum* or other *Corynebacteria*. For example, studies of inter-strain variations based on individual transcript profiles and the identification of genes that are important for specific and/or desired strain properties such as pathogen icity, productivity and stress tolerance are facilitated by nucleic acid array methodologies. Also, comparisons of the profile of expression of genes of the invention during the course of a fermentation reaction are possible using nucleic acid array technology.

EXAMPLE 13

Analysis of the Dynamics of Cellular Protein Populations (Proteomics)

The genes, compositions, and methods of the invention may be applied to study the interactions and dynamics of populations of proteins, termed 'proteomics'. Protein populations of interest include, but are not limited to, the total protein population of *C. glutamicum* (e.g., in comparison with the protein populations of other organisms), those proteins which are active under specific environmental or metabolic conditions (e.g., during fermentation, at high or low temperature, or at high or low pH), or those proteins which are active during specific phases of growth and development.

Protein populations can be analyzed by various well-known techniques, such as gel electrophoresis. Cellular proteins may be obtained, for example, by lysis or extraction, and may be separated from one another using a variety of electrophoretic techniques. Sodium dodecyl sulfate polyacrylamide gel electrophoresis (SDS-PAGE) separates proteins largely on the basis of their molecular weight. Isoelectric focusing polyacrylamide gel electrophoresis (IEF-PAGE) separates proteins by their isoelectric point (which reflects not only the amino acid sequence but also posttranslational modifications of the protein). Another, more preferred method of protein analysis is the consecutive combination of both IEF-PAGE and SDS-PAGE, known as 2-D-gel electrophoresis (described, for example, in Hermann et al. (1998) *Electrophoresis* 19: 3217–3221; Fountoulakis et al. (1998) *Electrophoresis* 19: 1193–1202; Langen et al. (1997) *Electrophoresis* 18: 1184–1192; Antelmann et al. (1997) *Electrophoresis* 18: 1451–1463). Other separation techniques may also be utilized for protein separation, such as capillary gel electrophoresis; such techniques are well known in the art. Proteins separated by these methodologies can be visualized by standard techniques, such as by staining or labeling. Suitable stains are known in the art, and include Coomassie Brilliant Blue, silver stain, or fluorescent dyes such as Sypro Ruby (Molecular Probes). The inclusion of radioactively labeled amino acids or other protein precursors (e.g., $^{35}$S-methionine, $^{35}$S-cysteine, $^{14}$C-labelled amino acids, $^{15}$N-amino acids, $^{15}$NO$_3$ or $^{15}$NH$_4^+$ or $^{13}$C-labelled amino acids) in the medium of *C. glutamicum* permits the labeling of proteins from these cells prior to their separation. Similarly, fluorescent labels may be employed. These labeled proteins can be extracted, isolated and separated according to the previously described techniques.

Proteins visualized by these techniques can be further analyzed by measuring the amount of dye or label used. The amount of a given protein can be determined quantitatively using, for example, optical methods and can be compared to the amount of other proteins in the same gel or in other gels. Comparisons of proteins on gels can be made, for example, by optical comparison, by spectroscopy, by image scanning and analysis of gels, or through the use of photographic films and screens. Such techniques are well-known in the art.

To determine the identity of any given protein, direct sequencing or other standard techniques may be employed. For example, N- and/or C-terminal amino acid sequencing (such as Edman degradation) may be used, as may mass spectrometry (in particular MALDI or ESI techniques (see, e.g., Langen. et al. (1997) *Electrophoresis* 18: 1 184–1192)). The protein sequences provided herein can be used for the identification of *C. glutamicum* proteins by these techniques.

The information obtained by these methods can be used to compare patterns of protein presence, activity, or modification between different samples from various biological conditions (e.g., different organisms, time points of fermentation, media conditions, or different biotopes, among others). Data obtained from such experiments alone, or in combination with other techniques, can be used for various applications, such as to compare the behavior of various organisms in a given (e.g., metabolic) situation, to increase the productivity of strains which produce fine chemicals or to increase the efficiency of the production of fine chemicals.

Equivalents

Those of ordinary skill in the art will recognize, or will be able to ascertain using no more than routine experimentation, many equivalents to the specific embodiments of the invention described herein. Such equivalents are intended to be encompassed by the following claims.

TABLE 1

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 1 | naRXN01638 | 2 | aaRXN01638 | VV0005 | 54646 | 55545 |
| 3 | F naRXA01638 | 4 | F aaRXA01638 | GR00456 | 825 | 436 |
| 5 | F naRXA01639 | 6 | F aaRXA01639 | GR00456 | 1334 | 897 |
| 7 | naRXN01590 | 8 | aaRXN01590 | VV0015 | 66740 | 60294 |
| 9 | F naRXA01590 | 10 | F aaRXA01590 | GR00445 | 1710 | 427 |
| 11 | F naRXA01542 | 12 | F aaRXA01542 | GR00429 | 3 | 5063 |
| 13 | naRXN01539 | 14 | aaRXN01539 | VV0015 | 60006 | 57841 |
| 15 | F naRXA01539 | 16 | F aaRXA01539 | GR00428 | 120 | 2042 |
| 17 | naRXN01422 | 18 | aaRXN01422 | VV0122 | 17001 | 16030 |
| 19 | F naRXA01422 | 20 | F aaRXA01422 | GR00416 | 2003 | 1221 |
| 21 | naRXN01403 | 22 | aaRXN01403 | VV0126 | 4644 | 3997 |
| 23 | F naRXA01403 | 24 | F aaRXA01403 | GR00409 | 4410 | 3997 |
| 25 | naRXN01326 | 26 | aaRXN01326 | VV0102 | 23923 | 24288 |
| 27 | F naRXA01326 | 28 | F aaRXA01326 | GR00386 | 45 | 338 |
| 29 | naRXN01301 | 30 | aaRXN01301 | VV0068 | 8224 | 8748 |
| 31 | F naRXA01301 | 32 | F aaRXA01301 | GR00375 | 1993 | 1589 |
| 33 | naRXN01276 | 34 | aaRXN01276 | VV0009 | 31190 | 31633 |
| 35 | F naRXA01276 | 36 | F aaRXA01276 | GR00367 | 29993 | 30538 |
| 37 | naRXN01231 | 38 | aaRXN01231 | VV0020 | 30144 | 29902 |
| 39 | F naRXA01231 | 40 | F aaRXA01231 | GR00356 | 1384 | 1887 |
| 41 | naRXN01210 | 42 | aaRXN01210 | VV0169 | 4230 | 5060 |
| 43 | F naRXA01210 | 44 | F aaRXA01210 | GR00349 | 3 | 695 |
| 45 | naRXN01206 | 46 | aaRXN01206 | VV0268 | 303 | 4 |
| 47 | F naRXA01206 | 48 | F aaRXA01206 | GR00346 | 593 | 853 |
| 49 | naRXN01121 | 50 | aaRXN01121 | VV0182 | 5808 | 6893 |
| 51 | F naRXA01121 | 52 | F aaRXA01121 | GR00310 | 2479 | 3156 |
| 53 | naRXN01085 | 54 | aaRXN01085 | VV0093 | 16599 | 15721 |
| 55 | F naRXA01085 | 56 | F aaRXA01085 | GR00303 | 960 | 4 |
| 57 | naRXN00022 | 58 | aaRXN00022 | VV0015 | 27262 | 28962 |
| 59 | F naRXA00022 | 60 | F aaRXA00022 | GR00002 | 20563 | 21297 |
| 61 | F naRXA01921 | 62 | F aaRXA01921 | GR00551 | 943 | 5 |
| 63 | naRXN00027 | 64 | aaRXN00027 | VV0127 | 60015 | 59650 |
| 65 | F naRXA00027 | 66 | F aaRXA00027 | GR00003 | 5142 | 5507 |
| 67 | naRXN00028 | 68 | aaRXN00028 | VV0127 | 57099 | 59045 |
| 69 | F naRXA00028 | 70 | F aaRXA00028 | GR00003 | 8058 | 6112 |
| 71 | naRXN00033 | 72 | aaRXN00033 | VV0127 | 51753 | 53087 |
| 73 | naRXN00056 | 74 | aaRXN00056 | VV0044 | 11980 | 12729 |
| 75 | F naRXA00056 | 76 | F aaRXA00056 | GR00009 | 1463 | 714 |
| 77 | naRXN00067 | 78 | aaRXN00067 | VV0019 | 29740 | 29255 |
| 79 | F naRXA00067 | 80 | F aaRXA00067 | GR00011 | 708 | 223 |
| 81 | naRXN00077 | 82 | aaRXN00077 | VV0154 | 4222 | 5583 |
| 83 | F naRXA00077 | 84 | F aaRXA00077 | GR00012 | 4228 | 5589 |
| 85 | naRXN00080 | 86 | aaRXN00080 | VV0154 | 8446 | 6917 |
| 87 | F naRXA00080 | 88 | F aaRXA00080 | GR00012 | 7342 | 6923 |
| 89 | naRXN00087 | 90 | aaRXN00087 | VV0048 | 204 | 731 |
| 91 | F naRXA00087 | 92 | F aaRXA00087 | GR00013 | 3983 | 3456 |
| 93 | naRXN00096 | 94 | aaRXN00096 | VV0129 | 22302 | 22000 |
| 95 | F naRXA00096 | 96 | F aaRXA00096 | GR00014 | 4746 | 5048 |
| 97 | naRXN00097 | 98 | aaRXN00097 | VV0129 | 21841 | 20666 |
| 99 | F naRXA00097 | 100 | F aaRXA00097 | GR00014 | 5222 | 6382 |
| 101 | naRXN00114 | 102 | aaRXN00114 | VV0129 | 5849 | 6337 |
| 103 | F naRXA00114 | 104 | F aaRXA00114 | GR00017 | 3420 | 3908 |
| 105 | naRXN00120 | 106 | aaRXN00120 | VV0142 | 2612 | 3451 |
| 107 | F naRXA00120 | 108 | F aaRXA00120 | GR00019 | 2798 | 3451 |
| 109 | naRXN00128 | 110 | aaRXN00128 | VV0124 | 7960 | 9663 |
| 111 | F naRXA00128 | 112 | F aaRXA00128 | GR00020 | 4709 | 3006 |
| 113 | naRXN00154 | 114 | aaRXN00154 | VV0167 | 3283 | 4125 |
| 115 | F naRXA00154 | 116 | F aaRXA00154 | GR00023 | 8568 | 7726 |
| 117 | naRXN00162 | 118 | aaRXN00162 | VV0084 | 9489 | 9842 |
| 119 | F naRXA00162 | 120 | F aaRXA00162 | GR00024 | 5438 | 5791 |
| 121 | naRXN00167 | 122 | aaRXN00167 | VV0232 | 4324 | 4821 |
| 123 | F naRXA00167 | 124 | F aaRXA00167 | GR00025 | 4324 | 4584 |
| 125 | naRXN00171 | 126 | aaRXN00171 | VV0031 | 5311 | 5054 |
| 127 | F naRXA00171 | 128 | F aaRXA00171 | GR00026 | 10316 | 10086 |
| 129 | naRXN00194 | 130 | aaRXN00194 | VV0115 | 4174 | 4614 |
| 131 | F naRXA00194 | 132 | F aaRXA00194 | GR00030 | 290 | 6 |
| 133 | naRXN00197 | 134 | aaRXN00197 | VV0115 | 2733 | 1522 |
| 135 | F naRXA00197 | 136 | F aaRXA00197 | GR00030 | 1731 | 2741 |
| 137 | naRXN00216 | 138 | aaRXN00216 | VV0096 | 16292 | 15303 |
| 139 | naRXN00222 | 140 | aaRXN00222 | VV0096 | 21079 | 22224 |
| 141 | F naRXA00222 | 142 | F aaRXA00222 | GR00032 | 21073 | 22218 |
| 143 | naRXN00232 | 144 | aaRXN00232 | VV0214 | 601 | 92 |
| 145 | F naRXA00232 | 146 | F aaRXA00232 | GR00035 | 527 | 18 |
| 147 | naRXN00236 | 148 | aaRXN00236 | VV0133 | 3300 | 2575 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 149 | F naRXA00236 | 150 | F aaRXA00236 | GR00036 | 3300 | 2575 |
| 151 | naRXN00242 | 152 | aaRXN00242 | VV0133 | 7031 | 8308 |
| 153 | F naRXA00242 | 154 | F aaRXA00242 | GR00036 | 7031 | 8233 |
| 155 | naRXN00247 | 156 | aaRXN00247 | VV0057 | 35082 | 34156 |
| 157 | F naRXN00247 | 158 | F aaRXA00247 | GR00037 | 7097 | 6171 |
| 159 | naRXN00256 | 160 | aaRXN00256 | VV0015 | 3794 | 4564 |
| 161 | F naRXA00256 | 162 | F aaRXA00256 | GR00039 | 968 | 1738 |
| 163 | naRXN00264 | 164 | aaRXN00264 | VV0123 | 14046 | 13669 |
| 165 | F naRXA00264 | 166 | F aaRXA00264 | GR00040 | 2459 | 2836 |
| 167 | naRXN00267 | 168 | aaRXN00267 | VV0123 | 12366 | 12683 |
| 169 | F naRXA00267 | 170 | F aaRXA00267 | GR00040 | 4091 | 3822 |
| 171 | naRXN00271 | 172 | aaRXN00271 | VV0019 | 4975 | 3986 |
| 173 | F naRXA00271 | 174 | F aaRXA00271 | GR00041 | 3709 | 2720 |
| 175 | naRXN00272 | 176 | aaRXN00272 | VV0019 | 5686 | 6057 |
| 177 | F naRXA00272 | 178 | F aaRXA00272 | GR00041 | 4420 | 4791 |
| 179 | naRXN00283 | 180 | aaRXN00283 | VV0127 | 33097 | 32066 |
| 181 | F naRXA00283 | 182 | F aaRXA00283 | GR00045 | 142 | 1269 |
| 183 | naRXN00334 | 184 | aaRXN00334 | VV0197 | 3581 | 3246 |
| 185 | F naRXA00334 | 186 | F aaRXA00334 | GR00057 | 16762 | 17097 |
| 187 | naRXN00338 | 188 | aaRXN00338 | VV0197 | 26797 | 25658 |
| 189 | F naRXA00338 | 190 | F aaRXA00338 | GR00059 | 1 | 783 |
| 191 | F naRXA00318 | 192 | F aaRXA00318 | GR00055 | 426 | 635 |
| 193 | naRXN00342 | 194 | aaRXN00342 | VV0049 | 1576 | 1148 |
| 195 | F naRXA00342 | 196 | F aaRXA00342 | GR00061 | 73 | 501 |
| 197 | naRXN00344 | 198 | aaRXN00344 | VV0135 | 42719 | 43597 |
| 199 | F naRXA00344 | 200 | F aaRXA00344 | GR00063 | 6 | 584 |
| 201 | naRXN00353 | 202 | aaRXN00353 | VV0135 | 32107 | 32799 |
| 203 | F naRXA00353 | 204 | F aaRXA00353 | GR00068 | 988 | 1680 |
| 205 | naRXN00354 | 206 | aaRXN00354 | VV0135 | 33604 | 32792 |
| 207 | naRXN00362 | 208 | aaRXN00362 | VV0176 | 33334 | 34680 |
| 209 | F naRXA00362 | 210 | F aaRXA00362 | GR00073 | 2 | 961 |
| 211 | naRXN00373 | 212 | aaRXN00373 | VV0226 | 6002 | 6340 |
| 213 | F naRXA00373 | 214 | F aaRXA00373 | GR00079 | 342 | 4 |
| 215 | naRXN00390 | 216 | aaRXN00390 | VV0025 | 9834 | 9430 |
| 217 | F naRXA00390 | 218 | F aaRXA00390 | GR00086 | 1437 | 1841 |
| 219 | naRXN00399 | 220 | aaRXN00399 | VV0025 | 13735 | 13421 |
| 221 | F naRXA00399 | 222 | F aaRXA00399 | GR00087 | 830 | 1144 |
| 223 | naRXA00416 | 224 | aaRXN00416 | VV0181 | 1 | |
| 225 | F naRXA00416 | 226 | F aaRXA00416 | GR00093 | 1 | 327 |
| 227 | F naRXA00418 | 228 | F aaRXA00418 | GR00094 | 1 | 1065 |
| 229 | naRXN00422 | 230 | aaRXN00422 | VV0112 | 3820 | 4713 |
| 231 | F naRXA00422 | 232 | F aaRXA00422 | GR00097 | 428 | 6 |
| 233 | naRXN00447 | 234 | aaRXN00447 | VV0112 | 23325 | 22906 |
| 235 | F naRXA00447 | 236 | F aaRXA00447 | GR00108 | 518 | 817 |
| 237 | naRXN00455 | 238 | aaRXN00455 | VV0076 | 5523 | 4774 |
| 239 | F naRXA00455 | 240 | F aaRXA00455 | GR00113 | 2 | 619 |
| 241 | naRXN00473 | 242 | aaRXN00473 | VV0086 | 31493 | 32281 |
| 243 | F naRXA00473 | 244 | F aaRXA00473 | GR00119 | 5799 | 6563 |
| 245 | naRXN00485 | 246 | aaRXN00485 | VV0086 | 51200 | 48906 |
| 247 | F naRXA00485 | 248 | F aaRXA00485 | GR00119 | 25230 | 23188 |
| 249 | naRXN00496 | 250 | aaRXN00496 | VV0086 | 17452 | 18477 |
| 251 | F naRXA00496 | 252 | F aaRXA00496 | GR00123 | 1776 | 2177 |
| 253 | naRXN00503 | 254 | aaRXN00503 | VV0086 | 11688 | 13409 |
| 255 | naRXN00504 | 256 | aaRXN00504 | VV0086 | 13486 | 13905 |
| 257 | F naRXA00504 | 258 | F aaRXA00504 | GR00125 | 5007 | 5252 |
| 259 | naRXN00505 | 260 | aaRXN00505 | VV0086 | 5810 | 6304 |
| 261 | F naRXA00505 | 262 | F aaRXA00505 | GR00126 | 1 | 252 |
| 263 | naRXN00507 | 264 | aaRXN00507 | VV0086 | 4606 | 3752 |
| 265 | F naRXA00507 | 266 | F aaRXA00507 | GR00127 | 1098 | 244 |
| 267 | naRXN00510 | 268 | aaRXN00510 | VV0086 | 1924 | 3432 |
| 269 | F naRXA00509 | 270 | F aaRXA00509 | GR00128 | 316 | 140 |
| 271 | F naRXA00510 | 272 | F aaRXA00510 | GR00128 | 384 | 914 |
| 273 | naRXN00515 | 274 | aaRXN00515 | VV0144 | 3289 | 2588 |
| 275 | F naRXA00515 | 276 | F aaRXA00515 | GR00131 | 3 | 482 |
| 277 | F naRXA00520 | 278 | F aaRXA00520 | GR00132 | 599 | 796 |
| 279 | naRXN00527 | 280 | aaRXN00527 | VV0079 | 23845 | 25608 |
| 281 | F naRXA00527 | 282 | F aaRXA00527 | GR00136 | 3123 | 1360 |
| 283 | naRXN00547 | 284 | aaRXN00547 | VV0079 | 33886 | 35283 |
| 285 | F naRXA00547 | 286 | F aaRXA00547 | GR00142 | 641 | 1054 |
| 287 | F naRXA00546 | 288 | F aaRXA00546 | GR00142 | 1 | 690 |
| 289 | naRXN00552 | 290 | aaRXN00552 | VV0079 | 27617 | 28552 |
| 291 | F naRXA00552 | 292 | F aaRXA00552 | GR00145 | 2 | 718 |
| 293 | naRXN00555 | 294 | aaRXN00555 | VV0079 | 30437 | 29499 |
| 295 | F naRXA00555 | 296 | F aaRXA00555 | GR00145 | 2555 | 1665 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 297 | naRXN00560 | 298 | aaRXN00560 | VV0103 | 7606 | 7980 |
| 299 | F naRXA00560 | 300 | F aaRXA00560 | GR00149 | 256 | 492 |
| 301 | naRXN00574 | 302 | aaRXN00574 | VV0323 | 16133 | 15255 |
| 303 | F naRXA00574 | 304 | F aaRXA00574 | GR00156 | 767 | 1645 |
| 305 | naRXN00589 | 306 | aaRXN00589 | VV0323 | 2680 | 2231 |
| 307 | F naRXA00589 | 308 | F aaRXA00589 | GR00156 | 14220 | 14582 |
| 309 | naRXN00616 | 310 | aaRXN00616 | VV0054 | 5670 | 5326 |
| 311 | F naRXA00616 | 312 | F aaRXA00616 | GR00162 | 3574 | 3918 |
| 313 | naRXN00647 | 314 | aaRXN00647 | VV0109 | 12861 | 12229 |
| 315 | F naRXA00647 | 316 | F aaRXA00647 | GR00169 | 641 | 1273 |
| 317 | naRXN00653 | 318 | aaRXN00653 | VV0109 | 6578 | 7342 |
| 319 | F naRXA00653 | 320 | F aaRXA00653 | GR00169 | 6924 | 6160 |
| 321 | naRXN00662 | 322 | aaRXN00662 | VV0142 | 7711 | 8979 |
| 323 | F naRXA00662 | 324 | F aaRXA00662 | GR00172 | 2671 | 1403 |
| 325 | naRXN00666 | 326 | aaRXN00666 | VV0109 | 1566 | 2480 |
| 327 | F naRXA00666 | 328 | F aaRXA00666 | GR00175 | 390 | 4 |
| 329 | naRXN00704 | 330 | aaRXN00704 | VV0005 | 9240 | 9866 |
| 331 | F naRXA00704 | 332 | F aaRXA00704 | GR00183 | 2972 | 3484 |
| 333 | naRXN00712 | 334 | aaRXN00712 | VV0005 | 1195 | 500 |
| 335 | F naRXA00712 | 336 | F aaRXA00712 | GR00187 | 1048 | 500 |
| 337 | naRXN00720 | 338 | aaRXN00720 | VV0232 | 4899 | 5564 |
| 339 | F naRXA00720 | 340 | F aaRXA00720 | GR00188 | 7665 | 7000 |
| 341 | naRXN00722 | 342 | aaRXN00722 | VV0052 | 2 | |
| 343 | F naRXA00722 | 344 | F aaRXA00722 | GR00189 | 1015 | 512 |
| 345 | naRXN00729 | 346 | aaRXN00729 | VV0024 | 3903 | 2926 |
| 347 | F naRXA00729 | 348 | F aaRXA00729 | GR00194 | 1 | 642 |
| 349 | F naRXA02867 | 350 | F aaRXA02867 | GR10008 | 610 | 5 |
| 351 | naRXN00730 | 352 | aaRXN00730 | VV0024 | 2031 | 2837 |
| 353 | F naRXA00730 | 354 | F aaRXA00730 | GR00194 | 1063 | 731 |
| 355 | naRXN00731 | 356 | aaRXN00731 | VV0133 | 8314 | 10809 |
| 357 | F naRXA00731 | 358 | F aaRXA00731 | GR00195 | 2613 | 142 |
| 359 | naRXN00738 | 360 | aaRXN00738 | VV0254 | 3 | |
| 361 | F naRXA00738 | 362 | F aaRXA00738 | GR00201 | 78 | 365 |
| 363 | naRXN00750 | 364 | aaRXN00750 | VV0010 | 30086 | 30523 |
| 365 | F naRXA00750 | 366 | F aaRXA00750 | GR00202 | 18937 | 19374 |
| 367 | naRXN00762 | 368 | aaRXN00762 | VV0103 | 16953 | 17828 |
| 369 | naRXN00768 | 370 | aaRXN00768 | VV0103 | 12997 | 11879 |
| 371 | F naRXA00768 | 372 | F aaRXA00768 | GR00204 | 5956 | 6399 |
| 373 | F naRXA00767 | 374 | F aaRXA00767 | GR00204 | 5280 | 5993 |
| 375 | naRXN00769 | 376 | aaRXN00769 | VV0103 | 11654 | 11442 |
| 377 | F naRXA00769 | 378 | F aaRXA00769 | GR00204 | 6624 | 6836 |
| 379 | naRXN00771 | 380 | aaRXN00771 | VV0103 | 26639 | 27457 |
| 381 | F naRXA00771 | 382 | F aaRXA00771 | GR00205 | 857 | 180 |
| 383 | naRXN00785 | 384 | aaRXN00785 | VV0321 | 2 | 658 |
| 385 | F naRXA00785 | 386 | F aaRXA00785 | GR00207 | 625 | 5 |
| 387 | naRXN00795 | 388 | aaRXN00795 | VV0321 | 6259 | 5732 |
| 389 | F naRXA00795 | 390 | F aaRXA00795 | GR00211 | 4228 | 4755 |
| 391 | naRXN00831 | 392 | aaRXN00831 | VV0180 | 4205 | 4906 |
| 393 | F naRXA00831 | 394 | F aaRXA00831 | GR00224 | 1662 | 961 |
| 395 | naRXN00835 | 396 | aaRXN00835 | VV0138 | 12068 | 13021 |
| 397 | F naRXA00835 | 398 | F aaRXA00835 | GR00226 | 3 | 692 |
| 399 | naRXN00836 | 400 | aaRXN00836 | VV0138 | 13126 | 14841 |
| 401 | F naRXA00836 | 402 | F aaRXA00836 | GR00226 | 797 | 2467 |
| 403 | naRXN00840 | 404 | aaRXN00840 | VV0138 | 6220 | 6933 |
| 405 | F naRXA00840 | 406 | F aaRXA00840 | GR00228 | 742 | 1455 |
| 407 | naRXN00841 | 408 | aaRXN00841 | VV0138 | 6944 | 7480 |
| 409 | F naRXA00841 | 410 | F aaRXA00841 | GR00228 | 1466 | 2002 |
| 411 | naRXN00846 | 412 | aaRXN00846 | VV0138 | 2367 | 1498 |
| 413 | F naRXA00846 | 414 | F aaRXA00846 | GR00230 | 391 | 5 |
| 415 | naRXN00850 | 416 | aaRXN00850 | VV0067 | 4148 | 3321 |
| 417 | naRXN00854 | 418 | aaRXN00854 | VV0067 | 371 | 159 |
| 419 | F naRXA00854 | 420 | F aaRXA00854 | GR00231 | 4708 | 4920 |
| 421 | naRXN00855 | 422 | aaRXN00855 | VV0255 | 735 | 1019 |
| 423 | F naRXA00855 | 424 | F aaRXA00855 | GR00232 | 526 | 242 |
| 425 | naRXN00869 | 426 | aaRXN00869 | VV0127 | 5599 | 4679 |
| 427 | F naRXA00869 | 428 | F aaRXA00869 | GR00239 | 1 | 792 |
| 429 | naRXN00915 | 430 | aaRXN00915 | VV0238 | 886 | 257 |
| 431 | F naRXA00915 | 432 | F aaRXA00915 | GR00251 | 514 | 5 |
| 433 | naRXN00917 | 434 | aaRXN00917 | VV0238 | 7202 | 4524 |
| 435 | F naRXA00917 | 436 | F aaRXA00917 | GR00251 | 5534 | 4152 |
| 437 | naRXN00921 | 438 | aaRXN00921 | VV0373 | 1 | 513 |
| 439 | F naRXA00921 | 440 | F aaRXA00921 | GR00252 | 4750 | 2852 |
| 441 | naRXN00943 | 442 | aaRXN00943 | VV0116 | 11376 | 12287 |
| 443 | F naRXA00943 | 444 | F aaRXA00943 | GR00258 | 3 | 509 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 445 | F naRXA02423 | 446 | F aaRXA02423 | GR00706 | 221 | 6 |
| 447 | naRXN00945 | 448 | aaRXN00945 | VV0107 | 1876 | 2847 |
| 449 | naRXN00946 | 450 | aaRXN00946 | VV0107 | 3034 | 3807 |
| 451 | F naRXA00946 | 452 | F aaRXA00946 | GR00259 | 3034 | 3807 |
| 453 | naRXN00953 | 454 | aaRXN00953 | VV0260 | 1834 | 1082 |
| 455 | naRXN00959 | 456 | aaRXN00959 | VV0208 | 402 | 857 |
| 457 | F naRXA00959 | 458 | F aaRXA00959 | GR00265 | 402 | 728 |
| 459 | naRXN00963 | 460 | aaRXN00963 | VV0249 | 1816 | 2652 |
| 461 | F naRXA00963 | 462 | F aaRXA00963 | GR00269 | 442 | 5 |
| 463 | naRXN00971 | 464 | aaRXN00971 | VV0149 | 14706 | 14389 |
| 465 | F naRXA00971 | 466 | F aaRXA00971 | GR00273 | 1421 | 1149 |
| 467 | naRXN00991 | 468 | aaRXN00991 | VV0210 | 4424 | 3045 |
| 469 | naRXN01004 | 470 | aaRXN01004 | VV0210 | 3045 | 1984 |
| 471 | naRXN01016 | 472 | aaRXN01016 | VV0209 | 14476 | 15123 |
| 473 | F naRXA01016 | 474 | F aaRXA01016 | GR00290 | 1141 | 494 |
| 475 | naRXN01023 | 476 | aaRXN01023 | VV0143 | 2343 | 3320 |
| 477 | F naRXA01023 | 478 | F aaRXA01023 | GR00292 | 1817 | 867 |
| 479 | naRXN01028 | 480 | aaRXN01028 | VV0015 | 29000 | 31048 |
| 481 | F naRXA01028 | 482 | F aaRXA01028 | GR00295 | 3 | 626 |
| 483 | F naRXA01812 | 484 | F aaRXA01812 | GR00514 | 3 | 1232 |
| 485 | naRXN01069 | 486 | aaRXN01069 | VV0030 | 986 | 273 |
| 487 | F naRXA01069 | 488 | F aaRXA01069 | GR00299 | 606 | 4 |
| 489 | naRXN01071 | 490 | aaRXN01071 | VV0030 | 4879 | 2816 |
| 491 | F naRXA02898 | 492 | F aaRXA02898 | GR10040 | 1631 | 6 |
| 493 | F naRXA01071 | 494 | F aaRXA01071 | GR00299 | 2822 | 2436 |
| 495 | naRXN01075 | 496 | aaRXN01075 | VV0084 | 42045 | 41635 |
| 497 | F naRXA01075 | 498 | F aaRXA01075 | GR00300 | 3269 | 2859 |
| 499 | naRXN01128 | 500 | aaRXN01128 | VV0157 | 2427 | 3440 |
| 501 | F naRXA01128 | 502 | F aaRXA01128 | GR00314 | 1325 | 312 |
| 503 | naRXN01134 | 504 | aaRXN01134 | VV0077 | 774 | 4 |
| 505 | F naRXA01134 | 506 | F aaRXA01134 | GR00317 | 2 | 460 |
| 507 | naRXN01140 | 508 | aaRXN01140 | VV0077 | 1642 | 710 |
| 509 | F naRXA01140 | 510 | F aaRXA01140 | GR00318 | 3272 | 4057 |
| 511 | naRXN01148 | 512 | aaRXN01148 | VV0136 | 3147 | 3746 |
| 513 | F naRXA01148 | 514 | F aaRXA01148 | GR00323 | 1452 | 2051 |
| 515 | naRXN01153 | 516 | aaRXN01153 | VV0265 | 546 | 4 |
| 517 | F naRXA01153 | 518 | F aaRXA01153 | GR00325 | 546 | 4 |
| 519 | naRXN01154 | 520 | aaRXN01154 | VV0266 | 644 | 6 |
| 521 | F naRXA01154 | 522 | F aaRXA01154 | GR00326 | 608 | 6 |
| 523 | naRXN01155 | 524 | aaRXN01155 | VV0225 | 252 | 1721 |
| 525 | F naRXA01155 | 526 | F aaRXA01155 | GR00327 | 1370 | 6 |
| 527 | naRXN01167 | 528 | aaRXN01167 | VV0117 | 12777 | 13172 |
| 529 | F naRXA01167 | 530 | F aaRXA01167 | GR00333 | 3 | 323 |
| 531 | naRXN01169 | 532 | aaRXN01169 | VV0117 | 5804 | 6799 |
| 533 | F naRXA01169 | 534 | F aaRXA01169 | GR00334 | 1 | 567 |
| 535 | naRXN01173 | 536 | aaRXN01173 | VV0117 | 11085 | 10471 |
| 537 | F naRXA01173 | 538 | F aaRXA01173 | GR00334 | 4853 | 4239 |
| 539 | naRXN01174 | 540 | aaRXN01174 | VV0117 | 12236 | 11487 |
| 541 | F naRXA01174 | 542 | F aaRXA01174 | GR00334 | 6004 | 5255 |
| 543 | naRXN01229 | 544 | aaRXN01229 | VV0020 | 32482 | 31205 |
| 545 | F naRXA01229 | 546 | F aaRXA01229 | GR00355 | 2806 | 3498 |
| 547 | naRXN01246 | 548 | aaRXN01246 | VV0104 | 2815 | 3321 |
| 549 | F naRXA01246 | 550 | F aaRXA01246 | GR00360 | 1824 | 2462 |
| 551 | naRXN01249 | 552 | aaRXN01249 | VV0271 | 1 |  |
| 553 | F naRXA01249 | 554 | F aaRXA01249 | GR00363 | 303 | 4 |
| 555 | naRXN01251 | 556 | aaRXN01251 | VV0219 | 13143 | 12835 |
| 557 | F naRXA01251 | 558 | F aaRXA01251 | GR00365 | 228 | 536 |
| 559 | naRXN01263 | 560 | aaRXN01263 | VV0009 | 11816 | 12727 |
| 561 | F naRXA01263 | 562 | F aaRXA01263 | GR00367 | 10720 | 11631 |
| 563 | naRXN01266 | 564 | aaRXN01266 | VV0009 | 15553 | 14519 |
| 565 | F naRXA01266 | 566 | F aaRXA01266 | GR00367 | 14457 | 13423 |
| 567 | naRXN01275 | 568 | aaRXN01275 | VV0009 | 29514 | 30431 |
| 569 | F naRXA01275 | 570 | F aaRXA01275 | GR00367 | 28418 | 29335 |
| 571 | naRXN01281 | 572 | aaRXN01281 | VV0212 | 4506 | 5267 |
| 573 | F naRXA01281 | 574 | F aaRXA01281 | GR00369 | 3869 | 4630 |
| 575 | naRXN01296 | 576 | aaRXN01296 | VV0209 | 10462 | 9380 |
| 577 | F naRXA01296 | 578 | F aaRXA01296 | GR00373 | 5836 | 4754 |
| 579 | naRXN01306 | 580 | aaRXN01306 | VV0148 | 8158 | 7151 |
| 581 | F naRXA01306 | 582 | F aaRXA01306 | GR00376 | 5691 | 4684 |
| 583 | naRXN01324 | 584 | aaRXN01324 | VV0082 | 6588 | 6887 |
| 585 | naRXN01331 | 586 | aaRXN01331 | VV0005 | 39816 | 42212 |
| 587 | F naRXA01331 | 588 | F aaRXA01331 | GR00387 | 1606 | 1031 |
| 589 | F naRXA00668 | 590 | F aaRXA00668 | GR00176 | 797 | 6 |
| 591 | F naRXA00674 | 592 | F aaRXA00674 | GR00177 | 755 | 6 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 593 | naRXN01337 | 594 | aaRXN01337 | VV0032 | 1925 | 3337 |
| 595 | F naRXA01337 | 596 | F aaRXA01337 | GR00389 | 5065 | 3653 |
| 597 | naRXN01351 | 598 | aaRXN01351 | VV0123 | 2841 | 3425 |
| 599 | naRXN01362 | 600 | aaRXN01362 | VV0051 | 27040 | 23387 |
| 601 | F naRXA01362 | 602 | F aaRXA01362 | GR00395 | 3 | 1397 |
| 603 | F naRXA01364 | 604 | F aaRXA01364 | GR00396 | 1869 | 4 |
| 605 | naRXN01379 | 606 | aaRXN01379 | VV0091 | 10518 | 11459 |
| 607 | F naRXA01379 | 608 | F aaRXA01379 | GR00402 | 926 | 6 |
| 609 | naRXN01390 | 610 | aaRXN01390 | VV0277 | 6654 | 7310 |
| 611 | F naRXA01390 | 612 | F aaRXA01390 | GR00408 | 992 | 336 |
| 613 | naRXN01391 | 614 | aaRXN01391 | VV0277 | 5568 | 6257 |
| 615 | F naRXA01391 | 616 | F aaRXA01391 | GR00408 | 2078 | 1389 |
| 617 | naRXN01400 | 618 | aaRXN01400 | VV0126 | 2988 | 1489 |
| 619 | F naRXA01400 | 620 | F aaRXA01400 | GR00409 | 2988 | 1489 |
| 621 | naRXN01409 | 622 | aaRXN01409 | VV0278 | 5304 | 4483 |
| 623 | F naRXA01409 | 624 | F aaRXA01409 | GR00410 | 5296 | 4481 |
| 625 | naRXN01434 | 626 | aaRXN01434 | VV0050 | 13792 | 10841 |
| 627 | F naRXA01434 | 628 | F aaRXA01434 | GR00417 | 10228 | 9863 |
| 629 | naRXN01448 | 630 | aaRXN01448 | VV0089 | 9602 | 10768 |
| 631 | F naRXA01448 | 632 | F aaRXA01448 | GR00418 | 19796 | 19017 |
| 633 | naRXN01459 | 634 | aaRXN01459 | VV0233 | 3311 | 4120 |
| 635 | F naRXA01459 | 636 | F aaRXA01459 | GR00420 | 3311 | 4120 |
| 637 | naRXN01460 | 638 | aaRXN01460 | VV0233 | 4066 | 4359 |
| 639 | F naRXA01460 | 640 | F aaRXA01460 | GR00420 | 4066 | 4359 |
| 641 | naRXN01471 | 642 | aaRXN01471 | VV0019 | 11467 | 10661 |
| 643 | F naRXA01471 | 644 | F aaRXA01471 | GR00422 | 5243 | 4437 |
| 645 | naRXN01479 | 646 | aaRXN01479 | VV0019 | 18635 | 18874 |
| 647 | F naRXA01479 | 648 | F aaRXA01479 | GR00422 | 12423 | 12650 |
| 649 | naRXN01484 | 650 | aaRXN01484 | VV0019 | 26292 | 25747 |
| 651 | F naRXA01484 | 652 | F aaRXA01484 | GR00422 | 20068 | 19523 |
| 653 | naRXN01485 | 654 | aaRXN01485 | VV0019 | 26454 | 28505 |
| 655 | F naRXA01485 | 656 | F aaRXA01485 | GR00422 | 20230 | 22281 |
| 657 | naRXN01492 | 658 | aaRXN01492 | VV0139 | 36004 | 36807 |
| 659 | F naRXA01492 | 660 | F aaRXA01492 | GR00423 | 6133 | 5330 |
| 661 | naRXN01518 | 662 | aaRXN01518 | VV0008 | 23238 | 23711 |
| 663 | F naRXA01518 | 664 | F aaRXA01518 | GR00424 | 23238 | 23711 |
| 665 | naRXN01549 | 666 | aaRXN01549 | VV0080 | 46 | 1704 |
| 667 | F naRXA01549 | 668 | F aaRXA01549 | GR00430 | 8426 | 7566 |
| 669 | F naRXA02011 | 670 | F aaRXA02011 | GR00603 | 46 | 363 |
| 671 | naRXN01557 | 672 | aaRXN01557 | VV0323 | 959 | 1774 |
| 673 | F naRXA01557 | 674 | F aaRXA01557 | GR00433 | 959 | 1774 |
| 675 | naRXN01574 | 676 | aaRXN01574 | VV0009 | 48980 | 47946 |
| 677 | F naRXA01574 | 678 | F aaRXA01574 | GR00438 | 6963 | 5929 |
| 679 | naRXN01589 | 680 | aaRXN01589 | VV0227 | 1216 | 197 |
| 681 | naRXN01592 | 682 | aaRXN01592 | VV0229 | 14706 | 13405 |
| 683 | F naRXA01592 | 684 | F aaRXA01592 | GR00447 | 3 | 1295 |
| 685 | naRXN01597 | 686 | aaRXN01597 | VV0229 | 8480 | 7299 |
| 687 | F naRXA01597 | 688 | F aaRXA01597 | GR00447 | 6220 | 7401 |
| 689 | naRXN01598 | 690 | aaRXN01598 | VV0229 | 7286 | 6324 |
| 691 | F naRXA01598 | 692 | F aaRXA01598 | GR00447 | 7414 | 8376 |
| 693 | naRXN01618 | 694 | aaRXN01618 | VV0050 | 23629 | 23246 |
| 695 | F naRXA01618 | 696 | F aaRXA01618 | GR00451 | 1387 | 1004 |
| 697 | naRXN01634 | 698 | aaRXN01634 | VV0050 | 43466 | 42915 |
| 699 | F naRXA01634 | 700 | F aaRXA01634 | GR00454 | 4988 | 5539 |
| 701 | naRXN01635 | 702 | aaRXN01635 | VV0050 | 42879 | 42139 |
| 703 | F naRXA01635 | 704 | F aaRXA01635 | GR00454 | 5575 | 6315 |
| 705 | naRXN01647 | 706 | aaRXN01647 | VV0005 | 43276 | 44445 |
| 707 | F naRXA01647 | 708 | F aaRXA01647 | GR00456 | 12422 | 11535 |
| 709 | naRXN01658 | 710 | aaRXN01658 | VV0010 | 44183 | 42351 |
| 711 | F naRXA01658 | 712 | F aaRXA01658 | GR00461 | 5 | 1489 |
| 713 | naRXN01659 | 714 | aaRXN01659 | VV0089 | 5059 | 5604 |
| 715 | F naRXA01659 | 716 | F aaRXA01659 | GR00462 | 3 | 488 |
| 717 | naRXN01663 | 718 | aaRXN01663 | VV0089 | 4271 | 5128 |
| 719 | F naRXA01663 | 720 | F aaRXA01663 | GR00463 | 438 | 4 |
| 721 | naRXN01669 | 722 | aaRXN01669 | VV0057 | 4529 | 5443 |
| 723 | F naRXA01669 | 724 | F aaRXA01669 | GR00465 | 1002 | 271 |
| 725 | naRXN01672 | 726 | aaRXN01672 | VV0179 | 7849 | 8190 |
| 727 | F naRXA01672 | 728 | F aaRXA01672 | GR00467 | 2 | 310 |
| 729 | naRXN01694 | 730 | aaRXN01694 | VV0139 | 13054 | 13953 |
| 731 | F naRXA01694 | 732 | F aaRXA01694 | GR00474 | 3931 | 3032 |
| 733 | naRXN01696 | 734 | aaRXN01696 | VV0115 | 1381 | 203 |
| 735 | F naRXA01696 | 736 | F aaRXA01696 | GR00475 | 799 | 203 |
| 737 | naRXN01697 | 738 | aaRXN01697 | VV0139 | 1581 | 625 |
| 739 | F naRXA01697 | 740 | F aaRXA01697 | GR00476 | 761 | 1486 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 741 | naRXN01701 | 742 | aaRXN01701 | VV0162 | 375 | 4 |
| 743 | F naRXA01701 | 744 | F aaRXA01701 | GR00478 | 196 | 528 |
| 745 | naRXN01703 | 746 | aaRXN01703 | VV0089 | 7108 | 8220 |
| 747 | F naRXA01703 | 748 | F aaRXA01703 | GR00479 | 2118 | 1648 |
| 749 | naRXN01709 | 750 | aaRXN01709 | VV0022 | 847 | 416 |
| 751 | F naRXA01709 | 752 | F aaRXA01709 | GR00483 | 745 | 416 |
| 753 | naRXN01711 | 754 | aaRXN01711 | VV0191 | 8153 | 6996 |
| 755 | F naRXA01711 | 756 | F aaRXA01711 | GR00484 | 2007 | 850 |
| 757 | naRXN01721 | 758 | aaRXN01721 | VV0036 | 1026 | 4 |
| 759 | naRXN01734 | 760 | aaRXN01734 | VV0221 | 1251 | 1784 |
| 761 | F naRXA01734 | 762 | F aaRXA01734 | GR00492 | 544 | 1077 |
| 763 | naRXN01742 | 764 | aaRXN01742 | VV0233 | 5246 | 4743 |
| 765 | F naRXA01742 | 766 | F aaRXA01742 | GR00493 | 7614 | 8117 |
| 767 | naRXN01754 | 768 | aaRXN01754 | VV0127 | 38790 | 36850 |
| 769 | F naRXA01754 | 770 | F aaRXA01754 | GR00497 | 4082 | 2142 |
| 771 | naRXN01761 | 772 | aaRXN01761 | VV0010 | 11968 | 7505 |
| 773 | F naRXA00739 | 774 | F aaRXA00739 | GR00202 | 819 | 4 |
| 775 | F naRXA01587 | 776 | F aaRXA01587 | GR00442 | 120 | 2102 |
| 777 | F naRXA01761 | 778 | F aaRXA01761 | GR00499 | 7001 | 5484 |
| 779 | naRXN01765 | 780 | aaRXN01765 | VV0054 | 17190 | 18131 |
| 781 | F naRXA01765 | 782 | F aaRXA01765 | GR00500 | 3144 | 4085 |
| 783 | naRXN01767 | 784 | aaRXN01767 | VV0015 | 55242 | 55706 |
| 785 | F naRXA01767 | 786 | F aaRXA01767 | GR00501 | 341 | 6 |
| 787 | naRXN01769 | 788 | aaRXN01769 | VV0015 | 54296 | 54736 |
| 789 | F naRXA01769 | 790 | F aaRXA01769 | GR00501 | 1275 | 847 |
| 791 | naRXN01771 | 792 | aaRXN01771 | VV0050 | 35063 | 35764 |
| 793 | F naRXA01771 | 794 | F aaRXA01771 | GR00502 | 886 | 185 |
| 795 | naRXN01774 | 796 | aaRXN01774 | VV0015 | 1794 | 2519 |
| 797 | F naRXA01774 | 798 | F aaRXA01774 | GR00503 | 634 | 1416 |
| 799 | naRXN01787 | 800 | aaRXN01787 | VV0039 | 256 | 948 |
| 801 | F naRXA01787 | 802 | F aaRXA01787 | GR00506 | 2 | 355 |
| 803 | naRXN01796 | 804 | aaRXN01796 | VV0137 | 2070 | 2843 |
| 805 | F naRXA01796 | 806 | F aaRXA01796 | GR00508 | 2 | 484 |
| 807 | naRXN01803 | 808 | aaRXN01803 | VV0216 | 3355 | 4314 |
| 809 | F naRXA01803 | 810 | F aaRXA01803 | GR00509 | 5671 | 4712 |
| 811 | naRXN01809 | 812 | aaRXN01809 | VV0081 | 9171 | 10346 |
| 813 | F naRXA01062 | 814 | F aaRXA01062 | GR00297 | 490 | 5 |
| 815 | F naRXA01809 | 816 | F aaRXA01809 | GR00510 | 3 | 638 |
| 817 | naRXN01811 | 818 | aaRXN01811 | VV0146 | 1243 | 1923 |
| 819 | naRXN01813 | 820 | aaRXN01813 | VV0084 | 46618 | 45953 |
| 821 | F naRXA01813 | 822 | F aaRXA01813 | GR00515 | 635 | 6 |
| 823 | naRXN01815 | 824 | aaRXN01815 | VV0084 | 49277 | 50068 |
| 825 | F naRXA01815 | 826 | F aaRXA01815 | GR00515 | 3294 | 4085 |
| 827 | naRXN01825 | 828 | aaRXN01825 | VV0083 | 2847 | 2578 |
| 829 | F naRXA01825 | 830 | F aaRXA01825 | GR00516 | 2847 | 2578 |
| 831 | naRXN01831 | 832 | aaRXN01831 | VV0083 | 10874 | 10413 |
| 833 | F naRXA01831 | 834 | F aaRXA01831 | GR00516 | 10874 | 10413 |
| 835 | naRXN01834 | 836 | aaRXN01834 | VV0143 | 11244 | 11945 |
| 837 | F naRXA01834 | 838 | F aaRXA01834 | GR00517 | 2478 | 1777 |
| 839 | naRXN01846 | 840 | aaRXN01846 | VV0010 | 287 | 6 |
| 841 | F naRXA01846 | 842 | F aaRXA01846 | GR00523 | 261 | 4 |
| 843 | naRXN01847 | 844 | aaRXN01847 | VV0139 | 19018 | 18284 |
| 845 | F naRXA01847 | 846 | F aaRXA01847 | GR00524 | 52 | 786 |
| 847 | naRXN01874 | 848 | aaRXN01874 | VV0248 | 352 | 5 |
| 849 | F naRXA01874 | 850 | F aaRXA01874 | GR00535 | 2556 | 2903 |
| 851 | naRXN01875 | 852 | aaRXN01875 | VV0145 | 2894 | 2049 |
| 853 | F naRXA01875 | 854 | F aaRXA01875 | GR00536 | 516 | 1313 |
| 855 | F naRXA02734 | 856 | F aaRXA02734 | GR00762 | 6514 | 6897 |
| 857 | naRXN01877 | 858 | aaRXN01877 | VV0105 | 3493 | 2423 |
| 859 | F naRXA01877 | 860 | F aaRXA01877 | GR00537 | 135 | 1199 |
| 861 | naRXN01879 | 862 | aaRXN01879 | VV0105 | 1505 | 573 |
| 863 | F naRXA01879 | 864 | F aaRXA01879 | GR00537 | 2117 | 2704 |
| 865 | F naRXA01880 | 866 | F aaRXA01880 | GR00537 | 2641 | 3048 |
| 867 | naRXN01896 | 868 | aaRXN01896 | VV0098 | 75888 | 76523 |
| 869 | F naRXA01896 | 870 | F aaRXA01896 | GR00544 | 2 | 580 |
| 871 | naRXN01899 | 872 | aaRXN01899 | VV0098 | 77817 | 78602 |
| 873 | F naRXA01899 | 874 | F aaRXA01899 | GR00544 | 1874 | 2659 |
| 875 | naRXN01902 | 876 | aaRXN01902 | VV0098 | 84095 | 83037 |
| 877 | F naRXA01902 | 878 | F aaRXA01902 | GR00544 | 7957 | 7094 |
| 879 | naRXN01908 | 880 | aaRXN01908 | VV0187 | 4030 | 4875 |
| 881 | F naRXA01908 | 882 | F aaRXA01908 | GR00545 | 4030 | 4512 |
| 883 | naRXN01909 | 884 | aaRXN01909 | VV0218 | 69 | 947 |
| 885 | F naRXA01909 | 886 | F aaRXA01909 | GR00546 | 59 | 937 |
| 887 | naRXN01910 | 888 | aaRXN01910 | VV0218 | 1040 | 1885 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 889 | F naRXA01910 | 890 | F aaRXA01910 | GR00546 | 1030 | 1875 |
| 891 | naRXN01911 | 892 | aaRXN01911 | VV0218 | 2209 | 3147 |
| 893 | F naRXA01911 | 894 | F aaRXA01911 | GR00546 | 2199 | 3044 |
| 895 | naRXN01930 | 896 | aaRXN01930 | VV0127 | 46545 | 47495 |
| 897 | F naRXA01930 | 898 | F aaRXA01930 | GR00555 | 3817 | 2867 |
| 899 | naRXN01944 | 900 | aaRXN01944 | VV0050 | 42128 | 41157 |
| 901 | F naRXA01944 | 902 | F aaRXA01944 | GR00558 | 2 | 385 |
| 903 | F naRXA01636 | 904 | F aaRXA01636 | GR00454 | 6326 | 6898 |
| 905 | naRXN01945 | 906 | aaRXN01945 | VV0050 | 41150 | 39159 |
| 907 | F naRXA01945 | 908 | F aaRXA01945 | GR00558 | 392 | 1633 |
| 909 | F naRXA01627 | 910 | F aaRXA01627 | GR00453 | 1 | 495 |
| 911 | naRXN01960 | 912 | aaRXN01960 | VV0200 | 2259 | 1942 |
| 913 | F naRXA01960 | 914 | F aaRXA01960 | GR00565 | 187 | 504 |
| 915 | naRXN01985 | 916 | aaRXN01985 | VV0056 | 1331 | 282 |
| 917 | naRXN01987 | 918 | aaRXN01987 | VV0149 | 167 | 379 |
| 919 | F naRXA01987 | 920 | F aaRXA01987 | GR00576 | 167 | 379 |
| 921 | naRXN01988 | 922 | aaRXN01988 | VV0149 | 887 | 462 |
| 923 | F naRXA01988 | 924 | F aaRXA01988 | GR00576 | 779 | 462 |
| 925 | naRXN01991 | 926 | aaRXN01991 | VV0230 | 926 | 1798 |
| 927 | F naRXA01991 | 928 | F aaRXA01991 | GR00581 | 926 | 1720 |
| 929 | naRXN01996 | 930 | aaRXN01996 | VV0174 | 28434 | 27898 |
| 931 | F naRXA01996 | 932 | F aaRXA01996 | GR00585 | 88 | 624 |
| 933 | naRXN02007 | 934 | aaRXN02007 | VV0324 | 855 | 223 |
| 935 | F naRXA02007 | 936 | F aaRXA02007 | GR00598 | 651 | 223 |
| 937 | naRXN02014 | 938 | aaRXN02014 | VV0137 | 8298 | 8804 |
| 939 | F naRXA02014 | 940 | F aaRXA02014 | GR00607 | 935 | 540 |
| 941 | naRXN02019 | 942 | aaRXN02019 | VV0129 | 44705 | 44205 |
| 943 | F naRXA02019 | 944 | F aaRXA02019 | GR00612 | 597 | 106 |
| 945 | naRXN02023 | 946 | aaRXN02023 | VV0160 | 3234 | 4001 |
| 947 | F naRXA02023 | 948 | F aaRXA02023 | GR00613 | 3234 | 4001 |
| 949 | naRXN02032 | 950 | aaRXN02032 | VV0117 | 5181 | 5750 |
| 951 | F naRXA02032 | 952 | F aaRXA02032 | GR00618 | 4160 | 4729 |
| 953 | naRXN02039 | 954 | aaRXN02039 | VV0190 | 1482 | 643 |
| 955 | F naRXA02039 | 956 | F aaRXA02039 | GR00621 | 3 | 812 |
| 957 | naRXN02044 | 958 | aaRXN02044 | VV0025 | 17208 | 15826 |
| 959 | naRXN02045 | 960 | aaRXN02045 | VV0025 | 15823 | 15563 |
| 961 | F naRXA02045 | 962 | F aaRXA02045 | GR00623 | 1913 | 2173 |
| 963 | naRXN02049 | 964 | aaRXN02049 | VV0009 | 35549 | 36157 |
| 965 | F naRXA02049 | 966 | F aaRXA02049 | GR00624 | 1583 | 2029 |
| 967 | naRXN02050 | 968 | aaRXN02050 | VV0009 | 36003 | 36797 |
| 969 | F naRXA02050 | 970 | F aaRXA02050 | GR00624 | 2462 | 2833 |
| 971 | naRXN02059 | 972 | aaRXN02059 | VV0222 | 10306 | 10800 |
| 973 | F naRXA02059 | 974 | F aaRXA02059 | GR00625 | 4678 | 4184 |
| 975 | naRXN02066 | 976 | aaRXN02066 | VV0222 | 6187 | 6678 |
| 977 | F naRXA02066 | 978 | F aaRXA02066 | GR00626 | 6187 | 6678 |
| 979 | naRXN02067 | 980 | aaRXN02067 | VV0222 | 6733 | 7188 |
| 981 | F naRXA02067 | 982 | F aaRXA02067 | GR00626 | 6733 | 7188 |
| 983 | naRXN02075 | 984 | aaRXN02075 | VV0318 | 12990 | 13778 |
| 985 | naRXN02076 | 986 | aaRXN02076 | VV0318 | 13879 | 14412 |
| 987 | F naRXA02076 | 988 | F aaRXA02076 | GR00628 | 6902 | 7435 |
| 989 | naRXN02094 | 990 | aaRXN02094 | VV0126 | 18268 | 18984 |
| 991 | F naRXA02094 | 992 | F aaRXA02094 | GR00629 | 13282 | 13998 |
| 993 | naRXN02104 | 994 | aaRXN02104 | VV0318 | 7435 | 6314 |
| 995 | F naRXA02104 | 996 | F aaRXA02104 | GR00631 | 5327 | 4908 |
| 997 | F naRXA02071 | 998 | F aaRXA02071 | GR00628 | 458 | 6 |
| 999 | naRXN02107 | 1000 | aaRXN02107 | VV0123 | 21585 | 21244 |
| 1001 | F naRXA02107 | 1002 | F aaRXA02107 | GR00632 | 1536 | 1877 |
| 1003 | naRXN02108 | 1004 | aaRXN02108 | VV0123 | 21217 | 20609 |
| 1005 | F naRXA02108 | 1006 | F aaRXA02108 | GR00632 | 2077 | 2511 |
| 1007 | naRXN02114 | 1008 | aaRXN02114 | VV0180 | 3 | |
| 1009 | F naRXA02114 | 1010 | F aaRXA02114 | GR00634 | 615 | 130 |
| 1011 | naRXN02121 | 1012 | aaRXN02121 | VV0102 | 12833 | 12129 |
| 1013 | F naRXA02121 | 1014 | F aaRXA02121 | GR00636 | 5813 | 5109 |
| 1015 | naRXN02138 | 1016 | aaRXN02138 | VV0300 | 4409 | 4750 |
| 1017 | F naRXA02138 | 1018 | F aaRXA02138 | GR00639 | 4409 | 4750 |
| 1019 | naRXN02151 | 1020 | aaRXN02151 | VV0300 | 19913 | 21100 |
| 1021 | F naRXA02151 | 1022 | F aaRXA02151 | GR00639 | 19913 | 21100 |
| 1023 | naRXN02169 | 1024 | aaRXN02169 | VV0100 | 3172 | 4017 |
| 1025 | F naRXA02169 | 1026 | F aaRXA02169 | GR00641 | 3172 | 4017 |
| 1027 | naRXN02180 | 1028 | aaRXN02180 | VV0100 | 16813 | 15356 |
| 1029 | F naRXA02180 | 1030 | F aaRXA02180 | GR00641 | 16813 | 15356 |
| 1031 | naRXN02185 | 1032 | aaRXN02185 | VV0100 | 20185 | 20763 |
| 1033 | F naRXA02185 | 1034 | F aaRXA02185 | GR00641 | 20185 | 20763 |
| 1035 | naRXN02186 | 1036 | aaRXN02186 | VV0100 | 21192 | 20995 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 1037 | F naRXA02186 | 1038 | F aaRXA02186 | GR00641 | 21213 | 20995 |
| 1039 | naRXN02207 | 1040 | aaRXN02207 | VV0302 | 802 | 5 |
| 1041 | F naRXA02207 | 1042 | F aaRXA02207 | GR00646 | 10909 | 11667 |
| 1043 | naRXN02223 | 1044 | aaRXN02223 | VV0308 | 2732 | 3232 |
| 1045 | F naRXA02223 | 1046 | F aaRXA02223 | GR00652 | 425 | 6 |
| 1047 | naRXN02226 | 1048 | aaRXN02226 | VV0068 | 1059 | 4 |
| 1049 | F naRXA02226 | 1050 | F aaRXA02226 | GR00653 | 1059 | 4 |
| 1051 | naRXN02238 | 1052 | aaRXN02238 | VV0204 | 1345 | 1629 |
| 1053 | F naRXA02238 | 1054 | F aaRXA02238 | GR00654 | 5241 | 5525 |
| 1055 | naRXN02254 | 1056 | aaRXN02254 | VV0202 | 2 | |
| 1057 | F naRXA02254 | 1058 | F aaRXA02254 | GR00654 | 21769 | 22449 |
| 1059 | naRXN02271 | 1060 | aaRXN02271 | VV0020 | 14281 | 14838 |
| 1061 | F naRXA02271 | 1062 | F aaRXA02271 | GR00655 | 5406 | 5963 |
| 1063 | naRXN02279 | 1064 | aaRXN02279 | VV0020 | 236 | 1693 |
| 1065 | F naRXA02279 | 1066 | F aaRXA02279 | GR00657 | 1 | 1404 |
| 1067 | naRXN02296 | 1068 | aaRXN02296 | VV0127 | 24138 | 24626 |
| 1069 | F naRXA02296 | 1070 | F aaRXA02296 | GR00662 | 6978 | 7466 |
| 1071 | naRXN02300 | 1072 | aaRXN02300 | VV0127 | 28354 | 28022 |
| 1073 | F naRXA02300 | 1074 | F aaRXA02300 | GR00662 | 11194 | 10862 |
| 1075 | naRXN02301 | 1076 | aaRXN02301 | VV0127 | 29070 | 28354 |
| 1077 | F naRXA02301 | 1078 | F aaRXA02301 | GR00662 | 11910 | 11194 |
| 1079 | naRXN02302 | 1080 | aaRXN02302 | VV0127 | 29196 | 30074 |
| 1081 | F naRXA02302 | 1082 | F aaRXA02302 | GR00662 | 12036 | 12800 |
| 1083 | naRXN02303 | 1084 | aaRXN02303 | VV0127 | 13326 | 14231 |
| 1085 | F naRXA02303 | 1086 | F aaRXA02303 | GR00663 | 1 | 720 |
| 1087 | naRXN02307 | 1088 | aaRXN02307 | VV0127 | 12611 | 11991 |
| 1089 | F naRXA02307 | 1090 | F aaRXA02307 | GR00664 | 395 | 6 |
| 1091 | naRXN02314 | 1092 | aaRXN02314 | VV0025 | 23092 | 23532 |
| 1093 | F naRXA02314 | 1094 | F aaRXA02314 | GR00665 | 6379 | 5939 |
| 1095 | naRXN02337 | 1096 | aaRXN02337 | VV0141 | 4679 | 3357 |
| 1097 | F naRXA02337 | 1098 | F aaRXA02337 | GR00672 | 2893 | 3816 |
| 1099 | naRXN02339 | 1100 | aaRXN02339 | VV0195 | 1 | |
| 1101 | F naRXA02339 | 1102 | F aaRXA02339 | GR00674 | 1 | 492 |
| 1103 | naRXN02340 | 1104 | aaRXN02340 | VV0195 | 1640 | 576 |
| 1105 | F naRXA02338 | 1106 | F aaRXA02338 | GR00673 | 484 | 5 |
| 1107 | F naRXA02340 | 1108 | F aaRXA02340 | GR00674 | 1214 | 576 |
| 1109 | naRXN02341 | 1110 | aaRXN02341 | VV0078 | 4279 | 4764 |
| 1111 | F naRXA02341 | 1112 | F aaRXA02341 | GR00675 | 415 | 5 |
| 1113 | naRXN02360 | 1114 | aaRXN02360 | VV0051 | 14638 | 12206 |
| 1115 | F naRXA02360 | 1116 | F aaRXA02360 | GR00685 | 3644 | 6076 |
| 1117 | naRXN02361 | 1118 | aaRXN02361 | VV0051 | 12122 | 11472 |
| 1119 | F naRXA02361 | 1120 | F aaRXA02361 | GR00685 | 6160 | 6810 |
| 1121 | naRXN02367 | 1122 | aaRXN02367 | VV0102 | 4639 | 5247 |
| 1123 | F naRXA02367 | 1124 | F aaRXA02367 | GR00687 | 2162 | 1554 |
| 1125 | naRXN02368 | 1126 | aaRXN02368 | VV0102 | 3883 | 4557 |
| 1127 | F naRXA02368 | 1128 | F aaRXA02368 | GR00687 | 2918 | 2244 |
| 1129 | naRXN02381 | 1130 | aaRXN02381 | VV0213 | 3765 | 2743 |
| 1131 | F naRXA02381 | 1132 | F aaRXA02381 | GR00691 | 1792 | 770 |
| 1133 | naRXN02383 | 1134 | aaRXN02383 | VV0213 | 639 | 4 |
| 1135 | F naRXA02383 | 1136 | F aaRXA02383 | GR00692 | 608 | 6 |
| 1137 | naRXN02387 | 1138 | aaRXN02387 | VV0176 | 2729 | 3490 |
| 1139 | F naRXA02387 | 1140 | F aaRXA02387 | GR00694 | 683 | 6 |
| 1141 | naRXN02398 | 1142 | aaRXN02398 | VV0176 | 12750 | 11149 |
| 1143 | F naRXA02398 | 1144 | F aaRXA02398 | GR00698 | 2841 | 4370 |
| 1145 | naRXN02406 | 1146 | aaRXN02406 | VV0084 | 22016 | 22564 |
| 1147 | F naRXA02406 | 1148 | F aaRXA02406 | GR00701 | 1322 | 774 |
| 1149 | naRXN02407 | 1150 | aaRXN02407 | VV0084 | 21758 | 21387 |
| 1151 | F naRXA02407 | 1152 | F aaRXA02407 | GR00701 | 1580 | 1885 |
| 1153 | naRXN02408 | 1154 | aaRXN02408 | VV0084 | 20832 | 19921 |
| 1155 | F naRXA02408 | 1156 | F aaRXA02408 | GR00702 | 832 | 5 |
| 1157 | naRXN02409 | 1158 | aaRXN02409 | VV0084 | 21371 | 20835 |
| 1159 | F naRXA02409 | 1160 | F aaRXA02409 | GR00702 | 1248 | 835 |
| 1161 | naRXN02428 | 1162 | aaRXN02428 | VV0110 | 4585 | 3452 |
| 1163 | F naRXA02428 | 1164 | F aaRXA02428 | GR00707 | 4585 | 3452 |
| 1165 | naRXN02454 | 1166 | aaRXN02454 | VV0196 | 2810 | 1569 |
| 1167 | F naRXA02454 | 1168 | F aaRXA02454 | GR00711 | 3 | 815 |
| 1169 | naRXN02457 | 1170 | aaRXN02457 | VV0124 | 19193 | 18084 |
| 1171 | F naRXA02457 | 1172 | F aaRXA02457 | GR00712 | 1295 | 2404 |
| 1173 | naRXN02460 | 1174 | aaRXN02460 | VV0124 | 14649 | 15152 |
| 1175 | F naRXA02460 | 1176 | F aaRXA02460 | GR00712 | 5839 | 5336 |
| 1177 | naRXN02464 | 1178 | aaRXN02464 | VV0211 | 1990 | 3189 |
| 1179 | F naRXA02464 | 1180 | F aaRXA02464 | GR00713 | 1107 | 1613 |
| 1181 | naRXN02465 | 1182 | aaRXN02465 | VV0211 | 3590 | 3192 |
| 1183 | F naRXA02465 | 1184 | F aaRXA02465 | GR00713 | 2014 | 1616 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 1185 | naRXN02466 | 1186 | aaRXN02466 | VV0211 | 92 | 6 |
| 1187 | F naRXA02466 | 1188 | F aaRXA02466 | GR00714 | 92 | 6 |
| 1189 | naRXN02505 | 1190 | aaRXN02505 | VV0007 | 23969 | 24139 |
| 1191 | F naRXA02505 | 1192 | F aaRXA02505 | GR00720 | 18423 | 18593 |
| 1193 | naRXN02510 | 1194 | aaRXN02510 | VV0171 | 17467 | 16832 |
| 1195 | F naRXA02510 | 1196 | F aaRXA02510 | GR00721 | 1983 | 2618 |
| 1197 | naRXN02519 | 1198 | aaRXN02519 | VV0183 | 2709 | 4337 |
| 1199 | F naRXA02519 | 1200 | F aaRXA02519 | GR00724 | 1933 | 128 |
| 1201 | naRXN02520 | 1202 | aaRXN02520 | VV0183 | 2243 | 1560 |
| 1203 | F naRXA02520 | 1204 | F aaRXA02520 | GR00724 | 2222 | 2905 |
| 1205 | naRXN02534 | 1206 | aaRXN02534 | VV0057 | 11192 | 11995 |
| 1207 | F naRXA02534 | 1208 | F aaRXA02534 | GR00726 | 5536 | 6339 |
| 1209 | naRXN02537 | 1210 | aaRXN02537 | VV0057 | 14617 | 15078 |
| 1211 | F naRXA02537 | 1212 | F aaRXA02537 | GR00726 | 8961 | 9422 |
| 1213 | naRXN02538 | 1214 | aaRXN02538 | VV0057 | 15078 | 15749 |
| 1215 | F naRXA02538 | 1216 | F aaRXA02538 | GR00726 | 9422 | 10093 |
| 1217 | naRXN02555 | 1218 | aaRXN02555 | VV0101 | 5340 | 4738 |
| 1219 | F naRXA02555 | 1220 | F aaRXA02555 | GR00731 | 1757 | 1155 |
| 1221 | naRXN02564 | 1222 | aaRXN02564 | VV0154 | 10016 | 9015 |
| 1223 | F naRXA02564 | 1224 | F aaRXA02564 | GR00732 | 2543 | 3217 |
| 1225 | naRXN02568 | 1226 | aaRXN02568 | VV0245 | 1657 | 5 |
| 1227 | F naRXA02568 | 1228 | F aaRXA02568 | GR00735 | 1363 | 5 |
| 1229 | naRXN02593 | 1230 | aaRXN02593 | VV0098 | 11073 | 11669 |
| 1231 | F naRXA02593 | 1232 | F aaRXA02593 | GR00741 | 18693 | 18481 |
| 1233 | F naRXA02594 | 1234 | F aaRXA02594 | GR00741 | 19077 | 18754 |
| 1235 | naRXN02606 | 1236 | aaRXN02606 | VV0098 | 34557 | 35927 |
| 1237 | F naRXA02606 | 1238 | F aaRXA02606 | GR00742 | 13514 | 12144 |
| 1239 | naRXN02610 | 1240 | aaRXN02610 | VV0098 | 31620 | 30694 |
| 1241 | F naRXA02610 | 1242 | F aaRXA02610 | GR00742 | 16452 | 17378 |
| 1243 | naRXN02624 | 1244 | aaRXN02624 | VV0129 | 29202 | 30497 |
| 1245 | F naRXA02624 | 1246 | F aaRXA02624 | GR00746 | 5602 | 4889 |
| 1247 | naRXN02626 | 1248 | aaRXN02626 | VV0314 | 2012 | 1008 |
| 1249 | naRXN02656 | 1250 | aaRXN02656 | VV0090 | 15756 | 14917 |
| 1251 | naRXN02673 | 1252 | aaRXN02673 | VV0315 | 14030 | 13398 |
| 1253 | F naRXA02673 | 1254 | F aaRXA02673 | GR00753 | 14030 | 13398 |
| 1255 | naRXN02680 | 1256 | aaRXN02680 | VV0098 | 64917 | 66200 |
| 1257 | F naRXA02680 | 1258 | F aaRXA02680 | GR00754 | 6392 | 5109 |
| 1259 | F naRXA02679 | 1260 | F aaRXA02679 | GR00754 | 5268 | 5693 |
| 1261 | F naRXA02681 | 1262 | F aaRXA02681 | GR00754 | 5751 | 6194 |
| 1263 | naRXN02693 | 1264 | aaRXN02693 | VV0098 | 74100 | 75875 |
| 1265 | F naRXA02693 | 1266 | F aaRXA02693 | GR00755 | 1650 | 4 |
| 1267 | naRXN02696 | 1268 | aaRXN02696 | VV0017 | 7946 | 7491 |
| 1269 | F naRXA02696 | 1270 | F aaRXA02696 | GR00756 | 742 | 287 |
| 1271 | naRXN02697 | 1272 | aaRXN02697 | VV0017 | 31257 | 32783 |
| 1273 | F naRXA02697 | 1274 | F aaRXA02697 | GR00757 | 1 | 699 |
| 1275 | F naRXA02719 | 1276 | F aaRXA02719 | GR00758 | 19598 | 20245 |
| 1277 | naRXN02720 | 1278 | aaRXN02720 | VV0017 | 8727 | 8026 |
| 1279 | F naRXA02720 | 1280 | F aaRXA02720 | GR00759 | 631 | 5 |
| 1281 | naRXN02744 | 1282 | aaRXN02744 | VV0074 | 893 | 1696 |
| 1283 | F naRXA02744 | 1284 | F aaRXA02744 | GR00763 | 14460 | 13657 |
| 1285 | naRXN02770 | 1286 | aaRXN02770 | VV0171 | 4202 | 2637 |
| 1287 | F naRXA02770 | 1288 | F aaRXA02770 | GR00772 | 3 | 1322 |
| 1289 | naRXN02781 | 1290 | aaRXN02781 | VV0084 | 14566 | 13376 |
| 1291 | F naRXA02781 | 1292 | F aaRXA02781 | GR00774 | 1345 | 155 |
| 1293 | naRXN02782 | 1294 | aaRXN02782 | VV0093 | 7148 | 8446 |
| 1295 | F naRXA02782 | 1296 | F aaRXA02782 | GR00775 | 204 | 875 |
| 1297 | naRXN02812 | 1298 | aaRXN02812 | VV0210 | 342 | 4 |
| 1299 | F naRXA02812 | 1300 | F aaRXA02812 | GR00793 | 2 | 568 |
| 1301 | naRXN02817 | 1302 | aaRXN02817 | VV0346 | 403 | 5 |
| 1303 | F naRXA02817 | 1304 | F aaRXA02817 | GR00798 | 403 | 5 |
| 1305 | naRXN02818 | 1306 | aaRXN02818 | VV0347 | 611 | 6 |
| 1307 | F naRXA02818 | 1308 | F aaRXA02818 | GR00799 | 611 | 6 |
| 1309 | naRXN02825 | 1310 | aaRXN02825 | VV0082 | 3589 | 1751 |
| 1311 | F naRXA01322 | 1312 | F aaRXA01322 | GR00385 | 443 | 6 |
| 1313 | F naRXA02824 | 1314 | F aaRXA02824 | GR00805 | 531 | 4 |
| 1315 | F naRXA02825 | 1316 | F aaRXA02825 | GR00806 | 565 | 182 |
| 1317 | naRXN02838 | 1318 | aaRXN02838 | VV0161 | 1 | |
| 1319 | F naRXA02838 | 1320 | F aaRXA02838 | GR00831 | 1 | 462 |
| 1321 | naRXN02840 | 1322 | aaRXN02840 | VV0365 | 488 | 339 |
| 1323 | F naRXA02840 | 1324 | F aaRXA02840 | GR00835 | 488 | 339 |
| 1325 | naRXN02841 | 1326 | aaRXN02841 | VV0055 | 11788 | 12222 |
| 1327 | F naRXA02841 | 1328 | F aaRXA02841 | GR00840 | 283 | 5 |
| 1329 | naRXN02846 | 1330 | aaRXN02846 | VV0127 | 30861 | 30112 |
| 1331 | F naRXA02846 | 1332 | F aaRXA02846 | GR00845 | 578 | 6 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 1333 | naRXN02847 | 1334 | aaRXN02847 | VV0113 | 47 | 1135 |
| 1335 | F naRXA02847 | 1336 | F aaRXA02847 | GR00847 | 598 | 5 |
| 1337 | naRXN02849 | 1338 | aaRXN02849 | VV0237 | 2 | |
| 1339 | F naRXA02849 | 1340 | F aaRXA02849 | GR00849 | 2 | 283 |
| 1341 | naRXN02911 | 1342 | aaRXN02911 | VV0135 | 24643 | 25101 |
| 1343 | naRXN02914 | 1344 | aaRXN02914 | VV0127 | 17305 | 16763 |
| 1345 | naRXN02921 | 1346 | aaRXN02921 | VV0213 | 1871 | 1401 |
| 1347 | naRXN02924 | 1348 | aaRXN02924 | VV0088 | 4557 | 5105 |
| 1349 | naRXN02927 | 1350 | aaRXN02927 | VV0082 | 18836 | 19303 |
| 1351 | naRXN02928 | 1352 | aaRXN02928 | VV0082 | 19511 | 20203 |
| 1353 | naRXN02931 | 1354 | aaRXN02931 | VV0090 | 25420 | 25644 |
| 1355 | naRXN02932 | 1356 | aaRXN02932 | VV0176 | 23391 | 24362 |
| 1357 | naRXN02934 | 1358 | aaRXN02934 | VV0103 | 14533 | 14838 |
| 1359 | naRXN02936 | 1360 | aaRXN02936 | VV0197 | 24360 | 24557 |
| 1361 | naRXN02939 | 1362 | aaRXN02939 | VV0008 | 33988 | 32387 |
| 1363 | F naRXA01383 | 1364 | F aaRXA01383 | GR00406 | 1147 | 5 |
| 1365 | naRXN02950 | 1366 | aaRXN02950 | VV0224 | 7629 | 7306 |
| 1367 | naRXN02951 | 1368 | aaRXN02951 | VV0176 | 5739 | 5131 |
| 1369 | naRXN02957 | 1370 | aaRXN02957 | VV0020 | 30448 | 30158 |
| 1371 | naRXN02967 | 1372 | aaRXN02967 | VV0318 | 6614 | 6931 |
| 1373 | naRXN02971 | 1374 | aaRXN02971 | VV0210 | 951 | 640 |
| 1375 | naRXN02978 | 1376 | aaRXN02978 | VV0010 | 2191 | 683 |
| 1377 | naRXN02995 | 1378 | aaRXN02995 | VV0069 | 348 | 1913 |
| 1379 | naRXN02997 | 1380 | aaRXN02997 | VV0069 | 3709 | 2981 |
| 1381 | naRXN03001 | 1382 | aaRXN03001 | VV0170 | 422 | 874 |
| 1383 | naRXN03005 | 1384 | aaRXN03005 | VV0237 | 1101 | 334 |
| 1385 | naRXN03009 | 1386 | aaRXN03009 | VV0238 | 353 | 6 |
| 1387 | naRXN03010 | 1388 | aaRXN03010 | VV0238 | 7435 | 7199 |
| 1389 | naRXN03011 | 1390 | aaRXN03011 | VV0098 | 2984 | 3184 |
| 1391 | naRXN03012 | 1392 | aaRXN03012 | VV0241 | 2 | 571 |
| 1393 | naRXN03017 | 1394 | aaRXN03017 | VV0218 | 5720 | 7258 |
| 1395 | F naRXA02753 | 1396 | F aaRXA02753 | GR00765 | 2630 | 138 |
| 1397 | naRXN03018 | 1398 | aaRXN03018 | VV0218 | 7221 | 8213 |
| 1399 | naRXN03024 | 1400 | aaRXN03024 | VV0003 | 6315 | 7730 |
| 1401 | naRXN03025 | 1402 | aaRXN03025 | VV0003 | 8668 | 7796 |
| 1403 | naRXN03027 | 1404 | aaRXN03027 | VV0008 | 17 | 151 |
| 1405 | naRXN03029 | 1406 | aaRXN03029 | VV0009 | 95 | 607 |
| 1407 | naRXN03031 | 1408 | aaRXN03031 | VV0011 | 1 | 789 |
| 1409 | naRXN03032 | 1410 | aaRXN03032 | VV0012 | 3652 | 3936 |
| 1411 | naRXN03034 | 1412 | aaRXN03034 | VV0013 | 2 | 661 |
| 1413 | F naRXA00063 | 1414 | F aaRXA00063 | GR0010 | 1658 | 1374 |
| 1415 | naRXN03037 | 1416 | aaRXN03037 | VV0015 | 5364 | 5549 |
| 1417 | naRXN03041 | 1418 | aaRXN03041 | VV0018 | 1770 | 1273 |
| 1419 | F naRXA02892 | 1420 | F aaRXA02892 | GR10035 | 1171 | 668 |
| 1421 | naRXN03045 | 1422 | aaRXN03045 | VV0019 | 33044 | 34039 |
| 1423 | naRXN03046 | 1424 | aaRXN03046 | VV0020 | 1 | 336 |
| 1425 | naRXN03047 | 1426 | aaRXN03047 | VV0020 | 25070 | 26485 |
| 1427 | F naRXA00036 | 1428 | F aaRXA00036 | GR00004 | 7204 | 8619 |
| 1429 | naRXN03048 | 1430 | aaRXN03048 | VV0020 | 27423 | 26551 |
| 1431 | F naRXA00037 | 1432 | F aaRXA00037 | GR00004 | 9557 | 8685 |
| 1433 | naRXN03050 | 1434 | aaRXN03050 | VV0021 | 6368 | 7333 |
| 1435 | naRXN03053 | 1436 | aaRXN03053 | VV0026 | 12 | 1535 |
| 1437 | F naRXA02885 | 1438 | F aaRXA02885 | GR10021 | 1 | 1536 |
| 1439 | naRXN03055 | 1440 | aaRXN03055 | VV0026 | 3519 | 3947 |
| 1441 | F naRXA00261 | 1442 | F aaRXA00261 | GR00039 | 11693 | 11265 |
| 1443 | F naRXA02888 | 1444 | F aaRXA02888 | GR10024 | 326 | 754 |
| 1445 | naRXN03059 | 1446 | aaRXN03059 | VV0030 | 5373 | 4894 |
| 1447 | F naRXA02899 | 1448 | F aaRXA02899 | GR10040 | 2125 | 1646 |
| 1449 | naRXN03062 | 1450 | aaRXN03062 | VV0035 | 525 | 4 |
| 1451 | naRXN03066 | 1452 | aaRXN03066 | VV0038 | 7298 | 6636 |
| 1453 | F naRXA02876 | 1454 | F aaRXA02876 | GR10016 | 405 | 1067 |
| 1455 | naRXN03067 | 1456 | aaRXN03067 | VV0038 | 7493 | 7323 |
| 1457 | naRXN03068 | 1458 | aaRXN03068 | VV0038 | 7648 | 7529 |
| 1459 | naRXN03073 | 1460 | aaRXN03073 | VV0042 | 1573 | 944 |
| 1461 | F naRXA02905 | 1462 | F aaRXA02905 | GR10044 | 477 | 4 |
| 1463 | naRXN03085 | 1464 | aaRXN03085 | VV0048 | 4511 | 4161 |
| 1465 | naRXN03089 | 1466 | aaRXN03089 | VV0053 | 1183 | 26 |
| 1467 | F naRXA00071 | 1468 | F aaRXA00071 | GR00011 | 4013 | 5464 |
| 1469 | naRXN03098 | 1470 | aaRXN03098 | VV0064 | 2100 | 2723 |
| 1471 | naRXN03099 | 1472 | aaRXN03099 | VV0064 | 5576 | 6250 |
| 1473 | naRXN03104 | 1474 | aaRXN03104 | VV0071 | 401 | 577 |
| 1475 | naRXN03106 | 1476 | aaRXN03106 | VV0074 | 15930 | 16121 |
| 1477 | naRXN03107 | 1478 | aaRXN03107 | VV0076 | 232 | 432 |
| 1479 | naRXN03113 | 1480 | aaRXN03113 | VV0086 | 6541 | 8139 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 1481 | F naRXA00506 | 1482 | F aaRXA00506 | GR00126 | 489 | 1829 |
| 1483 | naRXN03115 | 1484 | aaRXN03115 | VV0089 | 148 | 546 |
| 1485 | naRXN03122 | 1486 | aaRXN03122 | VV0104 | 3329 | 3475 |
| 1487 | naRXN03134 | 1488 | aaRXN03134 | VV0127 | 65312 | 65662 |
| 1489 | naRXN03135 | 1490 | aaRXN03135 | VV0127 | 66674 | 67402 |
| 1491 | F naRXA02285 | 1492 | F aaRXA02285 | GR00660 | 1544 | 2272 |
| 1493 | naRXN03138 | 1494 | aaRXN03138 | VV0129 | 21194 | 21664 |
| 1495 | naRXN03140 | 1496 | aaRXN03140 | VV0131 | 4550 | 4302 |
| 1497 | naRXN03141 | 1498 | aaRXN03141 | VV0135 | 31144 | 31473 |
| 1499 | naRXN03146 | 1500 | aaRXN03146 | VV0143 | 25998 | 26468 |
| 1501 | naRXN03147 | 1502 | aaRXN03147 | VV0144 | 2726 | 2977 |
| 1503 | naRXN03149 | 1504 | aaRXN03149 | VV0146 | 969 | 1235 |
| 1505 | naRXN03152 | 1506 | aaRXN03152 | VV0166 | 264 | 536 |
| 1507 | naRXN03153 | 1508 | aaRXN03153 | VV0176 | 46481 | 47044 |
| 1509 | naRXN03154 | 1510 | aaRXN03154 | VV0179 | 1328 | 2239 |
| 1511 | naRXN03156 | 1512 | aaRXN03156 | VV0187 | 4908 | 5087 |
| 1513 | F naRXA00176 | 1514 | F aaRXA00176 | GR00027 | 3475 | 3317 |
| 1515 | naRXN03162 | 1516 | aaRXN03162 | VV0195 | 909 | 1304 |
| 1517 | naRXN03167 | 1518 | aaRXN03167 | VV0327 | 633 | 4 |
| 1519 | F naRXA02862 | 1520 | F aaRXA02862 | GR10006 | 1695 | 2330 |
| 1521 | naRXN03170 | 1522 | aaRXN03170 | VV0328 | 457 | 209 |
| 1523 | F naRXA02856 | 1524 | F aaRXA02856 | GR10003 | 459 | 211 |
| 1525 | naRXN03172 | 1526 | aaRXN03172 | VV0329 | 1392 | 367 |
| 1527 | F naRXA02858 | 1528 | F aaRXA02858 | GR10004 | 1392 | 367 |
| 1529 | naRXN03173 | 1530 | aaRXN03173 | VV0330 | 1340 | 243 |
| 1531 | F naRXA02874 | 1532 | F aaRXA02874 | GR10015 | 1348 | 869 |
| 1533 | naRXN03174 | 1534 | aaRXN03174 | VV0331 | 461 | 6 |
| 1535 | F naRXA02884 | 1536 | F aaRXA02884 | GR10020 | 1695 | 2156 |
| 1537 | naRXN03177 | 1538 | aaRXN03177 | VV0333 | 816 | 151 |
| 1539 | F naRXA02881 | 1540 | F aaRXA02881 | GR10019 | 94 | 759 |
| 1541 | naRXN03182 | 1542 | aaRXN03182 | VV0339 | 276 | 4 |
| 1543 | naRXN03184 | 1544 | aaRXN03184 | VV0374 | 517 | 20 |
| 1545 | naRXN03185 | 1546 | aaRXN03185 | VV0375 | 311 | 123 |
| 1547 | naRXA00003 | 1548 | aaRXA00003 | GR00001 | 2279 | 3019 |
| 1549 | naRXA00008 | 1550 | aaRXA00008 | GR00002 | 606 | 115 |
| 1551 | naRXA00015 | 1552 | aaRXA00015 | GR00002 | 5999 | 6307 |
| 1553 | naRXA00018 | 1554 | aaRXA00018 | GR00002 | 12979 | 14277 |
| 1555 | naRXA00020 | 1556 | aaRXA00020 | GR00002 | 17142 | 16363 |
| 1557 | naRXA00021 | 1558 | aaRXA00021 | GR00002 | 18766 | 20538 |
| 1559 | naRXA00025 | 1560 | aaRXA00025 | GR00003 | 2211 | 3647 |
| 1561 | naRXA00031 | 1562 | aaRXA00031 | GR00003 | 10383 | 9982 |
| 1563 | naRXA00049 | 1564 | aaRXA00049 | GR00008 | 2270 | 2956 |
| 1565 | naRXA00052 | 1566 | aaRXA00052 | GR00008 | 7957 | 7247 |
| 1567 | naRXA00054 | 1568 | aaRXA00054 | GR00008 | 8557 | 11469 |
| 1569 | naRXA00058 | 1570 | aaRXA00058 | GR00009 | 7394 | 6831 |
| 1571 | naRXA00059 | 1572 | aaRXA00059 | GR00009 | 8301 | 8020 |
| 1573 | naRXA00065 | 1574 | aaRXA00065 | GR00010 | 4140 | 4412 |
| 1575 | naRXA00068 | 1576 | aaRXA00068 | GR00011 | 1305 | 724 |
| 1577 | naRXA00079 | 1578 | aaRXA00079 | GR00012 | 6599 | 6820 |
| 1579 | naRXA00082 | 1580 | aaRXA00082 | GR00012 | 9019 | 8456 |
| 1581 | naRXA00083 | 1582 | aaRXA00083 | GR00013 | 771 | 1070 |
| 1583 | naRXA00093 | 1584 | aaRXA00093 | GR00014 | 204 | 2426 |
| 1585 | naRXA00101 | 1586 | aaRXA00101 | GR00014 | 10514 | 10107 |
| 1587 | naRXA00108 | 1588 | aaRXA00108 | GR00015 | 546 | 4 |
| 1589 | naRXA00110 | 1590 | aaRXA00110 | GR00016 | 364 | 912 |
| 1591 | naRXA00117 | 1592 | aaRXA00117 | GR00019 | 791 | 201 |
| 1593 | naRXA00118 | 1594 | aaRXA00118 | GR00019 | 918 | 1172 |
| 1595 | naRXA00119 | 1596 | aaRXA00119 | GR00019 | 1704 | 2462 |
| 1597 | naRXA00121 | 1598 | aaRXA00121 | GR00019 | 3473 | 4183 |
| 1599 | naRXA00122 | 1600 | aaRXA00122 | GR00019 | 4220 | 5842 |
| 1601 | naRXA00127 | 1602 | aaRXA00127 | GR00020 | 2871 | 2416 |
| 1603 | naRXA00134 | 1604 | aaRXA00134 | GR00021 | 1648 | 1079 |
| 1605 | naRXA00140 | 1606 | aaRXA00140 | GR00022 | 3841 | 3656 |
| 1607 | naRXA00141 | 1608 | aaRXA00141 | GR00022 | 4307 | 3846 |
| 1609 | naRXA00142 | 1610 | aaRXA00142 | GR00022 | 4776 | 4300 |
| 1611 | naRXA00150 | 1612 | aaRXA00150 | GR00023 | 4085 | 4858 |
| 1613 | naRXA00151 | 1614 | aaRXA00151 | GR00023 | 4956 | 5552 |
| 1615 | naRXA00153 | 1616 | aaRXA00153 | GR00023 | 7656 | 7231 |
| 1617 | naRXA00155 | 1618 | aaRXA00155 | GR00023 | 8615 | 9397 |
| 1619 | naRXA00159 | 1620 | aaRXA00159 | GR00024 | 3868 | 2687 |
| 1621 | naRXA00161 | 1622 | aaRXA00161 | GR00024 | 4893 | 5354 |
| 1623 | naRXA00169 | 1624 | aaRXA00169 | GR00026 | 5222 | 3150 |
| 1625 | naRXA00170 | 1626 | aaRXA00170 | GR00026 | 9914 | 8061 |
| 1627 | naRXA00173 | 1628 | aaRXA00173 | GR00027 | 1716 | 1384 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 1629 | naRXA00174 | 1630 | aaRXA00174 | GR00027 | 2079 | 1795 |
| 1631 | naRXA00175 | 1632 | aaRXA00175 | GR00027 | 2732 | 2103 |
| 1633 | naRXA00179 | 1634 | aaRXA00179 | GR00028 | 1714 | 1256 |
| 1635 | naRXA00180 | 1636 | aaRXA00180 | GR00028 | 2334 | 1795 |
| 1637 | naRXA00183 | 1638 | aaRXA00183 | GR00028 | 7344 | 8195 |
| 1639 | naRXA00185 | 1640 | aaRXA00185 | GR00028 | 9418 | 12045 |
| 1641 | naRXA00199 | 1642 | aaRXA00199 | GR00031 | 2172 | 754 |
| 1643 | naRXA00200 | 1644 | aaRXA00200 | GR00031 | 2837 | 2535 |
| 1645 | naRXA00207 | 1646 | aaRXA00207 | GR00032 | 6430 | 6747 |
| 1647 | naRXA00211 | 1648 | aaRXA00211 | GR00032 | 10120 | 10782 |
| 1649 | naRXA00218 | 1650 | aaRXA00218 | GR00032 | 18104 | 19243 |
| 1651 | naRXA00220 | 1652 | aaRXA00220 | GR00032 | 20666 | 20163 |
| 1653 | naRXA00230 | 1654 | aaRXA00230 | GR00034 | 746 | 27 |
| 1655 | naRXA00233 | 1656 | aaRXA00233 | GR00036 | 420 | 4 |
| 1657 | naRXA00234 | 1658 | aaRXA00234 | GR00036 | 998 | 459 |
| 1659 | naRXA00237 | 1660 | aaRXA00237 | GR00036 | 3668 | 4045 |
| 1661 | naRXA00238 | 1662 | aaRXA00238 | GR00036 | 4186 | 4554 |
| 1663 | naRXA00239 | 1664 | aaRXA00239 | GR00036 | 5118 | 4534 |
| 1665 | naRXA00240 | 1666 | aaRXA00240 | GR00036 | 5342 | 5133 |
| 1667 | naRXA00244 | 1668 | aaRXA00244 | GR00037 | 1565 | 930 |
| 1669 | naRXA00245 | 1670 | aaRXA00245 | GR00037 | 3049 | 1565 |
| 1671 | naRXA00248 | 1672 | aaRXA00248 | GR00037 | 7843 | 7121 |
| 1673 | naRXA00250 | 1674 | aaRXA00250 | GR00038 | 6 | 221 |
| 1675 | naRXA00252 | 1676 | aaRXA00252 | GR00038 | 485 | 727 |
| 1677 | naRXA00257 | 1678 | aaRXA00257 | GR00039 | 1760 | 2215 |
| 1679 | naRXA00258 | 1680 | aaRXA00258 | GR00039 | 3219 | 3890 |
| 1681 | naRXA00260 | 1682 | aaRXA00260 | GR00039 | 9234 | 10409 |
| 1683 | naRXA00273 | 1684 | aaRXA00273 | GR00042 | 185 | 1297 |
| 1685 | naRXA00274 | 1686 | aaRXA00274 | GR00042 | 1556 | 4165 |
| 1687 | naRXA00275 | 1688 | aaRXA00275 | GR00042 | 4696 | 4238 |
| 1689 | naRXA00276 | 1690 | aaRXA00276 | GR00042 | 5016 | 4675 |
| 1691 | naRXA00279 | 1692 | aaRXA00279 | GR00043 | 4001 | 2616 |
| 1693 | naRXA00282 | 1694 | aaRXA00282 | GR00044 | 793 | 5 |
| 1695 | naRXA00285 | 1696 | aaRXA00285 | GR00046 | 3 | 515 |
| 1697 | naRXA00286 | 1698 | aaRXA00286 | GR00046 | 579 | 1142 |
| 1699 | naRXA00294 | 1700 | aaRXA00294 | GR00047 | 2761 | 3189 |
| 1701 | naRXA00297 | 1702 | aaRXA00297 | GR00048 | 2861 | 3772 |
| 1703 | naRXA00320 | 1704 | aaRXA00320 | GR00057 | 358 | 537 |
| 1705 | naRXA00321 | 1706 | aaRXA00321 | GR00057 | 2411 | 597 |
| 1707 | naRXA00322 | 1708 | aaRXA00322 | GR00057 | 3658 | 2555 |
| 1709 | naRXA00325 | 1710 | aaRXA00325 | GR00057 | 8594 | 9238 |
| 1711 | naRXA00326 | 1712 | aaRXA00326 | GR00057 | 9378 | 9857 |
| 1713 | naRXA00336 | 1714 | aaRXA00336 | GR00057 | 19461 | 19931 |
| 1715 | naRXA00337 | 1716 | aaRXA00337 | GR00058 | 530 | 6 |
| 1717 | naRXA00339 | 1718 | aaRXA00339 | GR00059 | 817 | 1533 |
| 1719 | naRXA00349 | 1720 | aaRXA00349 | GR00066 | 3 | 1061 |
| 1721 | naRXA00355 | 1722 | aaRXA00355 | GR00069 | 635 | 510 |
| 1723 | naRXA00375 | 1724 | aaRXA00375 | GR00080 | 549 | 49 |
| 1725 | naRXA00380 | 1726 | aaRXA00380 | GR00082 | 836 | 216 |
| 1727 | naRXA00387 | 1728 | aaRXA00387 | GR00084 | 1403 | 591 |
| 1729 | naRXA00392 | 1730 | aaRXA00392 | GR00086 | 3890 | 3027 |
| 1731 | naRXA00394 | 1732 | aaRXA00394 | GR00086 | 5322 | 4990 |
| 1733 | naRXA00395 | 1734 | aaRXA00395 | GR00086 | 5417 | 5716 |
| 1735 | naRXA00396 | 1736 | aaRXA00396 | GR00086 | 6653 | 6183 |
| 1737 | naRXA00397 | 1738 | aaRXA00397 | GR00086 | 7206 | 6667 |
| 1739 | naRXA00398 | 1740 | aaRXA00398 | GR00087 | 1 | 681 |
| 1741 | naRXA00408 | 1742 | aaRXA00408 | GR00091 | 642 | 1088 |
| 1743 | naRXA00409 | 1744 | aaRXA00409 | GR00091 | 1088 | 2500 |
| 1745 | naRXA00411 | 1746 | aaRXA00411 | GR00092 | 1685 | 1011 |
| 1747 | naRXA00423 | 1748 | aaRXA00423 | GR00097 | 909 | 457 |
| 1749 | naRXA00424 | 1750 | aaRXA00424 | GR00097 | 1379 | 909 |
| 1751 | naRXA00425 | 1752 | aaRXA00425 | GR00097 | 1433 | 1657 |
| 1753 | naRXA00428 | 1754 | aaRXA00428 | GR00098 | 2657 | 2025 |
| 1755 | naRXA00429 | 1756 | aaRXA00429 | GR00098 | 3063 | 2662 |
| 1757 | naRXA00430 | 1758 | aaRXA00430 | GR00098 | 3473 | 3063 |
| 1759 | naRXA00433 | 1760 | aaRXA00433 | GR00100 | 1446 | 1970 |
| 1761 | naRXA00451 | 1762 | aaRXA00451 | GR00110 | 816 | 325 |
| 1763 | naRXA00457 | 1764 | aaRXA00457 | GR00114 | 1451 | 372 |
| 1765 | naRXA00462 | 1766 | aaRXA00462 | GR00116 | 3023 | 1644 |
| 1767 | naRXA00463 | 1768 | aaRXA00463 | GR00116 | 4209 | 3388 |
| 1769 | naRXA00468 | 1770 | aaRXA00468 | GR00118 | 1282 | 464 |
| 1771 | naRXA00469 | 1772 | aaRXA00469 | GR00119 | 1647 | 472 |
| 1773 | naRXA00472 | 1774 | aaRXA00472 | GR00119 | 5449 | 4589 |
| 1775 | naRXA00474 | 1776 | aaRXA00474 | GR00119 | 6575 | 8152 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 1777 | naRXA00475 | 1778 | aaRXA00475 | GR00119 | 8822 | 8163 |
| 1779 | naRXA00476 | 1780 | aaRXA00476 | GR00119 | 8961 | 9821 |
| 1781 | naRXA00481 | 1782 | aaRXA00481 | GR00119 | 17636 | 18220 |
| 1783 | naRXA00486 | 1784 | aaRXA00486 | GR00120 | 1 | 702 |
| 1785 | naRXA00490 | 1786 | aaRXA00490 | GR00121 | 2676 | 1774 |
| 1787 | naRXA00491 | 1788 | aaRXA00491 | GR00122 | 1057 | 638 |
| 1789 | naRXA00493 | 1790 | aaRXA00493 | GR00123 | 3 | 326 |
| 1791 | naRXA00519 | 1792 | aaRXA00519 | GR00132 | 4 | 516 |
| 1793 | naRXA00528 | 1794 | aaRXA00528 | GR00136 | 3562 | 4650 |
| 1795 | naRXA00529 | 1796 | aaRXA00529 | GR00136 | 5274 | 4732 |
| 1797 | naRXA00530 | 1798 | aaRXA00530 | GR00136 | 6837 | 5557 |
| 1799 | naRXA00535 | 1800 | aaRXA00535 | GR00137 | 5155 | 5871 |
| 1801 | naRXA00540 | 1802 | aaRXA00540 | GR00139 | 2027 | 2269 |
| 1803 | naRXA00549 | 1804 | aaRXA00549 | GR00143 | 502 | 897 |
| 1805 | naRXA00550 | 1806 | aaRXA00550 | GR00143 | 935 | 1255 |
| 1807 | naRXA00553 | 1808 | aaRXA00553 | GR00145 | 742 | 1062 |
| 1809 | naRXA00554 | 1810 | aaRXA00554 | GR00145 | 1606 | 1136 |
| 1811 | naRXA00563 | 1812 | aaRXA00563 | GR00151 | 1 | 2739 |
| 1813 | naRXA00564 | 1814 | aaRXA00564 | GR00151 | 3744 | 4148 |
| 1815 | naRXA00573 | 1816 | aaRXA00573 | GR00156 | 117 | 767 |
| 1817 | naRXA00576 | 1818 | aaRXA00576 | GR00156 | 2916 | 2245 |
| 1819 | naRXA00577 | 1820 | aaRXA00577 | GR00156 | 2980 | 3327 |
| 1821 | naRXA00578 | 1822 | aaRXA00578 | GR00156 | 4087 | 3365 |
| 1823 | naRXA00582 | 1824 | aaRXA00582 | GR00156 | 9442 | 8924 |
| 1825 | naRXA00585 | 1826 | aaRXA00585 | GR00156 | 11894 | 11577 |
| 1827 | naRXA00586 | 1828 | aaRXA00586 | GR00156 | 12818 | 11937 |
| 1829 | naRXA00587 | 1830 | aaRXA00587 | GR00156 | 13008 | 13490 |
| 1831 | naRXA00595 | 1832 | aaRXA00595 | GR00159 | 3 | 332 |
| 1833 | naRXA00597 | 1834 | aaRXA00597 | GR00159 | 797 | 1066 |
| 1835 | naRXA00598 | 1836 | aaRXA00598 | GR00159 | 1070 | 1387 |
| 1837 | naRXA00601 | 1838 | aaRXA00601 | GR00159 | 3459 | 3749 |
| 1839 | naRXA00602 | 1840 | aaRXA00602 | GR00159 | 4907 | 4155 |
| 1841 | naRXA00604 | 1842 | aaRXA00604 | GR00159 | 5489 | 5779 |
| 1843 | naRXA00610 | 1844 | aaRXA00610 | GR00161 | 1193 | 2056 |
| 1845 | naRXA00611 | 1846 | aaRXA00611 | GR00161 | 3640 | 2165 |
| 1847 | naRXA00613 | 1848 | aaRXA00613 | GR00162 | 1652 | 1200 |
| 1849 | naRXA00614 | 1850 | aaRXA00614 | GR00162 | 1680 | 2594 |
| 1851 | naRXA00617 | 1852 | aaRXA00617 | GR00162 | 4002 | 5084 |
| 1853 | naRXA00628 | 1854 | aaRXA00628 | GR00165 | 1284 | 877 |
| 1855 | naRXA00631 | 1856 | aaRXA00631 | GR00166 | 172 | 1626 |
| 1857 | naRXA00637 | 1858 | aaRXA00637 | GR00167 | 2002 | 2754 |
| 1859 | naRXA00646 | 1860 | aaRXA00646 | GR00169 | 446 | 6 |
| 1861 | naRXA00649 | 1862 | aaRXA00649 | GR00169 | 2823 | 3278 |
| 1863 | naRXA00652 | 1864 | aaRXA00652 | GR00169 | 5449 | 5997 |
| 1865 | naRXA00654 | 1866 | aaRXA00654 | GR00169 | 7213 | 8478 |
| 1867 | naRXA00656 | 1868 | aaRXA00656 | GR00169 | 9495 | 9235 |
| 1869 | naRXA00657 | 1870 | aaRXA00657 | GR00169 | 10882 | 9980 |
| 1871 | naRXA00661 | 1872 | aaRXA00661 | GR00172 | 664 | 1353 |
| 1873 | naRXA00667 | 1874 | aaRXA00667 | GR00175 | 593 | 1177 |
| 1875 | naRXA00676 | 1876 | aaRXA00676 | GR00178 | 647 | 1393 |
| 1877 | naRXA00678 | 1878 | aaRXA00678 | GR00179 | 1037 | 303 |
| 1879 | naRXA00691 | 1880 | aaRXA00691 | GR00181 | 2152 | 1223 |
| 1881 | naRXA00692 | 1882 | aaRXA00692 | GR00181 | 3450 | 2317 |
| 1883 | naRXA00693 | 1884 | aaRXA00693 | GR00181 | 4303 | 3821 |
| 1885 | naRXA00701 | 1886 | aaRXA00701 | GR00182 | 427 | 801 |
| 1887 | naRXA00707 | 1888 | aaRXA00707 | GR00185 | 377 | 1348 |
| 1889 | naRXA00713 | 1890 | aaRXA00713 | GR00188 | 71 | 1033 |
| 1891 | naRXA00714 | 1892 | aaRXA00714 | GR00188 | 1809 | 1249 |
| 1893 | naRXA00716 | 1894 | aaRXA00716 | GR00188 | 3002 | 3514 |
| 1895 | naRXA00719 | 1896 | aaRXA00719 | GR00188 | 5283 | 6911 |
| 1897 | naRXA00724 | 1898 | aaRXA00724 | GR00191 | 811 | 164 |
| 1899 | naRXA00726 | 1900 | aaRXA00726 | GR00192 | 841 | 701 |
| 1901 | naRXA00740 | 1902 | aaRXA00740 | GR00202 | 1646 | 1068 |
| 1903 | naRXA00741 | 1904 | aaRXA00741 | GR00202 | 2986 | 2054 |
| 1905 | naRXA00742 | 1906 | aaRXA00742 | GR00202 | 5517 | 3868 |
| 1907 | naRXA00743 | 1908 | aaRXA00743 | GR00202 | 6652 | 6230 |
| 1909 | naRXA00745 | 1910 | aaRXA00745 | GR00202 | 13874 | 13341 |
| 1911 | naRXA00746 | 1912 | aaRXA00746 | GR00202 | 13755 | 14945 |
| 1913 | naRXA00747 | 1914 | aaRXA00747 | GR00202 | 15067 | 15654 |
| 1915 | naRXA00748 | 1916 | aaRXA00748 | GR00202 | 15917 | 16360 |
| 1917 | naRXA00749 | 1918 | aaRXA00749 | GR00202 | 17240 | 16542 |
| 1919 | naRXA00751 | 1920 | aaRXA00751 | GR00202 | 20245 | 19418 |
| 1921 | naRXA00752 | 1922 | aaRXA00752 | GR00202 | 21847 | 21419 |
| 1923 | naRXA00757 | 1924 | aaRXA00757 | GR00203 | 3119 | 4372 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 1925 | naRXA00763 | 1926 | aaRXA00763 | GR00204 | 1384 | 2166 |
| 1927 | naRXA00765 | 1928 | aaRXA00765 | GR00204 | 3283 | 3969 |
| 1929 | naRXA00781 | 1930 | aaRXA00781 | GR00206 | 2682 | 2395 |
| 1931 | naRXA00788 | 1932 | aaRXA00788 | GR00209 | 910 | 686 |
| 1933 | naRXA00804 | 1934 | aaRXA00804 | GR00215 | 438 | 881 |
| 1935 | naRXA00805 | 1936 | aaRXA00805 | GR00215 | 2057 | 2938 |
| 1937 | naRXA00808 | 1938 | aaRXA00808 | GR00217 | 1029 | 352 |
| 1939 | naRXA00812 | 1940 | aaRXA00812 | GR00219 | 287 | 1345 |
| 1941 | naRXA00814 | 1942 | aaRXA00814 | GR00219 | 2463 | 3236 |
| 1943 | naRXA00815 | 1944 | aaRXA00815 | GR00219 | 3236 | 3808 |
| 1945 | naRXA00816 | 1946 | aaRXA00816 | GR00219 | 4382 | 4678 |
| 1947 | naRXA00826 | 1948 | aaRXA00826 | GR00223 | 567 | 37 |
| 1949 | naRXA00830 | 1950 | aaRXA00830 | GR00224 | 266 | 988 |
| 1951 | naRXA00853 | 1952 | aaRXA00853 | GR00231 | 3775 | 3173 |
| 1953 | naRXA00861 | 1954 | aaRXA00861 | GR00235 | 6 | 431 |
| 1955 | naRXA00862 | 1956 | aaRXA00862 | GR00236 | 580 | 17 |
| 1957 | naRXA00874 | 1958 | aaRXA00874 | GR00241 | 758 | 1846 |
| 1959 | naRXA00876 | 1960 | aaRXA00876 | GR00241 | 4208 | 2454 |
| 1961 | naRXA00881 | 1962 | aaRXA00881 | GR00242 | 8057 | 8434 |
| 1963 | naRXA00882 | 1964 | aaRXA00882 | GR00242 | 8788 | 9465 |
| 1965 | naRXA00883 | 1966 | aaRXA00883 | GR00242 | 10060 | 9542 |
| 1967 | naRXA00887 | 1968 | aaRXA00887 | GR00242 | 13544 | 14266 |
| 1969 | naRXA00889 | 1970 | aaRXA00889 | GR00242 | 15341 | 15928 |
| 1971 | naRXA00893 | 1972 | aaRXA00893 | GR00244 | 789 | 193 |
| 1973 | naRXA00895 | 1974 | aaRXA00895 | GR00244 | 2578 | 1988 |
| 1975 | naRXA00904 | 1976 | aaRXA00904 | GR00246 | 1457 | 702 |
| 1977 | naRXA00908 | 1978 | aaRXA00908 | GR00247 | 1611 | 2168 |
| 1979 | naRXA00916 | 1980 | aaRXA00916 | GR00251 | 4108 | 518 |
| 1981 | naRXA00926 | 1982 | aaRXA00926 | GR00253 | 466 | 104 |
| 1983 | naRXA00930 | 1984 | aaRXA00930 | GR00253 | 3841 | 3089 |
| 1985 | naRXA00932 | 1986 | aaRXA00932 | GR00253 | 5068 | 5541 |
| 1987 | naRXA00933 | 1988 | aaRXA00933 | GR00253 | 6047 | 5586 |
| 1989 | naRXA00940 | 1990 | aaRXA00940 | GR00257 | 129 | 524 |
| 1991 | naRXA00949 | 1992 | aaRXA00949 | GR00259 | 5400 | 6047 |
| 1993 | naRXA00969 | 1994 | aaRXA00969 | GR00273 | 1 | 147 |
| 1995 | naRXA00973 | 1996 | aaRXA00973 | GR00274 | 2272 | 1670 |
| 1997 | naRXA00978 | 1998 | aaRXA00978 | GR00276 | 217 | 831 |
| 1999 | naRXA00986 | 2000 | aaRXA00986 | GR00280 | 60 | 401 |
| 2001 | naRXA00987 | 2002 | aaRXA00987 | GR00280 | 875 | 411 |
| 2003 | naRXA00988 | 2004 | aaRXA00988 | GR00280 | 1371 | 949 |
| 2005 | naRXA01005 | 2006 | aaRXA01005 | GR00286 | 520 | 1365 |
| 2007 | naRXA01007 | 2008 | aaRXA01007 | GR00287 | 2572 | 866 |
| 2009 | naRXA01008 | 2010 | aaRXA01008 | GR00287 | 2719 | 4659 |
| 2011 | naRXA01011 | 2012 | aaRXA01011 | GR00288 | 2089 | 857 |
| 2013 | naRXA01017 | 2014 | aaRXA01017 | GR00290 | 2175 | 1567 |
| 2015 | naRXA01021 | 2016 | aaRXA01021 | GR00291 | 1759 | 2280 |
| 2017 | naRXA01029 | 2018 | aaRXA01029 | GR00295 | 1338 | 1826 |
| 2019 | naRXA01031 | 2020 | aaRXA01031 | GR00295 | 3182 | 3847 |
| 2021 | naRXA01032 | 2022 | aaRXA01032 | GR00295 | 3974 | 4348 |
| 2023 | naRXA01033 | 2024 | aaRXA01033 | GR00295 | 4363 | 4698 |
| 2025 | naRXA01034 | 2026 | aaRXA01034 | GR00295 | 5177 | 4824 |
| 2027 | naRXA01035 | 2028 | aaRXA01035 | GR00295 | 5818 | 6423 |
| 2029 | naRXA01036 | 2030 | aaRXA01036 | GR00295 | 6513 | 6965 |
| 2031 | naRXA01037 | 2032 | aaRXA01037 | GR00295 | 7000 | 7527 |
| 2033 | naRXA01038 | 2034 | aaRXA01038 | GR00295 | 7530 | 8276 |
| 2035 | naRXA01039 | 2036 | aaRXA01039 | GR00295 | 9540 | 8965 |
| 2037 | naRXA01040 | 2038 | aaRXA01040 | GR00295 | 9711 | 10613 |
| 2039 | naRXA01041 | 2040 | aaRXA01041 | GR00295 | 10780 | 10932 |
| 2041 | naRXA01042 | 2042 | aaRXA01042 | GR00295 | 11088 | 12365 |
| 2043 | naRXA01043 | 2044 | aaRXA01043 | GR00295 | 12774 | 13346 |
| 2045 | naRXA01044 | 2046 | aaRXA01044 | GR00295 | 14024 | 15280 |
| 2047 | naRXA01045 | 2048 | aaRXA01045 | GR00295 | 15407 | 17230 |
| 2049 | naRXA01046 | 2050 | aaRXA01046 | GR00295 | 17441 | 19219 |
| 2051 | naRXA01047 | 2052 | aaRXA01047 | GR00295 | 19244 | 19717 |
| 2053 | naRXA01058 | 2054 | aaRXA01058 | GR00296 | 8566 | 8246 |
| 2055 | naRXA01063 | 2056 | aaRXA01063 | GR00297 | 828 | 499 |
| 2057 | naRXA01066 | 2058 | aaRXA01066 | GR00298 | 605 | 1330 |
| 2059 | naRXA01068 | 2060 | aaRXA01068 | GR00298 | 2184 | 3254 |
| 2061 | naRXA01074 | 2062 | aaRXA01074 | GR00300 | 2811 | 2107 |
| 2063 | naRXA01076 | 2064 | aaRXA01076 | GR00300 | 4374 | 3355 |
| 2065 | naRXA01078 | 2066 | aaRXA01078 | GR00300 | 6043 | 6876 |
| 2067 | naRXA01083 | 2068 | aaRXA01083 | GR00302 | 1777 | 1502 |
| 2069 | naRXA01088 | 2070 | aaRXA01088 | GR00304 | 3083 | 1902 |
| 2071 | naRXA01091 | 2072 | aaRXA01091 | GR00305 | 546 | 76 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 2073 | naRXA01092 | 2074 | aaRXA01092 | GR00305 | 702 | 881 |
| 2075 | naRXA01092 | 2076 | aaRXA01092 | GR00305 | 702 | 881 |
| 2077 | naRXA01096 | 2078 | aaRXA01096 | GR00306 | 4341 | 3643 |
| 2079 | naRXA01102 | 2080 | aaRXA01102 | GR00306 | 10018 | 8774 |
| 2081 | naRXA01103 | 2082 | aaRXA01103 | GR00306 | 10316 | 10092 |
| 2083 | naRXA01107 | 2084 | aaRXA01107 | GR00306 | 13612 | 14811 |
| 2085 | naRXA01108 | 2086 | aaRXA01108 | GR00306 | 15562 | 14912 |
| 2087 | naRXA01109 | 2088 | aaRXA01109 | GR00306 | 16281 | 15640 |
| 2089 | naRXA01119 | 2090 | aaRXA01119 | GR00310 | 1068 | 139 |
| 2091 | naRXA01122 | 2092 | aaRXA01122 | GR00311 | 557 | 36 |
| 2093 | naRXA01123 | 2094 | aaRXA01123 | GR00311 | 1090 | 644 |
| 2095 | naRXA01127 | 2096 | aaRXA01127 | GR00314 | 2 | 280 |
| 2097 | naRXA01129 | 2098 | aaRXA01129 | GR00314 | 1461 | 3326 |
| 2099 | naRXA01131 | 2100 | aaRXA01131 | GR00315 | 445 | 1311 |
| 2101 | naRXA01137 | 2102 | aaRXA01137 | GR00318 | 1101 | 1460 |
| 2103 | naRXA01156 | 2104 | aaRXA01156 | GR00327 | 1588 | 1388 |
| 2105 | naRXA01158 | 2106 | aaRXA01158 | GR00328 | 2580 | 1639 |
| 2107 | naRXA01159 | 2108 | aaRXA01159 | GR00328 | 3089 | 2775 |
| 2109 | naRXA01160 | 2110 | aaRXA01160 | GR00328 | 4187 | 3213 |
| 2111 | naRXA01163 | 2112 | aaRXA01163 | GR00331 | 710 | 6 |
| 2113 | naRXA01165 | 2114 | aaRXA01165 | GR00332 | 2155 | 1583 |
| 2115 | naRXA01166 | 2116 | aaRXA01166 | GR00332 | 3005 | 2523 |
| 2117 | naRXA01170 | 2118 | aaRXA01170 | GR00334 | 638 | 1120 |
| 2119 | naRXA01171 | 2120 | aaRXA01171 | GR00334 | 1714 | 2406 |
| 2121 | naRXA01176 | 2122 | aaRXA01176 | GR00335 | 1980 | 1477 |
| 2123 | naRXA01177 | 2124 | aaRXA01177 | GR00335 | 2121 | 4106 |
| 2125 | naRXA01178 | 2126 | aaRXA01178 | GR00335 | 4106 | 4555 |
| 2127 | naRXA01184 | 2128 | aaRXA01184 | GR00338 | 1489 | 17 |
| 2129 | naRXA01186 | 2130 | aaRXA01186 | GR00338 | 3742 | 2645 |
| 2131 | naRXA01186 | 2132 | aaRXA01186 | GR00338 | 3742 | 2645 |
| 2133 | naRXA01187 | 2134 | aaRXA01187 | GR00338 | 3850 | 4308 |
| 2135 | naRXA01195 | 2136 | aaRXA01195 | GR00343 | 1413 | 1859 |
| 2137 | naRXA01196 | 2138 | aaRXA01196 | GR00343 | 1889 | 2578 |
| 2139 | naRXA01197 | 2140 | aaRXA01197 | GR00343 | 3333 | 2881 |
| 2141 | naRXA01198 | 2142 | aaRXA01198 | GR00343 | 3422 | 3724 |
| 2143 | naRXA01207 | 2144 | aaRXA01207 | GR00347 | 126 | 773 |
| 2145 | naRXA01213 | 2146 | aaRXA01213 | GR00351 | 1508 | 282 |
| 2147 | naRXA01218 | 2148 | aaRXA01218 | GR00353 | 1078 | 1506 |
| 2149 | naRXA01234 | 2150 | aaRXA01234 | GR00357 | 633 | 250 |
| 2151 | naRXA01237 | 2152 | aaRXA01237 | GR00358 | 2751 | 2311 |
| 2153 | naRXA01267 | 2154 | aaRXA01267 | GR00367 | 16799 | 15486 |
| 2155 | naRXA01268 | 2156 | aaRXA01268 | GR00367 | 19365 | 18526 |
| 2157 | naRXA01271 | 2158 | aaRXA01271 | GR00367 | 23467 | 21656 |
| 2159 | naRXA01273 | 2160 | aaRXA01273 | GR00367 | 26475 | 25042 |
| 2161 | naRXA01282 | 2162 | aaRXA01282 | GR00369 | 5444 | 4665 |
| 2163 | naRXA01294 | 2164 | aaRXA01294 | GR00373 | 3537 | 2872 |
| 2165 | naRXA01295 | 2166 | aaRXA01295 | GR00373 | 3764 | 4738 |
| 2167 | naRXA01304 | 2168 | aaRXA01304 | GR00376 | 1982 | 2467 |
| 2169 | naRXA01310 | 2170 | aaRXA01310 | GR00380 | 803 | 477 |
| 2171 | naRXA01313 | 2172 | aaRXA01313 | GR00381 | 1116 | 172 |
| 2173 | naRXA01315 | 2174 | aaRXA01315 | GR00382 | 1394 | 744 |
| 2175 | naRXA01316 | 2176 | aaRXA01316 | GR00382 | 1855 | 1553 |
| 2177 | naRXA01317 | 2178 | aaRXA01317 | GR00382 | 2296 | 1877 |
| 2179 | naRXA01318 | 2180 | aaRXA01318 | GR00382 | 3616 | 2315 |
| 2181 | naRXA01330 | 2182 | aaRXA01330 | GR00387 | 569 | 1024 |
| 2183 | naRXA01333 | 2184 | aaRXA01333 | GR00389 | 1231 | 227 |
| 2185 | naRXA01336 | 2186 | aaRXA01336 | GR00389 | 3640 | 3038 |
| 2187 | naRXA01342 | 2188 | aaRXA01342 | GR00389 | 11296 | 12807 |
| 2189 | naRXA01348 | 2190 | aaRXA01348 | GR00392 | 261 | 752 |
| 2191 | naRXA01349 | 2192 | aaRXA01349 | GR00392 | 1531 | 755 |
| 2193 | naRXA01357 | 2194 | aaRXA01357 | GR00393 | 4357 | 4659 |
| 2195 | naRXA01359 | 2196 | aaRXA01359 | GR00393 | 6857 | 8038 |
| 2197 | naRXA01366 | 2198 | aaRXA01366 | GR00397 | 1369 | 980 |
| 2199 | naRXA01367 | 2200 | aaRXA01367 | GR00397 | 1518 | 1919 |
| 2201 | naRXA01370 | 2202 | aaRXA01370 | GR00398 | 1875 | 2225 |
| 2203 | naRXA01372 | 2204 | aaRXA01372 | GR00399 | 1 | 591 |
| 2205 | naRXA01378 | 2206 | aaRXA01378 | GR00401 | 1281 | 4 |
| 2207 | naRXA01380 | 2208 | aaRXA01380 | GR00403 | 2 | 2017 |
| 2209 | naRXA01384 | 2210 | aaRXA01384 | GR00406 | 3238 | 1523 |
| 2211 | naRXA01396 | 2212 | aaRXA01396 | GR00408 | 6475 | 6218 |
| 2213 | naRXA01397 | 2214 | aaRXA01397 | GR00408 | 6894 | 6475 |
| 2215 | naRXA01401 | 2216 | aaRXA01401 | GR00409 | 3193 | 3453 |
| 2217 | naRXA01402 | 2218 | aaRXA01402 | GR00409 | 3508 | 3981 |
| 2219 | naRXA01405 | 2220 | aaRXA01405 | GR00410 | 1844 | 1389 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 2221 | naRXA01413 | 2222 | aaRXA01413 | GR00412 | 854 | 1453 |
| 2223 | naRXA01414 | 2224 | aaRXA01414 | GR00412 | 1628 | 2134 |
| 2225 | naRXA01417 | 2226 | aaRXA01417 | GR00414 | 645 | 49 |
| 2227 | naRXA01421 | 2228 | aaRXA01421 | GR00416 | 1215 | 829 |
| 2229 | naRXA01425 | 2230 | aaRXA01425 | GR00417 | 1701 | 2585 |
| 2231 | naRXA01429 | 2232 | aaRXA01429 | GR00417 | 5651 | 6268 |
| 2233 | naRXA01439 | 2234 | aaRXA01439 | GR00418 | 5949 | 6494 |
| 2235 | naRXA01440 | 2236 | aaRXA01440 | GR00418 | 7496 | 6489 |
| 2237 | naRXA01441 | 2238 | aaRXA01441 | GR00418 | 8542 | 7514 |
| 2239 | naRXA01445 | 2240 | aaRXA01445 | GR00418 | 15083 | 14091 |
| 2241 | naRXA01447 | 2242 | aaRXA01447 | GR00418 | 17885 | 18733 |
| 2243 | naRXA01452 | 2244 | aaRXA01452 | GR00419 | 2363 | 2641 |
| 2245 | naRXA01456 | 2246 | aaRXA01456 | GR00420 | 898 | 1419 |
| 2247 | naRXA01457 | 2248 | aaRXA01457 | GR00420 | 1499 | 2173 |
| 2249 | naRXA01463 | 2250 | aaRXA01463 | GR00421 | 2493 | 1330 |
| 2251 | naRXA01469 | 2252 | aaRXA01469 | GR00422 | 2091 | 3122 |
| 2253 | naRXA01470 | 2254 | aaRXA01470 | GR00422 | 4112 | 3687 |
| 2255 | naRXA01472 | 2256 | aaRXA01472 | GR00422 | 5783 | 5328 |
| 2257 | naRXA01473 | 2258 | aaRXA01473 | GR00422 | 6596 | 5832 |
| 2259 | naRXA01474 | 2260 | aaRXA01474 | GR00422 | 6678 | 7223 |
| 2261 | naRXA01475 | 2262 | aaRXA01475 | GR00422 | 7651 | 7226 |
| 2263 | naRXA01476 | 2264 | aaRXA01476 | GR00422 | 7847 | 8188 |
| 2265 | naRXA01488 | 2266 | aaRXA01488 | GR00423 | 2179 | 1349 |
| 2267 | naRXA01494 | 2268 | aaRXA01494 | GR00423 | 8515 | 7520 |
| 2269 | naRXA01497 | 2270 | aaRXA01497 | GR00424 | 262 | 1179 |
| 2271 | naRXA01501 | 2272 | aaRXA01501 | GR00424 | 8130 | 7843 |
| 2273 | naRXA01504 | 2274 | aaRXA01504 | GR00424 | 10710 | 11318 |
| 2275 | naRXA01505 | 2276 | aaRXA01505 | GR00424 | 11318 | 11815 |
| 2277 | naRXA01506 | 2278 | aaRXA01506 | GR00424 | 11815 | 12225 |
| 2279 | naRXA01507 | 2280 | aaRXA01507 | GR00424 | 12239 | 12661 |
| 2281 | naRXA01519 | 2282 | aaRXA01519 | GR00424 | 23725 | 24471 |
| 2283 | naRXA01520 | 2284 | aaRXA01520 | GR00424 | 24784 | 25167 |
| 2285 | naRXA01523 | 2286 | aaRXA01523 | GR00424 | 27951 | 28901 |
| 2287 | naRXA01525 | 2288 | aaRXA01525 | GR00424 | 32301 | 30580 |
| 2289 | naRXA01527 | 2290 | aaRXA01527 | GR00425 | 5126 | 2616 |
| 2291 | naRXA01536 | 2292 | aaRXA01536 | GR00427 | 4066 | 2825 |
| 2293 | naRXA01540 | 2294 | aaRXA01540 | GR00428 | 3083 | 2382 |
| 2295 | naRXA01543 | 2296 | aaRXA01543 | GR00430 | 2802 | 37 |
| 2297 | naRXA01544 | 2298 | aaRXA01544 | GR00430 | 3496 | 2897 |
| 2299 | naRXA01545 | 2300 | aaRXA01545 | GR00430 | 4838 | 3588 |
| 2301 | naRXA01546 | 2302 | aaRXA01546 | GR00430 | 5584 | 4889 |
| 2303 | naRXA01547 | 2304 | aaRXA01547 | GR00430 | 6371 | 5709 |
| 2305 | naRXA01548 | 2306 | aaRXA01548 | GR00430 | 7432 | 6425 |
| 2307 | naRXA01552 | 2308 | aaRXA01552 | GR00431 | 6122 | 5145 |
| 2309 | naRXA01554 | 2310 | aaRXA01554 | GR00432 | 3719 | 1578 |
| 2311 | naRXA01560 | 2312 | aaRXA01560 | GR00435 | 767 | 438 |
| 2313 | naRXA01575 | 2314 | aaRXA01575 | GR00438 | 8024 | 7005 |
| 2315 | naRXA01577 | 2316 | aaRXA01577 | GR00438 | 8811 | 9185 |
| 2317 | naRXA01579 | 2318 | aaRXA01579 | GR00439 | 671 | 1054 |
| 2319 | naRXA01585 | 2320 | aaRXA01585 | GR00441 | 1226 | 600 |
| 2321 | naRXA01586 | 2322 | aaRXA01586 | GR00441 | 1597 | 1229 |
| 2323 | naRXA01595 | 2324 | aaRXA01595 | GR00447 | 3326 | 4285 |
| 2325 | naRXA01600 | 2326 | aaRXA01600 | GR00447 | 10460 | 11128 |
| 2327 | naRXA01602 | 2328 | aaRXA01602 | GR00447 | 13591 | 12062 |
| 2329 | naRXA01605 | 2330 | aaRXA01605 | GR00448 | 960 | 2474 |
| 2331 | naRXA01610 | 2332 | aaRXA01610 | GR00449 | 4343 | 3615 |
| 2333 | naRXA01611 | 2334 | aaRXA01611 | GR00449 | 4832 | 4476 |
| 2335 | naRXA01612 | 2336 | aaRXA01612 | GR00449 | 5235 | 4891 |
| 2337 | naRXA01619 | 2338 | aaRXA01619 | GR00451 | 2407 | 1433 |
| 2339 | naRXA01622 | 2340 | aaRXA01622 | GR00452 | 1908 | 2510 |
| 2341 | naRXA01623 | 2342 | aaRXA01623 | GR00452 | 2514 | 3224 |
| 2343 | naRXA01624 | 2344 | aaRXA01624 | GR00452 | 3220 | 3564 |
| 2345 | naRXA01628 | 2346 | aaRXA01628 | GR00453 | 866 | 1879 |
| 2347 | naRXA01630 | 2348 | aaRXA01630 | GR00454 | 341 | 1417 |
| 2349 | naRXA01641 | 2350 | aaRXA01641 | GR00456 | 5182 | 6552 |
| 2351 | naRXA01642 | 2352 | aaRXA01642 | GR00456 | 6557 | 7798 |
| 2353 | naRXA01643 | 2354 | aaRXA01643 | GR00456 | 8374 | 7949 |
| 2355 | naRXA01645 | 2356 | aaRXA01645 | GR00456 | 10574 | 9969 |
| 2357 | naRXA01646 | 2358 | aaRXA01646 | GR00456 | 11513 | 10695 |
| 2359 | naRXA01656 | 2360 | aaRXA01656 | GR00460 | 1548 | 2444 |
| 2361 | naRXA01665 | 2362 | aaRXA01665 | GR00463 | 2152 | 1433 |
| 2363 | naRXA01671 | 2364 | aaRXA01671 | GR00466 | 854 | 1468 |
| 2365 | naRXA01673 | 2366 | aaRXA01673 | GR00467 | 1807 | 773 |
| 2367 | naRXA01675 | 2368 | aaRXA01675 | GR00467 | 2824 | 3234 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 2369 | naRXA01676 | 2370 | aaRXA01676 | GR00467 | 4179 | 3424 |
| 2371 | naRXA01677 | 2372 | aaRXA01677 | GR00467 | 5043 | 4300 |
| 2373 | naRXA01681 | 2374 | aaRXA01681 | GR00467 | 10681 | 11313 |
| 2375 | naRXA01685 | 2376 | aaRXA01685 | GR00470 | 1488 | 910 |
| 2377 | naRXA01686 | 2378 | aaRXA01686 | GR00470 | 2026 | 1586 |
| 2379 | naRXA01693 | 2380 | aaRXA01693 | GR00474 | 1553 | 2974 |
| 2381 | naRXA01714 | 2382 | aaRXA01714 | GR00485 | 985 | 371 |
| 2383 | naRXA01715 | 2384 | aaRXA01715 | GR00485 | 1267 | 1962 |
| 2385 | naRXA01729 | 2386 | aaRXA01729 | GR00489 | 2636 | 3154 |
| 2387 | naRXA01731 | 2388 | aaRXA01731 | GR00491 | 109 | 807 |
| 2389 | naRXA01738 | 2390 | aaRXA01738 | GR00493 | 3971 | 4684 |
| 2391 | naRXA01741 | 2392 | aaRXA01741 | GR00493 | 7535 | 6738 |
| 2393 | naRXA01748 | 2394 | aaRXA01748 | GR00495 | 3681 | 4460 |
| 2395 | naRXA01749 | 2396 | aaRXA01749 | GR00495 | 4633 | 6249 |
| 2397 | naRXA01750 | 2398 | aaRXA01750 | GR00496 | 1878 | 3518 |
| 2399 | naRXA01752 | 2400 | aaRXA01752 | GR00497 | 557 | 6 |
| 2401 | naRXA01753 | 2402 | aaRXA01753 | GR00497 | 2095 | 557 |
| 2403 | naRXA01760 | 2404 | aaRXA01760 | GR00498 | 5095 | 5376 |
| 2405 | naRXA01768 | 2406 | aaRXA01768 | GR00501 | 827 | 450 |
| 2407 | naRXA01770 | 2408 | aaRXA01770 | GR00501 | 5134 | 1370 |
| 2409 | naRXA01773 | 2410 | aaRXA01773 | GR00503 | 34 | 444 |
| 2411 | naRXA01775 | 2412 | aaRXA01775 | GR00504 | 178 | 741 |
| 2413 | naRXA01776 | 2414 | aaRXA01776 | GR00504 | 838 | 2289 |
| 2415 | naRXA01777 | 2416 | aaRXA01777 | GR00504 | 2319 | 2777 |
| 2417 | naRXA01778 | 2418 | aaRXA01778 | GR00504 | 2912 | 4048 |
| 2419 | naRXA01779 | 2420 | aaRXA01779 | GR00504 | 4246 | 5664 |
| 2421 | naRXA01780 | 2422 | aaRXA01780 | GR00504 | 5721 | 6095 |
| 2423 | naRXA01781 | 2424 | aaRXA01781 | GR00504 | 6052 | 6312 |
| 2425 | naRXA01782 | 2426 | aaRXA01782 | GR00504 | 6384 | 6779 |
| 2427 | naRXA01783 | 2428 | aaRXA01783 | GR00504 | 6842 | 7078 |
| 2429 | naRXA01785 | 2430 | aaRXA01785 | GR00505 | 729 | 1304 |
| 2431 | naRXA01788 | 2432 | aaRXA01788 | GR00506 | 361 | 801 |
| 2433 | naRXA01789 | 2434 | aaRXA01789 | GR00506 | 875 | 1516 |
| 2435 | naRXA01790 | 2436 | aaRXA01790 | GR00506 | 1672 | 1731 |
| 2437 | naRXA01791 | 2438 | aaRXA01791 | GR00506 | 1885 | 2247 |
| 2439 | naRXA01792 | 2440 | aaRXA01792 | GR00506 | 2310 | 2582 |
| 2441 | naRXA01793 | 2442 | aaRXA01793 | GR00506 | 2916 | 3149 |
| 2443 | naRXA01794 | 2444 | aaRXA01794 | GR00506 | 3194 | 3427 |
| 2445 | naRXA01799 | 2446 | aaRXA01799 | GR00509 | 377 | 1570 |
| 2447 | naRXA01800 | 2448 | aaRXA01800 | GR00509 | 2292 | 1573 |
| 2449 | naRXA01804 | 2450 | aaRXA01804 | GR00509 | 6117 | 5797 |
| 2451 | naRXA01805 | 2452 | aaRXA01805 | GR00509 | 6515 | 6186 |
| 2453 | naRXA01806 | 2454 | aaRXA01806 | GR00509 | 6595 | 7074 |
| 2455 | naRXA01816 | 2456 | aaRXA01816 | GR00515 | 4210 | 4941 |
| 2457 | naRXA01817 | 2458 | aaRXA01817 | GR00515 | 4941 | 5573 |
| 2459 | naRXA01820 | 2460 | aaRXA01820 | GR00515 | 8360 | 9733 |
| 2461 | naRXA01842 | 2462 | aaRXA01842 | GR00522 | 1397 | 480 |
| 2463 | naRXA01844 | 2464 | aaRXA01844 | GR00522 | 1950 | 1771 |
| 2465 | naRXA01845 | 2466 | aaRXA01845 | GR00522 | 1919 | 2326 |
| 2467 | naRXA01856 | 2468 | aaRXA01856 | GR00527 | 225 | 770 |
| 2469 | naRXA01857 | 2470 | aaRXA01857 | GR00527 | 939 | 1589 |
| 2471 | naRXA01858 | 2472 | aaRXA01858 | GR00529 | 578 | 6 |
| 2473 | naRXA01870 | 2474 | aaRXA01870 | GR00534 | 2123 | 2797 |
| 2475 | naRXA01871 | 2476 | aaRXA01871 | GR00534 | 2797 | 3759 |
| 2477 | naRXA01903 | 2478 | aaRXA01903 | GR00545 | 3 | 281 |
| 2479 | naRXA01904 | 2480 | aaRXA01904 | GR00545 | 762 | 340 |
| 2481 | naRXA01905 | 2482 | aaRXA01905 | GR00545 | 1074 | 1604 |
| 2483 | naRXA01906 | 2484 | aaRXA01906 | GR00545 | 2322 | 2786 |
| 2485 | naRXA01907 | 2486 | aaRXA01907 | GR00545 | 3176 | 3787 |
| 2487 | naRXA01923 | 2488 | aaRXA01923 | GR00552 | 1311 | 1739 |
| 2489 | naRXA01931 | 2490 | aaRXA01931 | GR00555 | 4913 | 5566 |
| 2491 | naRXA01941 | 2492 | aaRXA01941 | GR00557 | 995 | 1429 |
| 2493 | naRXA01942 | 2494 | aaRXA01942 | GR00557 | 3526 | 2927 |
| 2495 | naRXA01957 | 2496 | aaRXA01957 | GR00564 | 389 | 850 |
| 2497 | naRXA01958 | 2498 | aaRXA01958 | GR00564 | 910 | 1416 |
| 2499 | naRXA01959 | 2500 | aaRXA01959 | GR00564 | 1639 | 2019 |
| 2501 | naRXA01961 | 2502 | aaRXA01961 | GR00565 | 521 | 1000 |
| 2503 | naRXA01962 | 2504 | aaRXA01962 | GR00565 | 1022 | 1591 |
| 2505 | naRXA01963 | 2506 | aaRXA01963 | GR00565 | 1757 | 2440 |
| 2507 | naRXA01964 | 2508 | aaRXA01964 | GR00566 | 1329 | 4 |
| 2509 | naRXA01965 | 2510 | aaRXA01965 | GR00566 | 1935 | 1375 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 2511 | naRXA01966 | 2512 | aaRXA01966 | GR00567 | 47 | 703 |
| 2513 | naRXA01968 | 2514 | aaRXA01968 | GR00567 | 3295 | 2138 |
| 2515 | naRXA01969 | 2516 | aaRXA01969 | GR00567 | 5689 | 5216 |
| 2517 | naRXA01973 | 2518 | aaRXA01973 | GR00570 | 2 | 583 |
| 2519 | naRXA01974 | 2520 | aaRXA01974 | GR00570 | 658 | 2109 |
| 2521 | naRXA01976 | 2522 | aaRXA01976 | GR00571 | 3742 | 2222 |
| 2523 | naRXA01977 | 2524 | aaRXA01977 | GR00571 | 4547 | 3972 |
| 2525 | naRXA01982 | 2526 | aaRXA01982 | GR00573 | 3001 | 1844 |
| 2527 | naRXA01990 | 2528 | aaRXA01990 | GR00581 | 1 | 999 |
| 2529 | naRXA01992 | 2530 | aaRXA01992 | GR00583 | 709 | 260 |
| 2531 | naRXA01999 | 2532 | aaRXA01999 | GR00589 | 2384 | 2854 |
| 2533 | naRXA02001 | 2534 | aaRXA02001 | GR00590 | 700 | 152 |
| 2535 | naRXA02004 | 2536 | aaRXA02004 | GR00594 | 3 | 209 |
| 2537 | naRXA02006 | 2538 | aaRXA02006 | GR00597 | 498 | 4 |
| 2539 | naRXA02009 | 2540 | aaRXA02009 | GR00601 | 127 | 5 |
| 2541 | naRXA02013 | 2542 | aaRXA02013 | GR00607 | 553 | 5 |
| 2543 | naRXA02021 | 2544 | aaRXA02021 | GR00613 | 2008 | 1061 |
| 2545 | naRXA02036 | 2546 | aaRXA02036 | GR00619 | 3441 | 3821 |
| 2547 | naRXA02040 | 2548 | aaRXA02040 | GR00621 | 1452 | 925 |
| 2549 | naRXA02046 | 2550 | aaRXA02046 | GR00623 | 2680 | 2943 |
| 2551 | naRXA02051 | 2552 | aaRXA02051 | GR00624 | 3186 | 3683 |
| 2553 | naRXA02053 | 2554 | aaRXA02053 | GR00624 | 5484 | 6062 |
| 2555 | naRXA02057 | 2556 | aaRXA02057 | GR00625 | 2972 | 3502 |
| 2557 | naRXA02058 | 2558 | aaRXA02058 | GR00625 | 4051 | 3500 |
| 2559 | naRXA02069 | 2560 | aaRXA02069 | GR00627 | 1116 | 1694 |
| 2561 | naRXA02070 | 2562 | aaRXA02070 | GR00627 | 1733 | 2830 |
| 2563 | naRXA02080 | 2564 | aaRXA02080 | GR00628 | 11017 | 10211 |
| 2565 | naRXA02081 | 2566 | aaRXA02081 | GR00628 | 12307 | 13935 |
| 2567 | naRXA02084 | 2568 | aaRXA02084 | GR00629 | 2920 | 2576 |
| 2569 | naRXA02089 | 2570 | aaRXA02089 | GR00629 | 8431 | 8901 |
| 2571 | naRXA02090 | 2572 | aaRXA02090 | GR00629 | 9764 | 8964 |
| 2573 | naRXA02091 | 2574 | aaRXA02091 | GR00629 | 10512 | 9862 |
| 2575 | naRXA02097 | 2576 | aaRXA02097 | GR00630 | 184 | 3555 |
| 2577 | naRXA02102 | 2578 | aaRXA02102 | GR00631 | 4479 | 3322 |
| 2579 | naRXA02103 | 2580 | aaRXA02103 | GR00631 | 4510 | 4905 |
| 2581 | naRXA02109 | 2582 | aaRXA02109 | GR00632 | 3460 | 2540 |
| 2583 | naRXA02117 | 2584 | aaRXA02117 | GR00636 | 1056 | 1529 |
| 2585 | naRXA02123 | 2586 | aaRXA02123 | GR00636 | 6558 | 7928 |
| 2587 | naRXA02124 | 2588 | aaRXA02124 | GR00636 | 7956 | 9911 |
| 2589 | naRXA02125 | 2590 | aaRXA02125 | GR00637 | 739 | 1539 |
| 2591 | naRXA02129 | 2592 | aaRXA02129 | GR00637 | 5906 | 6139 |
| 2593 | naRXA02132 | 2594 | aaRXA02132 | GR00638 | 737 | 1375 |
| 2595 | naRXA02137 | 2596 | aaRXA02137 | GR00639 | 4166 | 3369 |
| 2597 | naRXA02141 | 2598 | aaRXA02141 | GR00639 | 8457 | 8864 |
| 2599 | naRXA02146 | 2600 | aaRXA02146 | GR00639 | 14742 | 15368 |
| 2601 | naRXA02152 | 2602 | aaRXA02152 | GR00640 | 237 | 638 |
| 2603 | naRXA02163 | 2604 | aaRXA02163 | GR00640 | 10072 | 10824 |
| 2605 | naRXA02164 | 2606 | aaRXA02164 | GR00640 | 10824 | 12398 |
| 2607 | naRXA02165 | 2608 | aaRXA02165 | GR00640 | 12388 | 12999 |
| 2609 | naRXA02166 | 2610 | aaRXA02166 | GR00640 | 13048 | 13224 |
| 2611 | naRXA02168 | 2612 | aaRXA02168 | GR00641 | 2894 | 81 |
| 2613 | naRXA02170 | 2614 | aaRXA02170 | GR00641 | 4798 | 4025 |
| 2615 | naRXA02172 | 2616 | aaRXA02172 | GR00641 | 6919 | 6581 |
| 2617 | naRXA02177 | 2618 | aaRXA02177 | GR00641 | 12683 | 13615 |
| 2619 | naRXA02178 | 2620 | aaRXA02178 | GR00641 | 13628 | 14497 |
| 2621 | naRXA02181 | 2622 | aaRXA02181 | GR00641 | 17168 | 17845 |
| 2623 | naRXA02183 | 2624 | aaRXA02183 | GR00641 | 18663 | 19187 |
| 2625 | naRXA02187 | 2626 | aaRXA02187 | GR00641 | 21249 | 23447 |
| 2627 | naRXA02199 | 2628 | aaRXA02199 | GR00646 | 2591 | 3160 |
| 2629 | naRXA02203 | 2630 | aaRXA02203 | GR00646 | 7469 | 7092 |
| 2631 | naRXA02206 | 2632 | aaRXA02206 | GR00646 | 9927 | 10862 |
| 2633 | naRXA02211 | 2634 | aaRXA02211 | GR00648 | 2537 | 2989 |
| 2635 | naRXA02212 | 2636 | aaRXA02212 | GR00649 | 964 | 467 |
| 2637 | naRXA02216 | 2638 | aaRXA02216 | GR00651 | 2 | 307 |
| 2639 | naRXA02217 | 2640 | aaRXA02217 | GR00651 | 968 | 306 |
| 2641 | naRXA02218 | 2642 | aaRXA02218 | GR00651 | 1299 | 1565 |
| 2643 | naRXA02219 | 2644 | aaRXA02219 | GR00651 | 1578 | 2963 |
| 2645 | naRXA02221 | 2646 | aaRXA02221 | GR00651 | 6720 | 8081 |
| 2647 | naRXA02227 | 2648 | aaRXA02227 | GR00653 | 1236 | 1853 |
| 2649 | naRXA02230 | 2650 | aaRXA02230 | GR00653 | 4156 | 3620 |
| 2651 | naRXA02231 | 2652 | aaRXA02231 | GR00653 | 5111 | 4356 |
| 2653 | naRXA02244 | 2654 | aaRXA02244 | GR00654 | 12058 | 13590 |
| 2655 | naRXA02255 | 2656 | aaRXA02255 | GR00654 | 22507 | 23442 |
| 2657 | naRXA02266 | 2658 | aaRXA02266 | GR00655 | 653 | 1165 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 2659 | naRXA02267 | 2660 | aaRXA02267 | GR00655 | 2053 | 1181 |
| 2661 | naRXA02280 | 2662 | aaRXA02280 | GR00658 | 2 | 754 |
| 2663 | naRXA02286 | 2664 | aaRXA02286 | GR00660 | 3285 | 3833 |
| 2665 | naRXA02287 | 2666 | aaRXA02287 | GR00660 | 4071 | 4622 |
| 2667 | naRXA02294 | 2668 | aaRXA02294 | GR00662 | 5992 | 5618 |
| 2669 | naRXA02295 | 2670 | aaRXA02295 | GR00662 | 6842 | 6063 |
| 2671 | naRXA02297 | 2672 | aaRXA02297 | GR00662 | 7502 | 8638 |
| 2673 | naRXA02298 | 2674 | aaRXA02298 | GR00662 | 10310 | 8652 |
| 2675 | naRXA02304 | 2676 | aaRXA02304 | GR00663 | 1613 | 723 |
| 2677 | naRXA02308 | 2678 | aaRXA02308 | GR00664 | 939 | 511 |
| 2679 | naRXA02324 | 2680 | aaRXA02324 | GR00668 | 1548 | 2633 |
| 2681 | naRXA02325 | 2682 | aaRXA02325 | GR00668 | 4314 | 3445 |
| 2683 | naRXA02331 | 2684 | aaRXA02331 | GR00671 | 396 | 761 |
| 2685 | naRXA02336 | 2686 | aaRXA02336 | GR00672 | 2731 | 2552 |
| 2687 | naRXA02347 | 2688 | aaRXA02347 | GR00677 | 509 | 189 |
| 2689 | naRXA02349 | 2690 | aaRXA02349 | GR00678 | 394 | 5 |
| 2691 | naRXA02352 | 2692 | aaRXA02352 | GR00681 | 2 | 556 |
| 2693 | naRXA02356 | 2694 | aaRXA02356 | GR00684 | 761 | 1756 |
| 2695 | naRXA02358 | 2696 | aaRXA02358 | GR00685 | 1239 | 1529 |
| 2697 | naRXA02362 | 2698 | aaRXA02362 | GR00685 | 7045 | 10743 |
| 2699 | naRXA02374 | 2700 | aaRXA02374 | GR00688 | 1626 | 2246 |
| 2701 | naRXA02390 | 2702 | aaRXA02390 | GR00695 | 1500 | 832 |
| 2703 | naRXA02393 | 2704 | aaRXA02393 | GR00697 | 168 | 449 |
| 2705 | naRXA02395 | 2706 | aaRXA02395 | GR00698 | 2 | 733 |
| 2707 | naRXA02396 | 2708 | aaRXA02396 | GR00698 | 1309 | 1031 |
| 2709 | naRXA02403 | 2710 | aaRXA02403 | GR00700 | 896 | 1660 |
| 2711 | naRXA02412 | 2712 | aaRXA02412 | GR00703 | 2043 | 2522 |
| 2713 | naRXA02417 | 2714 | aaRXA02417 | GR00705 | 4755 | 2632 |
| 2715 | naRXA02421 | 2716 | aaRXA02421 | GR00705 | 7237 | 6428 |
| 2717 | naRXA02425 | 2718 | aaRXA02425 | GR00707 | 1 | 630 |
| 2719 | naRXA02427 | 2720 | aaRXA02427 | GR00707 | 3447 | 3061 |
| 2721 | naRXA02430 | 2722 | aaRXA02430 | GR00707 | 7498 | 7683 |
| 2723 | naRXA02433 | 2724 | aaRXA02433 | GR00708 | 2981 | 3580 |
| 2725 | naRXA02437 | 2726 | aaRXA02437 | GR00709 | 1661 | 2470 |
| 2727 | naRXA02443 | 2728 | aaRXA02443 | GR00709 | 6818 | 7771 |
| 2729 | naRXA02444 | 2730 | aaRXA02444 | GR00709 | 7836 | 9113 |
| 2731 | naRXA02452 | 2732 | aaRXA02452 | GR00710 | 5271 | 5092 |
| 2733 | naRXA02459 | 2734 | aaRXA02459 | GR00712 | 4341 | 5075 |
| 2735 | naRXA02461 | 2736 | aaRXA02461 | GR00712 | 6252 | 5845 |
| 2737 | naRXA02467 | 2738 | aaRXA02467 | GR00714 | 643 | 419 |
| 2739 | naRXA02472 | 2740 | aaRXA02472 | GR00715 | 5435 | 5725 |
| 2741 | naRXA02473 | 2742 | aaRXA02473 | GR00715 | 6664 | 5924 |
| 2743 | naRXA02475 | 2744 | aaRXA02475 | GR00715 | 9595 | 8441 |
| 2745 | naRXA02478 | 2746 | aaRXA02478 | GR00716 | 1245 | 10 |
| 2747 | naRXA02482 | 2748 | aaRXA02482 | GR00718 | 914 | 105 |
| 2749 | naRXA02483 | 2750 | aaRXA02483 | GR00718 | 1813 | 1001 |
| 2751 | naRXA02484 | 2752 | aaRXA02484 | GR00718 | 2317 | 1817 |
| 2753 | naRXA02486 | 2754 | aaRXA02486 | GR00718 | 3441 | 4076 |
| 2755 | naRXA02488 | 2756 | aaRXA02488 | GR00719 | 1 | 369 |
| 2757 | naRXA02489 | 2758 | aaRXA02489 | GR00719 | 373 | 996 |
| 2759 | naRXA02495 | 2760 | aaRXA02495 | GR00720 | 9002 | 6435 |
| 2761 | naRXA02496 | 2762 | aaRXA02496 | GR00720 | 10025 | 9219 |
| 2763 | naRXA02498 | 2764 | aaRXA02498 | GR00720 | 11016 | 11819 |
| 2765 | naRXA02500 | 2766 | aaRXA02500 | GR00720 | 13460 | 13558 |
| 2767 | naRXA02506 | 2768 | aaRXA02506 | GR00720 | 19484 | 18603 |
| 2769 | naRXA02514 | 2770 | aaRXA02514 | GR00723 | 1 | 837 |
| 2771 | naRXA02518 | 2772 | aaRXA02518 | GR00723 | 3464 | 3874 |
| 2773 | naRXA02521 | 2774 | aaRXA02521 | GR00724 | 2924 | 4366 |
| 2775 | naRXA02524 | 2776 | aaRXA02524 | GR00725 | 2405 | 3094 |
| 2777 | naRXA02525 | 2778 | aaRXA02525 | GR00725 | 3113 | 3490 |
| 2779 | naRXA02540 | 2780 | aaRXA02540 | GR00726 | 12438 | 12001 |
| 2781 | naRXA02544 | 2782 | aaRXA02544 | GR00726 | 16715 | 18142 |
| 2783 | naRXA02545 | 2784 | aaRXA02545 | GR00726 | 18749 | 18192 |
| 2785 | naRXA02546 | 2786 | aaRXA02546 | GR00726 | 19927 | 18824 |
| 2787 | naRXA02549 | 2788 | aaRXA02549 | GR00728 | 1331 | 6 |
| 2789 | naRXA02552 | 2790 | aaRXA02552 | GR00730 | 924 | 130 |
| 2791 | naRXA02554 | 2792 | aaRXA02554 | GR00731 | 1050 | 427 |
| 2793 | naRXA02569 | 2794 | aaRXA02569 | GR00736 | 82 | 831 |
| 2795 | naRXA02570 | 2796 | aaRXA02570 | GR00736 | 837 | 1478 |
| 2797 | naRXA02573 | 2798 | aaRXA02573 | GR00739 | 594 | 151 |
| 2799 | naRXA02575 | 2800 | aaRXA02575 | GR00739 | 1907 | 3064 |
| 2801 | naRXA02576 | 2802 | aaRXA02576 | GR00740 | 1569 | 148 |
| 2803 | naRXA02577 | 2804 | aaRXA02577 | GR00740 | 2463 | 1579 |
| 2805 | naRXA02584 | 2806 | aaRXA02584 | GR00741 | 8925 | 8575 |

TABLE 1-continued

GENES IN THE APPLICATION

| Nucleic Acid SEQ ID NO | Identification Code | Amino Acid SEQ ID NO | Identification Code | Contig. | NT Start | NT Stop |
|---|---|---|---|---|---|---|
| 2807 | naRXA02585 | 2808 | aaRXA02585 | GR00741 | 9917 | 8937 |
| 2809 | naRXA02588 | 2810 | aaRXA02588 | GR00741 | 13037 | 12354 |
| 2811 | naRXA02591 | 2812 | aaRXA02591 | GR00741 | 15780 | 17609 |
| 2813 | naRXA02598 | 2814 | aaRXA02598 | GR00742 | 2576 | 3166 |
| 2815 | naRXA02600 | 2816 | aaRXA02600 | GR00742 | 5027 | 3630 |
| 2817 | naRXA02601 | 2818 | aaRXA02601 | GR00742 | 5258 | 7246 |
| 2819 | naRXA02602 | 2820 | aaRXA02602 | GR00742 | 7239 | 7742 |
| 2821 | naRXA02604 | 2822 | aaRXA02604 | GR00742 | 8800 | 10875 |
| 2823 | naRXA02609 | 2824 | aaRXA02609 | GR00742 | 16197 | 16445 |
| 2825 | naRXA02617 | 2826 | aaRXA02617 | GR00745 | 1404 | 1910 |
| 2827 | naRXA02619 | 2828 | aaRXA02619 | GR00746 | 204 | 1103 |
| 2829 | naRXA02620 | 2830 | aaRXA02620 | GR00746 | 1192 | 1845 |
| 2831 | naRXA02639 | 2832 | aaRXA02639 | GR00749 | 511 | 1344 |
| 2833 | naRXA02647 | 2834 | aaRXA02647 | GR00751 | 4155 | 4616 |
| 2835 | naRXA02649 | 2836 | aaRXA02649 | GR00752 | 1284 | 283 |
| 2837 | naRXA02652 | 2838 | aaRXA02652 | GR00752 | 2973 | 3551 |
| 2839 | naRXA02655 | 2840 | aaRXA02655 | GR00752 | 9313 | 8330 |
| 2841 | naRXA02662 | 2842 | aaRXA02662 | GR00753 | 1461 | 1724 |
| 2843 | naRXA02665 | 2844 | aaRXA02665 | GR00753 | 6497 | 6018 |
| 2845 | naRXA02670 | 2846 | aaRXA02670 | GR00753 | 10199 | 10780 |
| 2847 | naRXA02672 | 2848 | aaRXA02672 | GR00753 | 12303 | 13400 |
| 2849 | naRXA02678 | 2850 | aaRXA02678 | GR00754 | 3858 | 4775 |
| 2851 | naRXA02683 | 2852 | aaRXA02683 | GR00754 | 7742 | 7065 |
| 2853 | naRXA02685 | 2854 | aaRXA02685 | GR00754 | 10058 | 9402 |
| 2855 | naRXA02688 | 2856 | aaRXA02688 | GR00754 | 12256 | 12924 |
| 2857 | naRXA02689 | 2858 | aaRXA02689 | GR00754 | 13405 | 13064 |
| 2859 | naRXA02690 | 2860 | aaRXA02690 | GR00754 | 14502 | 13405 |
| 2861 | naRXA02700 | 2862 | aaRXA02700 | GR00757 | 3507 | 4742 |
| 2863 | naRXA02701 | 2864 | aaRXA02701 | GR00757 | 4838 | 6145 |
| 2865 | naRXA02712 | 2866 | aaRXA02712 | GR00758 | 13067 | 12273 |
| 2867 | naRXA02714 | 2868 | aaRXA02714 | GR00758 | 14754 | 14326 |
| 2869 | naRXA02715 | 2870 | aaRXA02715 | GR00758 | 15847 | 15458 |
| 2871 | naRXA02721 | 2872 | aaRXA02721 | GR00759 | 1373 | 636 |
| 2873 | naRXA02725 | 2874 | aaRXA02725 | GR00760 | 1478 | 867 |
| 2875 | naRXA02727 | 2876 | aaRXA02727 | GR00760 | 6287 | 5376 |
| 2877 | naRXA02735 | 2878 | aaRXA02735 | GR00763 | 777 | 73 |
| 2879 | naRXA02736 | 2880 | aaRXA02736 | GR00763 | 1753 | 797 |
| 2881 | naRXA02751 | 2882 | aaRXA02751 | GR00764 | 6393 | 5920 |
| 2883 | naRXA02756 | 2884 | aaRXA02756 | GR00766 | 3851 | 2961 |
| 2885 | naRXA02757 | 2886 | aaRXA02757 | GR00766 | 4475 | 3930 |
| 2887 | naRXA02765 | 2888 | aaRXA02765 | GR00769 | 3552 | 2794 |
| 2889 | naRXA02766 | 2890 | aaRXA02766 | GR00770 | 986 | 594 |
| 2891 | naRXA02774 | 2892 | aaRXA02774 | GR00773 | 3 | 473 |
| 2893 | naRXA02775 | 2894 | aaRXA02775 | GR00773 | 744 | 968 |
| 2895 | naRXA02776 | 2896 | aaRXA02776 | GR00773 | 1713 | 1372 |
| 2897 | naRXA02777 | 2898 | aaRXA02777 | GR00773 | 4626 | 5732 |
| 2899 | naRXA02778 | 2900 | aaRXA02778 | GR00773 | 10095 | 10319 |
| 2901 | naRXA02779 | 2902 | aaRXA02779 | GR00773 | 10617 | 10895 |
| 2903 | naRXA02780 | 2904 | aaRXA02780 | GR00773 | 10954 | 11280 |
| 2905 | naRXA02783 | 2906 | aaRXA02783 | GR00775 | 845 | 1393 |
| 2907 | naRXA02784 | 2908 | aaRXA02784 | GR00775 | 1751 | 1936 |
| 2909 | naRXA02786 | 2910 | aaRXA02786 | GR00777 | 2 | 808 |
| 2911 | naRXA02789 | 2912 | aaRXA02789 | GR00777 | 5237 | 5782 |
| 2913 | naRXA02793 | 2914 | aaRXA02793 | GR00777 | 9385 | 8684 |
| 2915 | naRXA02796 | 2916 | aaRXA02796 | GR00778 | 1648 | 1100 |
| 2917 | naRXA02798 | 2918 | aaRXA02798 | GR00778 | 2842 | 4266 |
| 2919 | naRXA02799 | 2920 | aaRXA02799 | GR00780 | 182 | 454 |
| 2921 | naRXA02815 | 2922 | aaRXA02815 | GR00796 | 3 | 554 |
| 2923 | naRXA02823 | 2924 | aaRXA02823 | GR00804 | 275 | 6 |
| 2925 | naRXA02827 | 2926 | aaRXA02827 | GR00812 | 428 | 6 |
| 2927 | naRXA02842 | 2928 | aaRXA02842 | GR00841 | 356 | 15 |
| 2929 | naRXA02845 | 2930 | aaRXA02845 | GR00844 | 2 | 616 |
| 2931 | naRXA02848 | 2932 | aaRXA02848 | GR00848 | 113 | 511 |

TABLE 2

GENES IDENTIFIED FROM GENBANK

| GenBank™ Accession No. | Gene Name | Gene Function | Reference |
|---|---|---|---|
| A09073 | ppg | Phosphoenol pyruvate carboxylase | Bachmann, B. et al. "DNA fragment coding for phosphoenolpyruvat corboxylase, recombinant DNA carrying said fragment, strains carrying the recombinant DNA and method for producing L-aminino acids using said strains," Patent: EP 0358940-A 3 Mar. 21, 1990 |
| A45579, A45581, A45583, A45585, A45587 | | Threonine dehydratase | Moeckel, B. et al. "Production of L-isoleucine by means of recombinant micro-organisms with deregulated threonine dehydratase," Patent: WO 9519442-A 5 Jul. 20, 1995 |
| AB003132 | murC; ftsQ; ftsZ | | Kobayashi, M. et al. "Cloning, sequencing, and characterization of the ftsZ gene from coryneform bacteria," Biochem. Biophys. Res. Commun., 236(2):383–388 (1997) |
| AB015023 | murC; ftsQ | | Wachi, M. et al. "A murC gene from Coryneform bacteria," Appl. Microbiol. Biotechnol., 51(2):223–228 (1999) |
| AB018530 | dtsR | | Kimura, E. et al. "Molecular cloning of a novel gene, dtsR, which rescues the detergent sensitivity of a mutant derived from *Brevibacterium lactofermentum*," Biosci. Biotechnol. Biochem., 60(10):1565–1570 (1996) |
| AB018531 | dtsR1; dtsR2 | | |
| AB020624 | murI | D-glutamate racemase | |
| AB023377 | tkt | transketolase | |
| AB024708 | gltB; gltD | Glutamine 2-oxoglutarate aminotransferase large and small subunits | |
| AB025424 | acn | aconitase | |
| AB027714 | rep | Replication protein | |
| AB027715 | rep; aad | Replication protein; aminoglycoside adenyltransferase | |
| AF005242 | argC | N-acetylglutamate-5-semialdehyde dehydrogenase | |
| AF005635 | glnA | Glutamine synthetase | |
| AF030405 | hisF | cyclase | |
| AF030520 | argG | Argininosuccinate synthetase | |
| AF031518 | argF | Ornithine carbamoyltransferase | |
| AF036932 | aroD | 3-dehydroquinate dehydratase | |
| AF038548 | pyc | Pyruvate carboxylase | |
| AF038651 | dciAE; apt; rel | Dipeptide-binding protein; adenine phosphoribosyltransferase; GTP pyrophosphokinase | Wehmeier, L. et al. "The role of the *Corynebacterium glutamicum* rel gene in (p)ppGpp metabolism," Microbiology, 144:1853–1862 (1998) |
| AF041436 | argR | Arginine repressor | |
| AF045998 | impA | Inositol monophosphate phosphatase | |
| AF048764 | argH | Argininosuccinate lyase | |
| AF049897 | argC; argJ; arbB; argD; argF; argR; argG; argH | N-acetylglutamylphosphate reductase; ornithine acetyltransferase; N-acetylglutamate kinase; acetylornithine transminase; ornithine carbamoyltransferase; arginine repressor; argininosuccinate synthase; argininosuccinate lyase | |
| AF050109 | inhA | Enoyl-acyl carrier protein reductase | |
| AF050166 | hisG | ATP phosphoribosyltransferase | |
| AF051846 | hisA | Phosphoribosylformimino-5-amino-1-phosphoribosyl-4-imidazolecarboxamide isomerase | |
| AF052652 | metA | Homoserine O-acetyltransferase | Park, S. et al. "Isolation and analysis of metA, a methionine biosynthetic gene encoding homoserine acetyltransferase in *Corynebacterium glutamicum*," Mol. Cells., 8(3):286–294 (1998) |
| AF053071 | aroB | Dehydroquinate synthetase | |
| AF060558 | hisH | Glutamine amidotransferase | |
| AF086704 | hisE | Phosphoribosyl-ATP-pyrophosphohydrolase | |
| AF114233 | aroA | 5-enolpyruvylshikimate 3-phosphate synthase | |
| AF116184 | panD | L-aspartate-alpha-decarboxylase precursor | Dusch, N. et al. "Expression of the *Corynebacterium glutamicum* panD gene encoding L-aspartate-alpha-decarboxylase leads to pantothenate overproduction in *Escherichia coli*," Appl. Environ. Microbiol., 65(4)1530–1539 (1999) |
| AF124518 | aroD; aroE | 3-dehydroquinase; shikimate dehydrogenase | |
| AF124600 | aroC; aroK; aroB; pepQ | Chorismate synthase; shikimate kinase; 3-dehydroquinate synthase; putative cytoplasmic peptidase | |
| AF145897 | inhA | | |
| AF145898 | inhA | | |

TABLE 2-continued

GENES IDENTIFIED FROM GENBANK

| GenBank™ Accession No. | Gene Name | Gene Function | Reference |
|---|---|---|---|
| AJ001436 | ectP | Transport of ectoine, glycine betaine, proline | Peter, H. et al. "*Corynebacterium glutamicum* is equipped with four secondary carriers for combatible solutes: Identification, sequencing, and characterization of the proline/ectoine uptake systems, ProP, and the ectoine/proline/glycine betaine carrier, EctP," J. Baceriol., 180(22):6005–6012 (1998) |
| AJ004934 | dapD | Tetrahydrodipicolinate succinylase (incomplete[i]) | Wehrmann, A. et al "Different modes of diaminopimelate synthesis and their role in cell wall integrity: A study with *Corynebacterium glutamicum*," J. Bacteriol., 180(12):3159–3165 (1998) |
| AJ007732 | pcp; secG; amt; ocd; soxA | Phosphoenolpyruvate-carboxylase; ?; high affinity ammonium uptake protein; putative ornithine-cyclodecarboxylase; sarcosine oxidase | |
| AJ010319 | ftsY, glnB, glnD; srp; amtP | Ivnolved in cell division; PII protein; uridylyltransferase (uridylyl-removing enzyme); signal recognition particle; low affinity ammonium uptake protein | Jakoby, M. et al. "Nitrogen regulation in *Corynebacterium glutamicum*; Isolation of genes involved in biochemical characterization of corresponding proteins," FEMS Microbiol., 173(2):303–310 (1999) |
| AJ132968 | cat | Chloramphenicol aceteyl transferase | |
| AJ224946 | mqo | L-malate: quinone oxidoreductase | Molenaar, D. et al. "Biochemical and genetic characterization of the membrane-associated malate dehydrogenase (acceptor) from *Corynebacterium glutamicum*," Eur. J. Biochem., 254(2):395–403 (1998) |
| AJ238250 | ndh | NADH dehydrogenase | |
| AJ238703 | porA | Porin | Lichtinger, T. et al. "Biochemical and biophysical characterization of the the cell wall porin of *Corynebacterium glutamicum*: The channel is formed by a low molecular mass polypeptide," Biochemistry, 37(43):15024–15032 (1998) |
| D17429 | | Transposable element IS31831 | Vertes, A. A. et al. "Isolation and characterizaton of IS31831, a transposable element from *Corynebacterium glutamicum*," Mol. Microbiol., 11(4):739–746 (1994) |
| D84102 | odhA | 2-oxoglutarate dehydrogenase | Usuda, Y. et al. "Molecular cloning of the *Corynebacterium glutamicum* (*Brevibacterium lactofermentum* AJ12036) odhA gene encoding a novel type of 2-oxoglutarate dehydrogenase," Microbiology, 142:3347–3354 (1996) |
| E01358 | hdh; hk | Homoserine dehydrogenase; homoserine kinase | Katsumata, R. et al. "Production of L-thereonine and L-isoleucine," Patent: JP 1987232392-A 1 Oct. 12, 1987 |
| E01359 | | Upstream of the start codon of homoserine kinase gene | Katsumata, R. et al. "Production of L-thereonine and L-isoleucine," Patent: JP 1987232392-A 2 Oct. 12, 1987 |
| E01375 | | Tryptophan operon | |
| E01376 | trpL; trpE | Leader peptide; anthranilate synthase | Matsui, K. et al. "Tryptophan operon, peptide and protein coded thereby, utilization of tryptophan operon gene expression and production of tryptophan," Patent: JP 1987244382-A 1 Oct. 24, 1987 |
| E01377 | | Promoter and operator regions of tryptophan operon | Matsui, K. et al. "Tryptophan operon, peptide and protein coded thereby, utilizaton of tryptophan operon gene expression and production of tryptophan," Patent: JP 1987244382-A 1 Oct. 24, 1987 |
| E03937 | | Biotin-synthase | Hatakeyama, K. et al. "DNA fragment containing gene capable of coding biotin synthetase and its utilization," Patent: JP 1992278088-A 1 Oct. 2, 1992 |
| E04040 | | Diamino pelargonic acid aminotransferase | Kohama, K. et al. "Gene coding diaminopelargonic acid aminotransferase and desthiobiotin synthetase and its utilization," Patent: JP 1992330284-A 1 Nov. 18, 1992 |
| E04041 | | Desthiobiotinsynthetase | Kohama, K. et al. "Gene coding diaminopelargonic acid aminotransferase and desthiobiotin synthetase and its utilization," Patent: JP 1992330284-A 1 Nov. 18, 1992 |
| E04307 | | Flavum aspartase | Kurusu, Y. et al. "Gene DNA coding aspartase and utilization thereof," Patent: JP 1993030977-A 1 Feb. 9, 1993 |
| E04376 | | Isocitric acid lyase | Katsumata, R. et al. "Gene manifestation controlling DNA," Patent: JP 1993056782-A 3 Mar. 9, 1993 |
| E04377 | | Isocitric acid lyase N-terminal fragment | Katsumata, R. et al. "Gene manifestation controlling DNA," Patent: JP 1993056782-A 3 Mar. 9, 1993 |
| E04484 | | Prephenate dehydratase | Sotouchi, N. et al. "Production of L-phenylalanine by fermentation," Patent: JP 1993076352-A 2 Mar. 30, 1993 |
| E05108 | | Aspartokinase | Fugono, N. et al. "Gene DNA coding Aspartokinase and its use," Patent: JP 1993184366-A 1 Jul. 27, 1993 |
| E05112 | | Dihydro-dipichorinate synthetase | Hatakeyama, K. et al. "Gene DNA coding dihydrodipicolinic acid synthetase and its use," Patent: JP 1993184371-A 1 Jul 27, 1993 |
| E05776 | | Diaminopimelic acid dehydrogenase | Kobayashi, M. et al. "Gene DNA coding Diaminopimelic acid dehydrogenase and its use," Patent: JP 1993284970-A 1 Nov. 2, 1993 |
| E05779 | | Threonine synthase | Kohama, K. et al. "Gene DNA coding threonine synthase and its use," Patent: JP 1993284972-A 1 Nov. 2, 1993 |
| E06110 | | Prephenate dehydratase | Kikuchi, T. et al. "Production of L-phenylalanine by fermentation method," Patent: JP 1993344881-A 1 Dec. 27, 1993 |
| E06111 | | Mutated Prephenate dehydratase | Kikuchi, T. et al. "Production of L-phenylalanine by fermentation method," Patent: JP 1993344881-A 1 Dec. 27, 1993 |
| E06146 | | Acetohydroxy acid synthetase | Inui, M. et al. "Gene capable of coding Acetohydroxy acid synthetase and its use," Patent: JP 1993344893-A 1 Dec. 27, 1993 |
| E06825 | | Aspartokinase | Sugimoto, M. et al. "Mutant aspartokinase gene," patent: JP 1994062866-A 1 Mar. 8, 1994 |

TABLE 2-continued

GENES IDENTIFIED FROM GENBANK

| GenBank ™ Accession No. | Gene Name | Gene Function | Reference |
|---|---|---|---|
| E06826 | | Mutated aspartokinase alpha subunit | Sugimoto, M. et al. "Mutant aspartokinase gene," patent: JP 1994062866-A 1 Mar. 8, 1994 |
| E06827 | | Mutated aspartokinase alpha subunit | Sugimoto, M. et al. "Mutant aspartokinase gene," patent: JP 1994062866-A 1 Mar. 8, 1994 |
| E07701 | secY | | Honno, N. et al. "Gene DNA participating in integration of membraneous protein to membrane," Patent: JP 1994169780-A 1 Jun. 21, 1994 |
| E08177 | | Aspartokinase | Sato, Y. et al. "Genetic DNA capable of coding Aspartokinase released from feedback inhibition and its utilization," Patent: JP 1994261766-A 1 Sep. 20, 1994 |
| E08178, E08179, E08180, E08181, E08182 | | Feedback inhibition-released Aspartokinase | Sato, Y. et al. "Genetic DNA capable of coding Aspartokinase released from feedback inhibition and its utilization," Patent: JP 1994261766-A 1 Sep. 20, 1994 |
| E08232 | | Acetohydroxy-acid isomeroreductase | Inui, M. et al. "Gene DNA coding acetohydroxy acid isomeroreductase," Patent: JP 1994277067-A 1 Oct. 4, 1994 |
| E08234 | secE | | Asai, Y. et al. "Gene DNA coding for translocation machinery of protein," Patent: JP 1994277073-A 1 Oct. 4, 1994 |
| E08643 | | FT aminotransferase and desthiobiotin synthetase promoter region | Hatakeyama, K. et al. "DNA fragment having promoter function in coryneform bacterium," Patent: JP 1995031476-A 1 Feb. 3, 1995 |
| E08646 | | Biotin synthetase | Hatakeyama, K. et al. "DNA fragment having promoter function in coryneform bacterium," Patent: JP 1995031476-A 1 Feb. 3, 1995 |
| E08649 | | Aspartase | Kohama, K. et al "DNA fragment having promoter function in coryneform bacterium," Patent: JP 1995031478-A 1 Feb. 3, 1995 |
| E08900 | | Dihydrodipicolinate reductase | Madori, M. et al. "DNA fragment containing gene coding Dihydrodipicolinate acid reductase and utilization thereof," Patent: JP 1995075578-A 1 Mar. 20, 1995 |
| E08901 | | Diaminopimelic acid decarboxylase | Madori, M. et al. "DNA fragment containing gene coding Diaminopimelic acid decarboxylase and utilization thereof," Patent: JP 1995075579-A 1 Mar. 20, 1995 |
| E12594 | | Serine hydroxymethyltransferase | Hatakeyama, K. et al. "Production of L-trypophan," Patent: JP 1997028391-A 1 Feb. 4, 1997 |
| E12760, E12759, E12758 | | transposase | Moriya, M. et al. "Amplifications of gene using artificial transposon," Patent: JP 1997070291-A Mar. 18, 1997 |
| E12764 | | Arginyl-tRNA synthetase; diaminopimelic acid decarboxylase | Moriya, M. et al. "Amplification of gene using artificial transposon," Patent: JP 1997070291-A Mar. 18, 1997 |
| E12767 | | Dihydrodipicolinic acid synthetase acid decarboxylase | Moriya, M. et al. "Amplification of gene using artificial transposon," Patent: JP 1997070291-A Mar. 18, 1997 |
| E12770 | | aspartokinase | Moriya, M. et al. "Amplification of gene using artificial transposon," Patent: JP 1997070291-A Mar. 18, 1997 |
| E12773 | | Dihydrodipicolinic acid reductase | Moriya, M. et al. "Amplification of gene using artificial transposon," Patent: JP 1997070291-A Mar. 18, 1997 |
| E13655 | | Glucose-6-phosphate dehydrogenase | Hatakeyama, K. et al. "Glucose-6-phosphate dehydrogenase and DNA capable of coding the same," Patent: JP 1997224661-A 1 Sep. 2, 1997 |
| L01508 | IlvA | Threonine dehydratase | Moeckel, B. et al. "Functional and structural analysis of the threonine dehydratase of *Corynebacterium glutamicum*," J. Bacteriol., 174:8065–8072 (1992) |
| L07603 | EC 4.2.1.15 | 3-deoxy-D-arabinoheptulosonate-7-phosphate synthase | Chen, C. et al. "The cloning and nucleotide sequence of *Corynebacterium glutamicum* 3-deoxy-D-arabinoheptulosonate-7-phosphate synthase gene," FENS Microbiol. Lett., 107:223–230 (1993) |
| L09232 | IlvB; ilvN; ilvC | Acetohydroxy acid synthase large subunit; Acetohydroxy acid synthase small subunit; Acetohydroxy acid isomeroreductase | Keilhauer, C. et al. "Isoleucine synthesis in *Corynebacterium glutamicum*: molecular analysis of the ilvB-ilvN-ilvC operon," J. Bacteriol., 175(17):5595–5603 (1993) |
| L18874 | PtsM | Phosphoenolpyruvate sugar phosphotransferase | Fouet, A et al. "*Bacillus subtilis* sucrose-specific enzyme II of the phosphotransferase system: expression in *Escherichia coli* and homology to enzymes II from enteric bacteria," PNAS USA, 84(24):8773–8777 (1987); Lee, J. K. et al. "Nucleotide sequence of the gene encoding the *Corynebacterium glutamicum* mannose enzyme II and analyses of the deduced protein sequence," FEMS Microbiol. Lett., 119(1–2):137–145 (1994) |
| L27123 | aceB | Malate synthase | Lee, H-S. et al. "Molecular characterization of aceB, a gene encoding malate synthase in *Corynebacterium glutamicum*," J. Microbiol. Biotechnol., 4(4):256–263 (1994) |
| L27126 | | Pyruvate kinase | Jetten, M. S. et al. "Structural and functional analysis of pyruvate kinase from *Corynebacterium glutamicum*," Appl. Environ. Microbiol., 60(7):2501–2507 (1994) |
| L28760 | aceA | Isocitrate lyase | |
| L35906 | dtxr | Diphtheria toxin repressor | Oguiza, J. A. et al. "Molecular cloning, DNA sequence analysis, and characterization of the *Corynebacterium diptheriae* dtxR from *Brevibacterium lactofermentum*," J. Bacteriol., 177(2):465–467 (1995) |
| M13774 | | Prephenate dehydratase | Follettie, M. T. et al. "Molecular cloning and nucleotide sequence of the *Corynebacterium glutamicum* pheA gene," J. Bacteriol., 167:695–702 (1986) |

TABLE 2-continued

GENES IDENTIFIED FROM GENBANK

| GenBank™ Accession No. | Gene Name | Gene Function | Reference |
|---|---|---|---|
| M16175 | 5S rRNA | | Park, Y-H. et al. "Phylogenetic analysis of the coryneform bacteria by 5S rRNA sequences," J. Bacteriol., 169:1801–1806 (1987) |
| M16663 | trpE | Anthranilate synthase, 5' end | Sano, K. et al. "Structure and function of the trp operon control regions of Brevibacterium lactofermentum, a glutamic-acid-producing bacterium," Gene, 52:191–200 (1987) |
| M16664 | trpA | Tryptophan synthase, 3' end | Sano, K. et al. "Structure and function of the trp operon control regions of Brevibacterium lactfermentun, a glutamic-acid-producing bacterium," Gene, 52:191–200 (1987) |
| M25819 | | Phosphoenolpyruvate carboxylase | O'Regan, M. et al. "Cloning and nucleotide sequence of the Phosphoenolpyruvate carboxylase-coding gene of Corynebacterium glutamicum ATCC13032," Gene, 77(2):237–251 (1989) |
| M85106 | | 23S rRNA gene insertion sequence | Roller, C. et al. "Gram-positive bacteria with a high DNA G + C content are characterized by a common insertion within their 23S rRNA genes," J. Gen. Microbiol., 138:1167–1175 (1992) |
| M85107, M85108 | | 23S rRNA gene insertion sequence | Roller, C. et al. "Gram-positive bacteria with a high DNA G + C content are characterized by a common insertion within their 23S rRNA genes," J. Gen. Microbiol., 138:1167–1175 (1992) |
| M89931 | aecD; brnQ; yhbw | Beta C—S lyase; branched-chain amino acid uptake carrier; hypothetical protein yhbw | Rossol, I. et al. "The Corynebacterium glutamicum aecD gene encodes a C—S lyase with alpha, beta-elimination activity that degrades aminoethylcystein," J. Bacteriol., 174(9):2968–2977 (1992); Tauch, A. et al. "Isoleucine uptake in Corynebacterium glutamicum ATCC 13032 is directed by the brnQ gene product," Arch. Microbiol., 169(4):303–312 (1998) |
| S59299 | trp | Leader gene (promoter) | Herry, D. M. et al. "Cloning of the trp gene cluster from a tryptophan-hyperproducing strain of Corynebacterium glutamicum: identification of a mutation in the trp leader sequence," Appl. Environ. Microbiol., 59(3):791–799 (1993) |
| U11545 | trpD | Anthranilate phosphoribosyltransferase | O'Gara, J. P. and Dunican, L. K. (1994) Complete nucleotide sequence of the Corynebacterium glutamicum ATCC 21850 tpD gene." Thesis, Microbiology Department, University College Galway, Ireland. |
| U13922 | cglIM; cglIR; clgIIR | Putative type II 5-cytosine methyltransferase; putative type II restriction endonuclease; putative type I or type III restriction endonuclease | Schafer, A. et al. "Cloning and characterization of a DNA region encoding a stress-sensitive restriction system from Corynebacterium glutamicum ATCC 13032 and analysis of its role in intergeneric conjugation with Escherichia coli," J. Bacteriol., 176(23):7309–7319 (1994); Schafer, A. et al. "The Corynebacterium glutamicum cglIM gene encoding a 5-cytosine in an McrBC-deficient Escherichia coli strain," Gene, 203(2):95–101 (1997) |
| U14965 | recA | | |
| U31224 | ppx | | Ankri, S. et al. "Mutations in the Corynebacterium glutamicumproline biosynthetic pathway: A natural bypass of the proA step," J. Bacteriol., 178(15):4412–4419 (1996) |
| U31225 | proC | L-proline: NADP+ 5-oxidoreductase | Ankri, S. et al. "Mutations in the Corynebacterium glutamicumproline biosynthetic pathway: A natural bypass of the proA step," J. Bacteriol., 178(15):4412–4419 (1996) |
| U31230 | obg; proB; unkdh | ?; gamma glutamyl kinase; similar to D-isomer specific 2-hydroxyacid dehydrogenases | Ankri, S. et al. "Mutations in the Corynebacterium glutamicumproline biosynthetic pathway: A natural bypass of the proA step," J. Bacteriol., 178(15):4412–4419 (1996) |
| U31281 | bioB | Biotin synthase | Serebriiskii, I. G., "Two new members of the bio B superfamily: Cloning, sequencing and expression of bio B genes of Methylobacillus flagellatum and Corynebacterium glutamicum," Gene, 175:15–22 (1996) |
| U35023 | thtR; accBC | Thiosulfate sulfurtransferase; acyl CoA carboxylase | Jager, W. et al. "A Corynebacterium glutamicum gene encoding a two-domain protein similar to biotin carboxylases and biotin-carboxyl-carrier proteins," Arch. Microbiol., 166(2):76–82 (1996) |
| U43535 | cmr | Multidrug resistance protein | Jager, W. et al. "A Corynebacterium glutamicum gene conferring multidrug resistance in the heterologous hose Escherichia coli," J. Bacteriol., 179(7):2449–2451 (1997) |
| U43536 | clpB | Heat shock ATP-binding protein | |
| U53587 | aphA-3 | 3'5"-aminoglycoside phosphotransferase | |
| U89648 | | Corynebacterium glutamicum unidentified sequence involved in histidine biosynthesis, partial sequence | |
| X04960 | trpA; trpB; trpC; trpD; trpE; trpG; trpL | Tryptophan operon | Matsui, K. et al. "Complete nucleotide and deduced amino acid sequences of the Brevibacterium lactofermentum tryptophan operon," Nucleic Acids Res., 14(24):10113–10114 (1986) |
| X07563 | lys A | DAP decarboxylase (meso-diaminopimelate decarboxylase, EC 4.1.1.20) | Yeh, P. et al. "Nucleic sequence of the lysA gene of Corynebacterium glutamicum and possible mechanisms for modulation of its expression," Mol. Gen. Genet., 212(1):112–119 (1988) |
| X14234 | EC 4.1.1.31 | Phosphoenolpyruvate carboxylase | Eikmanns, B. J. et al. "The Phosphoenolpyruvate carboxylase gene of Corynebacterium glutamicum: Molecular cloning, nucleotide sequence, and expression," Mol. Gen. Genet., 218(2):330–339 (1989); Lepiniec, L. et al. "Sorghum Phosphoenolpyruvate carboxylase gene family: structure, function and molecular evolution," Plant. Mol. Biol., 21(3):487–502 (1993) |

TABLE 2-continued

GENES IDENTIFIED FROM GENBANK

| GenBank™ Accession No. | Gene Name | Gene Function | Reference |
|---|---|---|---|
| X17313 | fda | Fructose-bisphosphate aldolase | Von der Osten, C. H. et al. "Molecular cloning, nucleotide sequence and fine-structural analysis of the *Corynebacterium glutamicum* fda gene: structural comparison of *C. glutamicum* fructose-1,6-biphosphate aldolase to class I and class II aldolases," Mol. Microbiol., |
| X53993 | dapA | L-2,3-dihydrodipicolinate synthetase (EC 4.2.1.52) | Bonnassie, S. et al. "Nucleic sequence of the dapA gene from *Corynebacterium glutamicum*," Nucleic Acids Res., 18(21):6421 (1990) |
| X54223 | | AttB-related site | Cianciotto, N. et al. "DNA sequence homology between att B-related sites of *Corynebacterium diptheriae*, *Corynebacterium ulcerans*, *Corynebacterium glutamicum*, and the attP site of lambdacorynephage," FEMS. Microbiol, Lett., 66:299–302 (1990) |
| X54740 | argS; lysA | Arginyl-tRNA synthetase; Diaminopimelate decarboxylase | Marcel, T. et al. "Nucleotide sequence and organization of the upstream region of the *Corynebacterium glutamicum* lysA gene," Mol. Microbiol., 4(11):1819–1830 (1990) |
| X55994 | trpL; trpE | Putative leader peptide; anthranilate synthase component 1 | Heery, D. M. et al. "Nucleotide sequence of the *Corynebacterium glutamicum* trpE gene," Nucleic Acids Res., 18(23):7138 (1990) |
| X56037 | trhC | Threonine synthase | Han, K. S. et al. "The molecular structure of the *Corynebacterium glutamicum* threonine synthase gene," Mol. Microbiol., 4(10):1693–1702 (1990) |
| X56075 | attB-related site | Attachment site | Cianciotto, N. et al. "DNA sequence homology between att B-related sites of *Corynebacterium diphtheriae*, *Corynebacterium ulcerans*, *Corynebacterium glutamicum*, and the attP site of lambdacorynephage," FEMS. Micorbiol, Lett., 66:299–302 (1990) |
| X57226 | lysC-alpha; lysC-beta; asd | Aspartokinase-alpha subunit; Aspartokinase-beta subunit; aspartate beta semialdehyde dehydrogenase | Kalinowski, J. et al. "Genetic and biochemical analysis of the Aspartokinase from *Corynebacterium glutamicum*," Mol. Microbiol., 5(5):1197–1204 (1991); Kalinowski, J. et al. "Aspartokinase genes lysC alpha and lysC beta overlap and are adjacent to the aspertate beta-semialdehyde dehydrogenase gene asd in *Corynebacterium glutamicum*," Mol. Gen. Genet., 224(3): 317–324 (1990) |
| X59403 | gap; pgk; tpi | Glyceraldehyde-3-phosphate; phosphoglycerate kinase; triosephosphate isomerase | Eikmanns, B. J. "Identification, sequence analysis, and expression of a *Corynebacterium glutamicum* gene cluster enoding the three glycolytic enzymes glyceraldehyde-3-phosphate dehydrogenase, 3-phosphoglycerate kinase, and triosephosphate isomeras," J. Bacteriol., 174(19):6076–6086 (1992) |
| X59404 | gdh | Glutamate dehydrogenase | Bormann, E. R. et al. "Molecular analysis of the *Corynebacterium glutamicum* gdh gene encoding glutamate dehydrogenase," Mol. Microbiol., 6(3):317–326 (1992) |
| X60312 | lysI | L-lysine permease | Seep-Feldhaus, A. H. et al. "Molecular analysis of the *Corynebacterium glutamicum* lysI gene involved in lysine uptake," Mol. Microbiol., 5(12):2995–3005 (1991) |
| X66078 | cop1 | Ps1 protein | Joliff, G. et al. "Cloning and nucleotide sequence of the csp1 gene encoding PS1, one of the two major secreted proteins of *Corynebacterium glutamicum*: The deduced N-terminal region of PS1 is similar to the *Mycobacterium* antigen 85 complex," Mol. Microbiol., 6(16):2349–2362 (1992) |
| X66112 | glt | Citrate synthase | Eikmanns, B. J. et al. "Cloning sequence, expression and transcriptional analysis of the *Corynebacterium glutamicum* gltA gene encoding citrate synthase," Microbiol., 140:1817–1828 (1994) |
| X67737 | dapB | Dihydrodipicolinate reductase | |
| X69103 | csp2 | Surface layer protein PS2 | Peyret, J. L. et al. "Characterization of the cspB gene encoding PS2, an ordered surface-layer protein in *Corynebacterium glutamicum*," Mol. Microbiol., 9(1):97–109 (1993) |
| X69104 | | IS3 related insertion element | Bonamy, C. et al. "Identification of IS1206, a *Corynebacterium glutamicum* IS3-related insertion sequence and phylogenetic analysis," Mol. Microbiol., 14(3):571–581 (1994) |
| X70959 | leuA | Isopropylmalate synthase | Patek, M. et al. "Leucine synthesis in *Corynebacterium glutamicum*: enzyme activities, structure of leuA, and effect of leuA inactivation on lysine synthesis," Appl. Environ. Microbiol., 60(1):133–140 (1994) |
| X71489 | icd | Isocitrate dehydrogenase (NADP+) | Eikmanns, B. J. et al. "Cloning sequence analysis, expression, and inactivation of the *Corynebacterium glutamicum* icd gene encoding isocitrate dehydrogenase and biochemical characterization of the enzyme," J. Bacteriol., 177(3):774–782 (1995) |
| X72855 | GDHA | Glutamate dehydrogenase (NADP+) | |
| X75083, X70584 | mtrA | 5-methyltryptophan resistance | Heery, D. M. et al. "A sequence from a tryptophan-hyperproducing strain of *Corynebacterium glutamicum* encoding resistance to 5-methyltryptophan," Biochem. Biophys. Res. Commun., 201(3):1255–1262 (1994) |
| X75085 | recA | | Fitzpatrick, R. et al. "Construction and characterization of recA mutant strains of *Corynebacterium glutamicum* and *Brevibacterium lactofermentum*," Appl. Microbiol. Biotechnol., 42(4):575–580 (1994) |
| X75504 | aceA; thiX | Partial Isocitrate lyase; ? | Reicheid, D. J. et al. "Characterization of the isocitrate lyase gene from *Corynebacterium glutamicum* and biochemical analysis of the enzyme," J. Bacteriol., 176(12):3474–3483 (1994) |
| X76875 | | ATPase beta-subunit | Ludwig, W. et al. "Phylogenetic relationships of bacteria based on comparative sequence analysis of elongation factor Tu and ATP-synthase beta-subunit genes," Antonie Van Leeuwenhoek, 64:285–305 (1993) |

TABLE 2-continued

GENES IDENTIFIED FROM GENBANK

| GenBank ™ Accession No. | Gene Name | Gene Function | Reference |
|---|---|---|---|
| X77034 | tuf | Elongation factor Tu | Ludwig, W. et al. "Phylogenetic relationships of bacteria based on comparative sequence analysis of elongation factor Tu and ATP-synthase beta-subunit genes," Antonie Van Leeuwenhoek, 64:285–305 (1993) |
| X77384 | recA | | Billman-Jacobe, H. "Nucleotide sequence of a recA gene from *Corynebacterium glutamicum*," DNA Seq., 4(6):403–404 (1994) |
| X78491 | aceB | Malate synthase | Reinscheid, D. J. et al. "Malate synthase from *Corynebacterium glutamicum* pta-ack operon encoding phosphotransacetylase: sequence analysis," Microbiology. 140:3099–3108 (1994) |
| X80629 | 16S rDNA | 16S ribosomal RNA | Rainey, F. A. et al. "Phylogenetic analysis of the genera *Rhodococcus* and *Norcardia* and evidence for the evolutionary origin of the genus *Norcardia* from within the radiation of *Rhodococcus* species," Microbiol., 141:523–528 (1995) |
| X81191 | gluA; gluB; gluC; gluD | Glutamate uptake system | Kronemeyer, W. et al. "Structure of the gluABCD cluster encoding the glutamate uptake system of *Corynebacterium glutamicum*," J. Bacteriol., 177(5):1152–1158 (1995) |
| X81379 | dapE | Succinyldiaminopimelate desuccinylase | Wehrmann, A. et al. "Analysis of different DNA fragments of *Corynebacterium glutamicum* complementing dapE of *Escherichia coli*," Microbiology, 40:3349–56 (1994) |
| X82061 | 16S rDNA | 16S ribosomal RNA | Ruimy, R. et al. "Phylogeny of the genus *Corynebacterium* deduced from analyses of small-subunit ribosomal DNA sequences," Int. J. Syst. Bacteriol., 45(4):740–746 (1995) |
| X82928 | asd; lysC | Aspartate-semialdehyde dehydrogenase; ? | Serebrijski, I. et al. "Multicopy suppression by asd gene and osmotic stress-dependent complementation by heterologous proA in proA mutants," J. Bacteriol., 177(24):7255–7260 (1995) |
| X82929 | proA | Gamma-glutamyl phosphate reductase | Serebrijski, I. et al. "Multicopy suppression by asd gene and osmotic stress-dependent complementation by heterologous proA in proA mutants," J. Bacteriol., 177(24):7255–7260 (1995) |
| X84257 | 16S rDNA | 16S ribosomal RNA | Pascual, C. et al. "Phylogenetic analysis of the genus *Corynebacterium* based on 16S rRNA gene sequences," Int. J. Syst. Bacteriol., 45(4):724–728 (1995) |
| X85965 | aroP; dapE | Aromatic amino acid permease; ? | Wehrmann, A. et al. "Functional anaylsis of sequences adjacent to dapE of *Corynebacterium glutamicumproline* reveals the presence of aroP, which encodes the romatic amino acid transporter," J. Bacteriol., 177(20):5991–5993 (1995) |
| X86157 | argB; argC; argD; argF; argJ | Acetylglutamate kinase; N-acetyl-gamma-glutamyl-phosphate reductase; acetylornithine aminotransferase; ornithine carbamoyltransferase; glutamate N-acetyltransferase | Sakanyan, V. et al. "Genes and enzymes of the acetyl cycle of arginine biosynthesis in *Corynebacterium glutamicum*: enzyme evolution in the early steps of the arginine pathway," Microbiology, 142:99–108 (1996) |
| X89084 | pta; ackA | Phosphate acetyltransferase; acetate kinase | Reinscheid, D. J. et al. "Cloning, sequence analysis, expression and inactivation of the *Corynebacterium glutamicum* pta-ack operon encoding phosphotransacetylase and acetate kinase," Microbiology, 145:503–513 (1999) |
| X89850 | attB | Attachment site | Le Marrec, C. et a. "Genetic characterization of site-specific integration functions of phi AAU2 infecting "*Arthrobacter aureus* C70," J. Bacteriol., 178(7):1996–2004 (1996) |
| X90356 | | Promoter fragment F1 | Patek, M. et al. "Promoters from *Corynebacterium glutamicum*: cloning, molecular analysis and search for a consensus motif," Microbiology, 142:1297–1309 (1996) |
| X90357 | | Promoter fragment F2 | Patek, M. et al. "Promoters from *Corynebacterium glutamicum*: cloning, molecular analysis and search for a consensus motif," Microbiology, 142:1297–1309 (1996) |
| X90358 | | Promoter fragment F10 | Patek, M. et al. "Promoters from *Corynebacterium glutamicum*: cloning, molecular analysis and search for a consensus motif," Microbiology, 142:1297–1309 (1996) |
| X90359 | | Promoter fragment F13 | Patek, M. et al. "Promoters from *Corynebacterium glutamicum*: cloning, molecular analysis and search for a consensus motif," Microbiology, 142:1297–1309 (1996) |
| X90360 | | Promoter fragment F22 | Patek, M. et al. "Promoters from *Corynebacterium glutamicum*: cloning, molecular analysis and search for a consensus motif," Microbiology, 142:1297–1309 (1996) |
| X90361 | | Promoter fragment F34 | Patek, M. et al. "Promoters from *Corynebacterium glutamicum*: cloning, molecular analysis and search for a consensus motif," Microbiology, 142:1297–1309 (1996) |
| X90362 | | Promoter fragment F37 | Patek, M. et al. "Promoters from *Corynebacterium glutamicum*: cloning, molecular analysis and search for a consensus motif," Microbiology, 142:1297–1309 (1996) |
| X90363 | | Promoter fragment F45 | Patek, M. et al. "Promoters from *Corynebacterium glutamicum*: cloning, molecular analysis and search for a consensus motif," Microbiology, 142:1297–1309 (1996) |
| X90364 | | Promoter fragment F64 | Patek, M. et al. "Promoters from *Corynebacterium glutamicum*: cloning, molecular analysis and search for a consensus motif," Microbiology, 142:1297–1309 (1996) |

TABLE 2-continued

GENES IDENTIFIED FROM GENBANK

| GenBank™ Accession No. | Gene Name | Gene Function | Reference |
|---|---|---|---|
| X90365 | | Promoter fragment F75 | Patek, M. et al. "Promoters from *Corynebacterium glutamicum*: cloning, molecular analysis and search for a consensus motif," Microbiology, 142:1297–1309 (1996) |
| X90366 | | Promoter fragment PF101 | Patek, M. et al. "Promoters from *Corynebacterium glutamicum*: cloning, molecular analysis and search for a consensus motif," Microbiology, 142:1297–1309 (1996) |
| X90367 | | Promoter fragment PF104 | Patek, M. et al. "Promoters from *Corynebacterium glutamicum*: cloning, molecular analysis and search for a consensus motif," Microbiology, 142:1297–1309 (1996) |
| X90368 | | Promoter fragment PF109 | Patek, M. et al. "Promoters from *Corynebacterium glutamicum*: cloning, molecular analysis and search for a consensus motif," Microbiology, 142:1297–1309 (1996) |
| X93513 | amt | Ammonium trnasport system | Siewe, R. M. et al. "Functional and genetic characterization of the (methyl) ammonium uptake carrier of *Corynebacterium glutamicum*," J. Biol. Chem., 271(10):5398–5403 (1996) |
| X93514 | betP | Glycine betaine transport system | Peter, H. et al. "Isolation, characterization, and expression of the *Corynebacterium glutamicum* betP gene, encoding the transport system for the compatible solute glycine betaine," J. Bacteriol., 178(17):5229–5234 (1996) |
| X95649 | orf4 | | Patek, M. et al. "Identification and transcriptional analysis of the dapB-ORF2-dapA-ORF4 operon of *Corynebacterium glutamicum*, encoding two enzymes involved in L-lysine synthesis," Biotechnol. Lett., 19:1113–1117 (1997) |
| X96471 | lysE; lysG | Lysine exporter protein; Lysine export regulator protein | Vrljic, M. et al. "A new type of transporter with a new type of cellular function: L-lysine export from *Corynebacterium glutamicum*," Mol. Microbiol., 22(5):815–826 (1996) |
| X96580 | panB; panC; xylB | 3-methyl-2-oxobutanoate hydroxymethyltransferase; pantoate-beta-alanine ligase; xylulokinase | Sahm, H. et al. "D-pantothenate synthesis in *Corynebacterium glutamicum* and use of panBC and genes encoding L-valine synthesis for D-pantothenate overproduction," Appl. Environ. Microbiol., 65(5):1973–1979 (1999) |
| X96962 | | Insertion sequence IS1207 and transposase | |
| X99289 | | Elongation factor P | Ramos, A. et al. "Cloning, sequencing and expression of the gene encoding elongation factor P in the amino-acid producer *Brevibacterium lactofermentum* (*Corynebacterium glutamicum* ATCC 13869)," Gene, 198:217–222 (1997) |
| Y00140 | thrB | Homoserine kinase | Mateos, L. M. et al. "Nucleotide sequence of the homoserine kinase (thrB) gene of the *Brevibacterium lactofermentum*," Nucleic Acids Res., 15(9):3922 (1987) |
| Y00151 | ddh | Meso-diaminopimelate D-dehydrogenase (EC 1.4.1.16) | Ishino, S. et al. "Nucleotide sequence of the meso-diaminopimelate D-dehydrogenase gene from *Corynebacterium glutamicum*," Nucleic Acids Res., 15(9):3917 (1987) |
| Y00476 | thrA | Homoserine dehydrogenase | Mateos, L. M. et al. "Nucleotide sequence of the homoserine dehydrogenase (thrA) gene of the *Brevibacterium lactofermentum*," Nucleic Acids Res., 15(24):10598 (1987) |
| Y00546 | hom; thrB | Homoserine dehydrogenase; homoserine kinase | Peoples, O. P. et al. "Nucleotide sequence and fine structural analysis of the *Corynebacterium glutamicum* hom-thrB operon," Mol. Microbiol., 2(1):63–72 (1988) |
| Y08964 | murC; ftsQ/divD; ftsZ | UPD-N-acetylmuramate-alanine ligase; division initiation protein or cell division protein; cell division protein | Honrubia, M. P. et al. "Identification, characterization, and chromosomal organization of the ftsZ gene from *Brevibacterium lactofermentum*," Mol. Gen. Genet., 259(1):97–104 (1998) |
| Y09163 | putP | High affinity proline transport system | Peter, H. et al. "Isolation of the putP gene of *Corynebacterium glutamicum*proline and characterization of a low-affinity uptake system for compatible solutes," Arch. Microbiol., 168(2):143–151 (1997) |
| Y09548 | pyc | Pyruvate carboxylase | Peters-Wendisch, P. G. et al. "Pyruvate carboxylase from *Corynebacterium glutamicum*: characterization, expression and inactivation of the pyc gene," Microbiology, 144:915–927 (1998) |
| Y09578 | leuB | 3-isopropylmalate dehydrogenase | Patek, M. et al. "Analysis of the leuB gene from *Corynebacterium glutamicum*," Appl. Microbiol. Biotechnol., 50(1):42–47 (1998) |
| Y12472 | | Attachment site bacteriophage Phi-16 | Moreau, S. et al. "Site-specific integration of corynephage Phi-16: The construction of an integration vector," Microbiol., 145:539–548 (1999) |
| Y12537 | proP | Proline/ectoine uptake system protein | Peter, H. et al. "*Corynebacterium glutamicum* is equipped with four secondary carriers for compatible solutes: Identification, sequencing, and characterization of the proline/ectoine uptake system, ProP, and the ectoine/proline/glycine betaine carrier, EctP," J. Bacteriol., 180(22):6005–6012 (1998) |
| Y13221 | glnA | Glutamine synthetase 1 | Jakoby, M. et al. "Isolation of *Corynebacterium glutamicum* glnA gene encoding glutamine synthetase I," FEMS Microbiol. Lett., 154(1):81–88 (1997) |
| Y16642 | lpd | Dihdrolipoamide dehydrogenase | |
| Y18059 | | Attachment site Corynephage 304L | Moreau, S. et al. "Analysis of the integration functions of & phi; 304L: An integrase module among corynephages," Virology, 255(1):150 . 159 (1999) |
| Z21501 | argS; lysA | Arginyl-tRNA synthetase; diaminopimelate decarboxylase (partial) | Oguiza, J. A. et al. "A gene encoding arginyl-tRNA synthetase is located in the upstream region of the lysA gene in *Brevibacterium lactofermentum*: Regulation of argS-lysA cluster expression by arginine,"J. Bacteriol., 175(22):7356–7362 (1993) |
| Z21502 | dapA; dapB | Dihydrodipicolinate synthase; dihydropicolinate reductase | Pisabarro, A. et al. "A cluster of three genes (dapA, orf2, and dapB) of *Brevibacterium lactofermentum* encodes dihydrodipicolinate reductase, and a third polypeptide of unknown function," J. Bacteriol., 175(9):2743–2749 (1993) |

TABLE 2-continued

GENES IDENTIFIED FROM GENBANK

| GenBank™ Accession No. | Gene Name | Gene Function | Reference |
|---|---|---|---|
| Z29563 | thrC | Threonine synthase | Malumbres, M. et al. "Analysis and expression of the thrC gene of the encoded threonine synthase," Appl. Environ. Microbiol., 60(7)2209–2219 (1994) |
| Z46753 | 16S rDNA | Gene for 16S ribosomal RNA | |
| Z49822 | sigA | SigA sigma factor | Oguiza, J. A. et al "Multiple sigma factor genes in *Brevibacterium lactofermentum*: Characterization of sigA and sigB," J. Bacteriol., 178(2):550–553 (1996) |
| Z49823 | galE; dtxR | Catalytic activity UDP-galactose 4-epimerase; diphtheria toxin regulatory protein | Oguiza, J. A. et al "The galE gene encoding the UDP-galactose 4-epimerase of *Brevibacterium lactofermentum* is coupled transcriptionally to the dmdR gene," Gene, 177:103–107 (1996) |
| Z49824 | orf1; sigB | ?; SigB sigma factor | Oguiza, J. A. et al "Multiple sigma factor genes in *Brevibacterium lactofermentum*: Characterization of sigA and sigB," J. Bacteriol., 178(2):550–553 (1996) |
| Z66534 | | Transposase | Correia, A. et al. "Cloning and characterization of an IS-like element present in the genome of *Brevibacterium lactofermentum* ATCC 13869," Gene, 170(1):91–94 (1996) |

[i]A sequence for this gene was published in the indicated reference. However, the sequence obtained by the inventors of the present application is significantly longer than the published version. It is believed that the published version relied on an incorrect start codon, and thus represents only a fragment of the actual coding region.

TABLE 3

*Corynebacterium* and *Brevibacterium* Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Brevibacterium | ammoniagenes | 21054 | | | | | | | |
| Brevibacterium | ammoniagenes | 19350 | | | | | | | |
| Brevibacterium | ammoniagenes | 19351 | | | | | | | |
| Brevibacterium | ammoniagenes | 19352 | | | | | | | |
| Brevibacterium | ammoniagenes | 19353 | | | | | | | |
| Brevibacterium | ammoniagenes | 19354 | | | | | | | |
| Brevibacterium | ammoniagenes | 19355 | | | | | | | |
| Brevibacterium | ammoniagenes | 19356 | | | | | | | |
| Brevibacterium | ammoniagenes | 21055 | | | | | | | |
| Brevibacterium | ammoniagenes | 21077 | | | | | | | |
| Brevibacterium | ammoniagenes | 21553 | | | | | | | |
| Brevibacterium | ammoniagenes | 21580 | | | | | | | |
| Brevibacterium | ammoniagenes | 39101 | | | | | | | |
| Brevibacterium | butanicum | 21196 | | | | | | | |
| Brevibacterium | divaricatum | 21792 | P928 | | | | | | |
| Brevibacterium | flavum | 21474 | | | | | | | |
| Brevibacterium | flavum | 21129 | | | | | | | |
| Brevibacterium | flavum | 21518 | | | | | | | |
| Brevibacterium | flavum | | | B11474 | | | | | |
| Brevibacterium | flavum | | | B11472 | | | | | |
| Brevibacterium | flavum | 21127 | | | | | | | |
| Brevibacterium | flavum | 21128 | | | | | | | |
| Brevibacterium | flavum | 21427 | | | | | | | |
| Brevibacterium | flavum | 21475 | | | | | | | |
| Brevibacterium | flavum | 21517 | | | | | | | |
| Brevibacterium | flavum | 21528 | | | | | | | |
| Brevibacterium | flavum | 21529 | | | | | | | |
| Brevibacterium | flavum | | | B11477 | | | | | |
| Brevibacterium | flavum | | | B11478 | | | | | |
| Brevibacterium | flavum | 21127 | | | | | | | |
| Brevibacterium | flavum | | | B11474 | | | | | |
| Brevibacterium | healii | 15527 | | | | | | | |
| Brevibacterium | ketoglutamicum | 21004 | | | | | | | |
| Brevibacterium | ketoglutamicum | 21089 | | | | | | | |
| Brevibacterium | ketosoreductum | 21914 | | | | | | | |
| Brevibacterium | lactofermentum | | | | 70 | | | | |
| Brevibacterium | lactofermentum | | | | 74 | | | | |
| Brevibacterium | lactofermentum | | | | 77 | | | | |

TABLE 3-continued

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Brevibacterium | lactofermentum | 21798 | | | | | | | |
| Brevibacterium | lactofermentum | 21799 | | | | | | | |
| Brevibacterium | lactofermentum | 21800 | | | | | | | |
| Brevibacterium | lactofermentum | 21801 | | | | | | | |
| Brevibacterium | lactofermentum | | | B11470 | | | | | |
| Brevibacterium | lactofermentum | | | B11471 | | | | | |
| Brevibacterium | lactofermentum | 21086 | | | | | | | |
| Brevibacterium | lactofermentum | 21420 | | | | | | | |
| Brevibacterium | lactofermentum | 21086 | | | | | | | |
| Brevibacterium | lactofermentum | 31269 | | | | | | | |
| Brevibacterium | linens | 9174 | | | | | | | |
| Brevibacterium | linens | 19391 | | | | | | | |
| Brevibacterium | linens | 8377 | | | | | | | |
| Brevibacterium | paraffinolyticum | | | | | 11160 | | | |
| Brevibacterium | spec. | | | | | | 717.73 | | |
| Brevibacterium | spec. | | | | | | 717.73 | | |
| Brevibacterium | spec. | 14604 | | | | | | | |
| Brevibacterium | spec. | 21860 | | | | | | | |
| Brevibacterium | spec. | 21864 | | | | | | | |
| Brevibacterium | spec. | 21865 | | | | | | | |
| Brevibacterium | spec. | 21866 | | | | | | | |
| Brevibacterium | spec. | 19240 | | | | | | | |
| Corynebacterium | acetoacidophilum | 21476 | | | | | | | |
| Corynebacterium | acetoacidophilum | 13870 | | | | | | | |
| Corynebacterium | acetoglutamicum | | | B11473 | | | | | |
| Corynebacterium | acetoglutamicum | | | B11475 | | | | | |
| Corynebacterium | acetoglutamicum | 15806 | | | | | | | |
| Corynebacterium | acetoglutamicum | 21491 | | | | | | | |
| Corynebacterium | acetoglutamicum | 31270 | | | | | | | |
| Corynebacterium | acetophilum | | | B3671 | | | | | |
| Corynebacterium | ammoniagenes | 6872 | | | | | | 2399 | |
| Corynebacterium | ammoniagenes | 15511 | | | | | | | |
| Corynebacterium | fujiokense | 21496 | | | | | | | |
| Corynebacterium | glutamicum | 14067 | | | | | | | |
| Corynebacterium | glutamicum | 39137 | | | | | | | |
| Corynebacterium | glutamicum | 21254 | | | | | | | |
| Corynebacterium | glutamicum | 21255 | | | | | | | |
| Corynebacterium | glutamicum | 31830 | | | | | | | |
| Corynebacterium | glutamicum | 13032 | | | | | | | |
| Corynebacterium | glutamicum | 14305 | | | | | | | |
| Corynebacterium | glutamicum | 15455 | | | | | | | |
| Corynebacterium | glutamicum | 13058 | | | | | | | |
| Corynebacterium | glutamicum | 13059 | | | | | | | |
| Corynebacterium | glutamicum | 13060 | | | | | | | |
| Corynebacterium | glutamicum | 21492 | | | | | | | |
| Corynebacterium | glutamicum | 21513 | | | | | | | |
| Corynebacterium | glutamicum | 21526 | | | | | | | |
| Corynebacterium | glutamicum | 21543 | | | | | | | |
| Corynebacterium | glutamicum | 13287 | | | | | | | |
| Corynebacterium | glutamicum | 21851 | | | | | | | |
| Corynebacterium | glutamicum | 21253 | | | | | | | |
| Corynebacterium | glutamicum | 21514 | | | | | | | |
| Corynebacterium | glutamicum | 21516 | | | | | | | |
| Corynebacterium | glutamicum | 21299 | | | | | | | |
| Corynebacterium | glutamicum | 21300 | | | | | | | |
| Corynebacterium | glutamicum | 39684 | | | | | | | |

TABLE 3-continued

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Corynebacterium | glutamicum | 21488 | | | | | | | |
| Corynebacterium | glutamicum | 21649 | | | | | | | |
| Corynebacterium | glutamicum | 21650 | | | | | | | |
| Corynebacterium | glutamicum | 19223 | | | | | | | |
| Corynebacterium | glutamicum | 13869 | | | | | | | |
| Corynebacterium | glutamicum | 21157 | | | | | | | |
| Corynebacterium | glutamicum | 21158 | | | | | | | |
| Corynebacterium | glutamicum | 21159 | | | | | | | |
| Corynebacterium | glutamicum | 21355 | | | | | | | |
| Corynebacterium | glutamicum | 31808 | | | | | | | |
| Corynebacterium | glutamicum | 21674 | | | | | | | |
| Corynebacterium | glutamicum | 21562 | | | | | | | |
| Corynebacterium | glutamicum | 21563 | | | | | | | |
| Corynebacterium | glutamicum | 21564 | | | | | | | |
| Corynebacterium | glutamicum | 21565 | | | | | | | |
| Corynebacterium | glutamicum | 21566 | | | | | | | |
| Corynebacterium | glutamicum | 21567 | | | | | | | |
| Corynebacterium | glutamicum | 21568 | | | | | | | |
| Corynebacterium | glutamicum | 21569 | | | | | | | |
| Corynebacterium | glutamicum | 21570 | | | | | | | |
| Corynebacterium | glutamicum | 21571 | | | | | | | |
| Corynebacterium | glutamicum | 21572 | | | | | | | |
| Corynebacterium | glutamicum | 21573 | | | | | | | |
| Corynebacterium | glutamicum | 21579 | | | | | | | |
| Corynebacterium | glutamicum | 19049 | | | | | | | |
| Corynebacterium | glutamicum | 19050 | | | | | | | |
| Corynebacterium | glutamicum | 19051 | | | | | | | |
| Corynebacterium | glutamicum | 19052 | | | | | | | |
| Corynebacterium | glutamicum | 19053 | | | | | | | |
| Corynebacterium | glutamicum | 19054 | | | | | | | |
| Corynebacterium | glutamicum | 19055 | | | | | | | |
| Corynebacterium | glutamicum | 19056 | | | | | | | |
| Corynebacterium | glutamicum | 19057 | | | | | | | |
| Corynebacterium | glutamicum | 19058 | | | | | | | |
| Corynebacterium | glutamicum | 19059 | | | | | | | |
| Corynebacterium | glutamicum | 19060 | | | | | | | |
| Corynebacterium | glutamicum | 19185 | | | | | | | |
| Corynebacterium | glutamicum | 13286 | | | | | | | |
| Corynebacterium | glutamicum | 21515 | | | | | | | |
| Corynebacterium | glutamicum | 21527 | | | | | | | |
| Corynebacterium | glutamicum | 21544 | | | | | | | |
| Corynebacterium | glutamicum | 21492 | | | | | | | |
| Corynebacterium | glutamicum | | | B8183 | | | | | |
| Corynebacterium | glutamicum | | | B8182 | | | | | |
| Corynebacterium | glutamicum | | | B12416 | | | | | |
| Corynebacterium | glutamicum | | | B12417 | | | | | |
| Corynebacterium | glutamicum | | | B12418 | | | | | |
| Corynebacterium | glutamicum | | | B11476 | | | | | |
| Corynebacterium | glutamicum | 21608 | | | | | | | |
| Corynebacterium | lilium | | P973 | | | | | | |
| Corynebacterium | nitrilophilus | 21419 | | | | 11594 | | | |
| Corynebacterium | spec. | | P4445 | | | | | | |
| Corynebacterium | spec. | | P4446 | | | | | | |
| Corynebacterium | spec. | 31088 | | | | | | | |
| Corynebacterium | spec. | 31089 | | | | | | | |
| Corynebacterium | spec. | 31090 | | | | | | | |
| Corynebacterium | spec. | 31090 | | | | | | | |
| Corynebacterium | spec. | 31090 | | | | | | | |
| Corynebacterium | spec. | 15954 | | | | | | | 20145 |
| Corynebacterium | spec. | 21857 | | | | | | | |
| Corynebacterium | spec. | 21862 | | | | | | | |
| Corynebacterium | spec. | 21863 | | | | | | | |

ATCC: Americal Type Culture Collection, Rockville, MD, USA
FERM: Fermentation Research Institute, Chiba, Japan
NRRL: ARS Culture Collection, Northern Regional Research Laboratory, Peoria, IL, USA
CECT: Coleccion Espanola de Cultivos Tipo, Valencia, Spain
NCIMB: National Collection of Industrial and Marine Bacteria Ltd., Aberdeen, UK
CBS: Centraalbureau voor Schimmelcultures, Baarn, NL
NCTC: National Collection of Type Coltures, London, UK
DSMZ: Deutsche Sammlung von Mikroorganismen und Zellkulturen, Braunschweig, Germany
For reference see Sugawara, H. et al. (1993) World directory of collections of cultures of microorganisms: Bacteria, fungi and yeasts (4$^{th}$ edn), World federation for culture collections world data center on microorganisms, Saimata, Japen.

TABLE 4

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00003 | 864 | GB_BA2:MPAE000013 | 10328 | AE000013 | Mycoplasma pneumoniae section 13 of 63 of the complete genome. | Mycoplasma pneumoniae | 37,409 | Nov. 18, 1996 |
|  |  | GB_BA2:MPAE000013 | 10328 | AE000013 | Mycoplasma pneumoniae section 13 of 63 of the complete genome. | Mycoplasma pneumoniae | 36,768 | Nov. 18, 1996 |
| rxa00008 | 615 | GB_HTG2:AC007356 | 185382 | AC007356 | Drosophila melanogaster chromosome 2 clone BACR24H09 (D595) RPCI-98 24.H.9 map 49A–49B strain y; cn bw sp, *SEQUENCING IN PROGRESS*, 13 unordered pieces. | Drosophila melanogaster | 39,203 | Aug. 2, 1999 |
|  |  | GB_HTG2:AC007356 | 185382 | AC007356 | Drosophila melanogaster chromosome 2 clone BACR24H09 (D595) RPCI-98 24.H.9 map 49A–49B strain y; cn bw sp, *SEQUENCING IN PROGRESS*, 13 unordered pieces. | Drosophila melanogaster | 39,203 | Aug. 2, 1999 |
|  |  | GB_EST36:AV194293 | 380 | AV194293 | AV194293 Yuji Kohara unpublished cDNA:Strain N2 hermaphrodite embryo Caenorhabditis elegans cDNA clone yk627f12 5', mRNA sequence. | Caenorhabditis elegans | 38,947 | Jul. 22, 1999 |
| rxa00015 | 432 | GB_GSS4:AQ684785 | 671 | AQ684785 | HS_5481_B2_H06_SP6E RPCI-11 Human Male BAC Library Homo sapiens genomic clone Plate = 1057 Col = 12 Row = P, genomic survey sequence. | Homo sapiens | 41,388 | Jun. 28, 1999 |
|  |  | GB_PR2:HS217O16 | 87552 | AL031771 | Human DNA sequence from clone 217O16 on chromosome 6q24 Contains GSS, complete sequence. | Homo sapiens | 37,471 | Nov. 23, 1999 |
| rxa00018 | 1422 | GB_EST15:AA528550 | 335 | AA528550 | nf01f01.s1 NCI_CGAP_Kid1 Homo sapiens cDNA clone IMAGE:912505, mRNA sequence | Homo sapiens | 40,789 | Aug. 19, 1997 |
|  |  | GB_VI:HSSMCP | 4320 | M25411 | Human cytomegalovirus major capsid protein (MCP) gene, complete cds. | human herpesvirus 5 | 38,231 | Oct. 30, 1994 |
|  |  | GB_BA2:AE001270 | 12448 | AE001270 | Treponema pallidum section 86 of 87 of the complete genome. | Treponema pallidum | 37,130 | Jul. 16, 1998 |
|  |  | GB_IN1:LMFL2385 | 22004 | AL034389 | Leishmania major Friedlin cosmid L2385, complete sequence. | Leishmania major | 37,518 | Mar. 15, 1999 |
| rxa00020 | 903 | GB_PR4:AC006960 | 179757 | AC006960 | Homo sapiens clone UWGC:djs58 from 7p14-15, complete sequence. | Homo sapiens | 36,618 | Mar. 5, 1999 |
|  |  | GB_HTG3:AC008266 | 178972 | AC008266 | Homo sapiens clone DJ1145A24, *SEQUENCING IN PROGRESS*, 3 unordered pieces. | Homo sapiens | 35,419 | Aug. 21, 1999 |
|  |  | GB_HTG3:AC008266 | 178972 | AC008266 | Homo sapiens clone DJ1145A24, *SEQUENCING IN PROGRESS*, 3 unordered pieces. | Homo sapiens | 35,419 | Aug. 21, 1999 |
| rxa00021 | 1896 | GB_EST15:AA496164 | 429 | AA496164 | zu67e09.r1 Soares_testis_NHT Homo sapiens cDNA clone IMAGE:743080 5', mRNA sequence. | Homo sapiens | 35,526 | Aug. 11, 1997 |
|  |  | GB_EST30:AI660039 | 443 | AI660039 | we65d06.x1 Soares_thymus_NHFTh Homo sapiens cDNA clone IMAGE:2345963 3', mRNA sequence. | Homo sapiens | 42,574 | May 10, 1999 |
|  |  | GB_EST37:AI953059 | 522 | AI953059 | wq49g06.x1 NCI_CGAP_GC6 Homo sapiens cDNA clone IMAGE:2474650 3', mRNA sequence. | Homo sapiens | 39,198 | Sep. 6, 1999 |
| rxa00022 | 1824 | GB_EST15:AA496164 | 429 | AA496164 | zu67e09.r1 Soares_testis_NHT Homo sapiens cDNA clone IMAGE:743080 5', mRNA sequence. | Homo sapiens | 41,141 | Aug. 11, 1997 |
|  |  | GB_PR3:AF022141 | 43473 | AF022141 | Homo sapiens chromosome 21q22.2 cosmid Q13F10, complete sequence. | Homo sapiens | 37,262 | Jan. 21, 1998 |
|  |  | GB_EST18:AA678649 | 538 | AA678649 | ah07c05.s1 Gessler Wilms tumor Homo sapiens cDNA clone IMAGE:1155944 3' similar to gb:X16869 ELONGATION FACTOR 1-ALPHA 1 (HUMAN), mRNA sequence. | Homo sapiens | 38,104 | Dec. 2, 1997 |
| rxa00025 | 1560 | GB_PL2:AC009978 | 97554 | AC009978 | Genomic sequence for Arabidopsis thaliana BAC T23E18 from chromosome I, complete sequence. | Arabidopsis thaliana | 34,173 | Nov. 15, 1999 |
|  |  | GB_HTG2:AC005958 | 216706 | AC005958 | Homo sapiens, *SEQUENCING IN PROGRESS*, 40 unordered pieces. | Homo sapiens | 35,374 | Nov. 11, 1998 |
|  |  | GB_HTG2:AC005958 | 216706 | AC005958 | Homo sapiens, *SEQUENCING IN PROGRESS*, 40 unordered pieces. | Homo sapiens | 35,374 | Nov. 11, 1998 |
| rxa00027 | 489 | GB_PR3:HSDI247C2 | 98358 | AL049713 | Human DNA sequence from clone 247C2 on chromosome 11p13, complete sequence. | Homo sapiens | 33,056 | Nov. 23, 1999 |
|  |  | GB_PR3:HSDI247C2 | 98358 | AL049713 | Human DNA sequence from clone 247C2 on chromosome 11p13, complete sequence. | Homo sapiens | 37,988 | Nov. 23, 1999 |
| rxa00028 |  |  |  |  |  |  |  |  |
| rxa00031 | 525 | GB_PL1:SPBC725 | 37949 | AL034352 | S. pombe chromosome II cosmid c725. | Schizosaccharomyces pombe | 36,084 | Mar. 29, 1999 |
|  |  | GB_EST5:N22565 | 435 | N22565 | yw30f05.s1 Morton Fetal Cochlea Homo sapiens cDNA clone IMAGE:253761 3', mRNA sequence. | Homo sapiens | 41,570 | Dec. 20, 1995 |
|  |  | GB_EST21:AA993042 | 464 | AA993042 | of92f07.s1 Soares_total_fetus_Nb2HF8_9w Homo sapiens cDNA clone IMAGE:1624261 3', mRNA sequence. | Homo sapiens | 41,499 | Aug. 27, 1998 |
| rxa00049 | 810 | GB_HTG2:HSI749H19 | 253387 | AL117380 | Homo sapiens chromosome 20 clone RP4-749H19 map q13.11-13.33, *SEQUENCING IN PROGRESS*, in unordered pieces. | Homo sapiens | 37,132 | Dec. 3, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG2:HSI749H19 | 253387 | AL117380 | Homo sapiens chromosome 20 clone RP4-749H19 map q13.11–13.33, *SEQUENCING IN PROGRESS*, in unordered pieces. | Homo sapiens | 37,132 | Dec. 3, 1999 |
| rxa00052 | 834 | GB_HTG4:AC010137 | 155817 | AC010137 | Homo sapiens clone NH0169D01, *SEQUENCING IN PROGRESS*, 4 unordered pieces. | Homo sapiens | 40,052 | Oct. 17, 1999 |
| | | GB_EST37:AI962012 | 382 | AI962012 | wt41e06.x1 NCI_CGAP_Pan1 Homo sapiens cDNA clone IMAGE:2510050 3' similar to SW:ALC2_HUMAN P01877 IG ALPHA-2 CHAIN C REGION; mRNA sequence. | Homo sapiens | 40,486 | Aug. 20, 1999 |
| | | GB_GSS13:AQ454792 | 450 | AQ454792 | HS_5195_B2_H04_SP6E RPCI-11 Human Male BAC Library Homo sapiens genomic clone Plate = 771 Col = 8 Row = P, genomic survey sequence. | Homo sapiens | 40,991 | Apr. 21, 1999 |
| | | GB_GSS13:AQ454792 | 450 | AQ454792 | HS_5195_B2_H04_SP6E RPCI-11 Human Male BAC Library Homo sapiens genomic clone Plate = 771 Col = 8 Row = P, genomic survey sequence. | Homo sapiens | 40,278 | Apr. 21, 1999 |
| rxa00054 | 3036 | GB_GSS5:AQ773786 | 459 | AQ773786 | HS_2222_A1_E07_MR.CIT Approved Human Genomic Sperm Library D Homo sapiens genomic clone Plate = 2222 Col = 13 Row = I, genomic survey sequence. | Homo sapiens | 40,087 | Jul. 29, 1999 |
| | | GB_GSS5:AQ773786 | 459 | AQ773786 | HS_2222_A1_E07_MR CIT Approved Human Genomic Sperm Library D Homo sapiens genomic clone Plate = 2222 Col = 13 Row = I, genomic survey sequence. | Homo sapiens | 40,087 | Jul. 29, 1999 |
| rxa00056 | 873 | GB_IN1:CEF56H9 | 28291 | Z74473 | Caenorhabditis elegans cosmid F56H9, complete sequence. | Caenorhabditis elegans | 35,301 | Nov. 23, 1998 |
| | | GB_IN1:CEF56H9 | 28291 | Z74473 | Caenorhabditis elegans cosmid F56H9, complete sequence. | Caenorhabditis elegans | 38,941 | Nov. 23, 1998 |
| rxa00058 | 687 | GB_HTG6:AC011647 | 141830 | AC011647 | Homo sapiens clone RP11-15D18, *SEQUENCING IN PROGRESS*, 29 unordered pieces. | Homo sapiens | 39,939 | Dec. 4, 1999 |
| | | GB_HTG6:AC011647 | 141830 | AC011647 | Homo sapiens clone RP11-15D18, *SEQUENCING IN PROGRESS*, 29 unordered pieces. | Homo sapiens | 37,537 | Dec. 4, 1999 |
| rxa00059 | 405 | GB_GSS6:AQ825754 | 463 | AQ825754 | HS_5441_A2_G02_SP6E RPCI-11 Human Male BAC Library Homo sapiens genomic clone Plate = 1017 Col = 4 Row = M, genomic survey sequence. | Homo sapiens | 34,444 | Aug. 27, 1999 |
| | | GB_PAT:I32939 | 30001 | I32939 | Sequence 1 from U.S. Pat. No. 5589385. | Unknown. | 42,049 | Feb. 6, 1997 |
| | | GB_PAT:AR031772 | 30001 | AR031772 | Sequence 1 from U.S. Pat. No. 5868410. | Unknown. | 42,049 | Sep. 29, 1999 |
| rxa00065 | 396 | GB_PAT:E16763 | 2517 | E16763 | gDNA encoding aspartate transferase (AAT). | Corynebacterium glutamicum | 98,765 | Jul. 28, 1999 |
| | | GB_EST32:AU050556 | 813 | AU050556 | AU050556 Paralichthys olivaceus library (Aoki T) Paralichthys olivaceus cDNA clone WF7-19, mRNA sequence. | Paralichthys olivaceus | 35,638 | Jun. 8, 1999 |
| | | GB_EST32:AU050215 | 733 | AU050215 | AU050215 Paralichthys olivaceus library (Aoki T) Paralichthys olivaceus cDNA clone WB1-12, mRNA sequence. | Paralichthys olivaceus | 35,638 | Jun. 8, 1999 |
| rxa00067 | 609 | GB_HTG3:AC008289 | 115120 | AC008289 | Drosophila melanogaster chromosome 2 clone BACR04E05 (D1055) RPCI-98 04.E.5 map 57B-57B strain y; cn bw sp, **SEQUENCING IN PROGRESS**, 100 unordered pieces. | Drosophila melanogaster | 30,397 | Aug. 17, 1999 |
| | | GB_IN2:AC004433 | 85882 | AC004433 | Drosophila melanogaster, chromosome 2R, region 57B1-57B6, P1 clone DS03659, complete sequence. | Drosophila melanogaster | 35,501 | Dec. 1, 1998 |
| | | GB_HTG3:AC008289 | 115120 | AC008289 | Drosophila melanogaster chromosome 2 clone BACR04E05 (D1055) RPCI-98 04.E.5 map 57B-57B strain y; cn bw sp, **SEQUENCING IN PROGRESS**, 100 unordered pieces. | Drosophila melanogaster | 30,397 | Aug. 17, 1999 |
| rxa00068 | 705 | GB_PL2:ATAC006201 | 87947 | AC006201 | Arabidopsis thaliana chromosome II BAC T27K22 genomic sequence, complete sequence. | Arabidopsis thaliana | 39,099 | Mar. 12, 1999 |
| | | GB_HTG5:AC010146 | 271437 | AC010146 | Homo sapiens clone NH0355113, WORKING DRAFT SEQUENCE, 1 unordered pieces. | Homo sapiens | 34,237 | Nov. 12, 1999 |
| | | GB_GSS3:B85079 | 307 | B85079 | RPCI11-29O9.TP RPCI-11 Homo sapiens genomic clone RPCI-11-29O9, genomic survey sequence. | Homo sapiens | 39,560 | Apr. 9, 1999 |
| rxa00077 | 1485 | GB_PR4:AC007157 | 152937 | AC007157 | Homo sapiens, clone hRPK.78_A_1, complete sequence. | Homo sapiens | 37,661 | Apr. 27, 1999 |
| | | GB_HTG1:CEY43C5 | 149571 | AL021449 | Caenorhabditis elegans chromosome IV clone Y43C5, *SEQUENCING IN PROGRESS*, in unordered pieces. | Caenorhabditis elegans | 25,242 | Jan. 23, 1998 |
| | | GB_HTG1:CEY43C5 | 149571 | AL021449 | Caenorhabditis elegans chromosome IV clone Y43C5, *SEQUENCING IN PROGRESS*, in unordered pieces. | Caenorhabditis elegans | 38,258 | Jan. 23, 1998 |
| rxa00079 | 345 | GB_IN1:CTAJ2763 | 1097 | AJ002763 | Chironomus tentans mRNA for P23 RNP protein (23 kDa). | Chironomus tentans | 36,176 | Jan. 26, 1998 |
| | | GB_IN1:CTHRP23 | 752 | AJ003820 | Chironomus tentans mRNA for hnRNP protein, hrp23. | Chironomus tentans | 36,176 | Dec. 2, 1998 |
| | | GB_EST17:AA650674 | 540 | AA650674 | 30788 Lambda-PRL2 Arabidopsis thaliana cDNA clone 277G7T7, mRNA sequence. | Arabidopsis thaliana | 36,965 | Oct. 31, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00080 | 1653 | GB_EST38:AW039986 | 564 | AW039986 | EST282477 tomato mixed elicitor, BTI Lycopersicon esculentum cDNA clone cLET19F23, mRNA sequence. | Lycopersicon esculentum | 38,078 | Oct. 18, 1999 |
|  |  | GB_EST33:AI778332 | 378 | AI778332 | EST259211 tomato susceptible, Cornell Lycopersicon esculentum cDNA clone cLES5A13, mRNA sequence. | Lycopersicon esculentum | 38,298 | Jun. 29, 1999 |
|  |  | GB_EST38:AW039988 | 564 | AW039988 | EST282479 tomato mixed elicitor, BTI Lycopersicon esculentum cDNA clone cLET19F23, mRNA sequence. | Lycopersicon esculentum | 38,078 | Oct. 18, 1999 |
| rxa00082 | 687 | GB_PR1:HSS171 | 333303 | AJ011930 | Homo sapiens chromosome 21q22.3, PAC clones 314N7, 225L15, BAC clone 7B7, complete sequence bases 1 . . . 333303. | Homo sapiens | 36,111 | Nov. 10, 1998 |
|  |  | GB_PR1:HSS171 | 333303 | AJ011930 | Homo sapiens chromosome 21q22.3, PAC clones 314N7, 225L15, BAC clone 7B7, complete sequence bases 1 . . . 333303. | Homo sapiens | 35,432 | Nov. 10, 1998 |
| rxa00083 | 423 | GB_PR3:AC004000 | 128117 | AC004000 | Human PAC clone DJ404F18 from Xq23, complete sequence. | Homo sapiens | 38,750 | Jan. 15, 1998 |
|  |  | GB_HTG1:CNS0180Y | 168868 | AL109769 | Homo sapiens chromosome 14 clone R-501E21, **SEQUENCING IN PROGRESS*, in ordered pieces. | Homo sapiens | 33,806 | Oct. 15, 1999 |
|  |  | GB_HTG1:CNS0180Y | 168868 | AL109769 | Homo sapiens chromosome 14 clone R-501E21, **SEQUENCING IN PROGRESS*, in ordered pieces. | Homo sapiens | 33,806 | Oct. 15, 1999 |
|  |  | GB_PR3:HSS16C23 | 116685 | Z93021 | Human DNA sequence from clone 516C23 on chromosome 6q12 Contains CA repeat (D6S402) and GSSs, complete sequence. | Homo sapiens | 36,562 | Nov. 23, 1999 |
| rxa00087 | 651 | GB_BA1:PSEBPHABC | 6780 | M83673 | P. pseudoalcaligenes dioxygenase (bphABC) gene cluster, complete cds. | Pseudomonas pseudoalcaligenes | 39,564 | Apr. 26, 1993 |
|  |  | GB_BA1:PSEBPHA | 5700 | M86348 | Pseudomonas sp. LB400 biphenyl dioxygenase (bphA), biphenyl dioxygenase (bphE), biphenyl dioxygenase (bphF) and biphenyl dioxygenase (bphG)s, complete cds, and dihydrodiol dehydrogenase (bphB), partial cds. | Burkholderia sp. LB400 | 39,564 | Jul. 18, 1997 |
| rxa00093 | 2346 | GB_PAT:E04215 | 4721 | E04215 | Benzene dioxygenase gene. | Pseudomonas aeruginosa | 45,814 | Sep. 29, 1997 |
|  |  | GB_HTG2:AC007361 | 36465 | AC007361 | Homo sapiens clone NH0144P23, **SEQUENCING IN PROGRESS*, 1 unordered pieces. | Homo sapiens | 37,179 | Apr. 23, 1999 |
|  |  | GB_PR4:AC006043 | 189036 | AC006043 | Homo sapiens BAC clone NH0538D15 from 7q11.23–q21.1, complete sequence. | Homo sapiens | 37,060 | Feb. 20, 1999 |
|  |  | GB_HTG2:AC007361 | 36465 | AC007361 | Homo sapiens clone NH0144P23, **SEQUENCING IN PROGRESS*, 1 unordered pieces. | Homo sapiens | 37,179 | Apr. 23, 1999 |
| rxa00096 | 426 | GB_EST15:AA533064 | 534 | AA533064 | nj60d06.s1 NCI_CGAP_Pr9 Homo sapiens cDNA clone IMAGE:996875, mRNA sequence. | Homo sapiens | 39,024 | Aug. 21, 1997 |
|  |  | GB_IN1:CEIF01G12 | 34671 | U53342 | Caenorhabditis elegans cosmid F01G12. | Caenorhabditis elegans | 38,060 | Apr. 5, 1996 |
| rxa00097 | 1299 | GB_PR3:AC004511 | 45005 | AC004511 | Homo sapiens chromosome 5, P1 clone 792C12 (LBNL H22), complete sequence. | Homo sapiens | 39,163 | Mar. 31, 1998 |
|  |  | GB_OM:CFU60590 | 6726 | U60590 | Canis familiaris TTX-resistant sodium channel mRNA, complete cds. | Canis familiaris | 39,528 | Jan. 8, 1998 |
|  |  | GB_GSS15:AQ664394 | 485 | AQ664394 | HS_5480_B1_B02_SP6E RPCI-11 Human Male BAC Library Homo sapiens genomic clone Plate = 1056 Col = 3 Row = D, genomic survey sequence. | Homo sapiens | 39,666 | Jun. 23, 1999 |
|  |  | GB_BA2:RSAF000233 | 5984 | AF000233 | Rhodobacter sphaeroides nitric oxide reductase operon; norC, norB, norQ, norD, nnrT and nnrU genes, complete cds. | Rhodobacter sphaeroides | 37,500 | Jun. 6, 1997 |
| rxa00101 |  |  |  |  |  |  |  |  |
| rxa00108 | 643 | GB_PR4:AC007115 | 180821 | AC007115 | Homo sapiens chromosome 12 clone 91705, complete sequence. | Homo sapiens | 35,165 | Aug. 17, 1999 |
|  |  | GB_PR3:AC004080 | 129354 | AC004080 | Homo sapiens PAC clone DJ0170O19 from 7p15-p21, complete sequence. | Homo sapiens | 38,560 | Jan. 29, 1998 |
|  |  | GB_HTG1:HSAJ9613 | 45302 | AJ009613 | Homo sapiens chromosome 17 clone cosmid 51.5 map p11, *SEQUENCING IN PROGRESS*, in unordered pieces. | Homo sapiens | 39,274 | Nov. 11, 1998 |
| rxa00110 | 672 | GB_PL1:MIATGENB | 166924 | Y08502 | A. thaliana mitochondrial genome, part B. | Mitochondrion Arabidopsis thaliana | 36,391 | Nov. 13, 1998 |
|  |  | GB_PL2:AC010718 | 87684 | AC010718 | Arabidopsis thaliana chromosome I BAC F28O16 genomic sequence, complete sequence. | Arabidopsis thaliana | 36,622 | Oct. 30, 1999 |
|  |  | GB_PL2:AC007729 | 106639 | AC007729 | Arabidopsis thaliana chromosome II BAC T18C6 genomic sequence, complete sequence. | Arabidopsis thaliana | 35,053 | Jun. 5, 1999 |
| rxa00114 | 612 | GB_OM:BTMICSD1 | 362 | Z27071 | B. taurus (cos1E3) microsatellite DNA (362 bp). | Bos taurus | 37,117 | Aug. 10, 1995 |
|  |  | GB_OM:BTMICSD1 | 362 | Z27071 | B. taurus (cos1E3) microsatellite DNA (362 bp). | Bos taurus | 36,486 | Aug. 10, 1995 |
| rxa00117 | 714 | GB_PL2:AF080249 | 3194 | AF080249 | Arabidopsis thaliana kinesin-like heavy chain (KATD) mRNA, complete cds. | Arabidopsis thaliana | 37,848 | Apr. 14, 1999 |

US 6,962,989 B1

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00118 |  | GB_PL2:IG002P16 | 110946 | AF007270 | Arabidopsis thaliana BAC IG002P16. | Arabidopsis thaliana | 37,110 | Jun. 12, 1997 |
|  |  | GB_PL2:AF080249 | 3194 | AF080249 | Arabidopsis thaliana kinesin-like heavy chain (KATD) mRNA, complete cds. | Arabidopsis thaliana | 36,506 | Apr. 14, 1999 |
|  | 376 | GB_HTG2:AC008043 | 124844 | AC008043 | Drosophila melanogaster chromosome 3 clone BACR05A08 (D750) RPCI-98 05.A.6 map 94A-94A strain y; cn bw sp, *SEQUENCING IN PROGRESS*, 86 unordered pieces. | Drosophila melanogaster | 33,780 | Aug. 2, 1999 |
|  |  | GB_HTG2:AC008043 | 124844 | AC008043 | Drosophila melanogaster chromosome 3 clone BACR05A08 (D750) RPCI-98 05.A.8 map 94A-94A strain y; cn bw sp, *SEQUENCING IN PROGRESS*, 86 unordered pieces. | Drosophila melanogaster | 33,780 | Aug. 2, 1999 |
| rxa00119 |  | GB_PR3:AC004827 | 129690 | AC004827 | Homo sapiens PAC clone DJ044L15 from Xq23, complete sequence. | Homo sapiens | 32,320 | Oct. 17, 1998 |
|  |  | GB_PR4:HSU34879 | 46610 | U34879 | Human 17-beta-hydroxysteroid dehydrogenase (EDH17B2) gene, complete cds. | Homo sapiens | 36,671 | Jan. 14, 1999 |
|  | 882 | GB_PR4:HSU34879 | 46610 | U34879 | Human 17-beta-hydroxysteroid dehydrogenase (EDH17B2) gene, complete cds. | Homo sapiens | 38,345 | Jan. 14, 1999 |
|  |  | GB_EST37:AW005997 | 702 | AW005997 | wz91c01.x1 NCI_CGAP_Bm25 Homo sapiens cDNA clone IMAGE:2566176 3' similar to TR:O08609 O08609 TRANSCRIPTION FACTOR-LIKE PROTEIN 4.; mRNA sequence. | Homo sapiens | 40,774 | Sep. 10, 1999 |
| rxa00120 | 963 | GB_BA1:TRU80216 | 1936 | U80216 | Thermomicrobium roseum 70 kDa heat shock protein Hsp70 (DnaK) gene, complete cds. | Thermomicrobium roseum | 38,000 | Feb. 1, 1997 |
| rxa00121 |  | GB_HTG1:HS791K14 | 155318 | AL035685 | Homo sapiens chromosome 20 clone RP4-791K14, *SEQUENCING IN PROGRESS*, in unordered pieces. | Homo sapiens | 37,277 | Nov. 23, 1999 |
|  |  | GB_HTG1:HS791K14 | 155318 | AL035685 | Homo sapiens chromosome 20 clone RP4-791K14, *SEQUENCING IN PROGRESS*, in unordered pieces. | Homo sapiens | 37,277 | Nov. 23, 1999 |
|  | 834 | GB_HTG1:HSBA29O6 | 198847 | AL118525 | Homo sapiens chromosome 20 clone RP11-298O6, *SEQUENCING IN PROGRESS*, in unordered pieces. | Homo sapiens | 36,199 | Nov. 24, 1999 |
|  |  | GB_HTG1:HS791K14 | 155318 | AL035685 | Homo sapiens chromosome 20 clone RP4-791K14, *SEQUENCING IN PROGRESS*, in unordered pieces. | Homo sapiens | 36,983 | Nov. 23, 1999 |
|  |  | GB_HTG1:HS791K14 | 155318 | AL035685 | Homo sapiens chromosome 20 clone RP4-791K14, *SEQUENCING IN PROGRESS*, in unordered pieces. | Homo sapiens | 36,983 | Nov. 23, 1999 |
| rxa00122 | 1746 | GB_PL1:MZECPN60A | 6575 | L21007 | Corn nuclear-encoded mitochondrial chaperonin 60 (cpn60I) gene, complete cds. | Zea mays | 36,098 | Jul. 26, 1993 |
|  |  | GB_PL1:ZMCPNAGA | 2247 | Z12114 | Z. mays CPNA gene encoding mitochondrial chaperonin-60. | Zea mays | 37,702 | Oct. 1, 1992 |
|  |  | GB_PL1:ZMCHHSP60 | 2138 | Z11546 | Z. mays mRNA for mitochondrial chaperonin hsp60. | Zea mays | 37,721 | Jun. 11, 1992 |
| rxa00127 | 588 | GB_PR4:AC005193 | 108400 | AC005193 | Homo sapiens clone DJ0655N24, complete sequence. | Homo sapiens | 37,500 | Jul. 1, 1999 |
|  |  | GB_PR4:AC005193 | 108400 | AC005193 | Homo sapiens clone DJ0655N24, complete sequence. | Homo sapiens | 36,796 | Jul. 1, 1999 |
| rxa00128 | 1827 | GB_GSS11:AQ299024 | 449 | AQ299024 | HS_3178_B1_B06_T7 CIT Approved Human Genomic Sperm Library D Homo sapiens genomic clone Plate = 3178 Col = 11 Row = D, genomic survey sequence. | Homo sapiens | 40,757 | Dec. 15, 1998 |
|  |  | GB_GSS11:AQ299024 | 449 | AQ299024 | HS_3178_B1_B06_T7 CIT Approved Human Genomic Sperm Library D Homo sapiens genomic clone Plate = 3178 Col = 11 Row = D, genomic survey sequence. | Homo sapiens | 40,443 | Dec. 15, 1998 |
| rxa00134 | 693 | GB_GSS10:AQ177172 | 393 | AQ177172 | HS_3225_A2_E10_MR CIT Approved Human Genomic Sperm Library D Homo sapiens genomic clone Plate = 3225 Col = 20 Row = I, genomic survey sequence. | Homo sapiens | 50,000 | Oct. 17, 1998 |
| rxa00140 |  | GB_PR3:AC005726 | 185215 | AC005726 | Homo sapiens chromosome 17, clone hRPK.192_H_23, complete sequence. | Homo sapiens | 37,778 | Oct. 30, 1998 |
|  |  | GB_PR3:AC005726 | 185215 | AC005726 | Homo sapiens chromosome 17, clone hRPK.192_H_23, complete sequence. | Homo sapiens | 38,710 | Oct. 30, 1998 |
|  | 309 | GB_VI:OPU75930 | 131993 | U75930 | Orgyia pseudotsugata nuclear polyhedrosis virus complete genome. | Orgyia pseudotsugata nuclear polyhedrosis virus | 39,007 | Mar. 6, 1998 |
| rxa00141 |  | GB_HTG2:AC006319 | 156299 | AC006319 | Homo sapiens clone DJ0837C09, *SEQUENCING IN PROGRESS*, 1 unordered pieces. | Homo sapiens | 31,773 | Apr. 23, 1999 |
|  |  | GB_HTG2:AC006319 | 156299 | AC006319 | Homo sapiens clone DJ0837C09, *SEQUENCING IN PROGRESS*, 1 unordered pieces. | Homo sapiens | 31,773 | Apr. 23, 1999 |
|  | 585 | GB_VI:OPU75930 | 131993 | U75930 | Orgyia pseudotsugata nuclear polyhedrosis virus complete genome. | Orgyia pseudotsugata nuclear polyhedrosis virus | 38,079 | Mar. 6, 1998 |
|  |  | GB_PR4:AC004526 | 297898 | AC004526 | Homo sapiens chromosome 17, Neurofibromatosis 1 locus, complete sequence. | Homo sapiens | 37,336 | Feb. 25, 1999 |
|  |  | GB_PR2:HUMNEUROF | 100849 | L05367 | Human oligodendrocyte myelin glycoprotein (OMG) exons 1-2; neurofibromatosis 1 (NF1) | Homo sapiens | 37,336 | Sep. 20, 1995 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00142 | 600 | GB_PR4:HUAC002331 | 139480 | AC002331 | exons 28-49; ecotropic viral integration site 2B (EVI2B) exons 1-2; ecotropic viral integration site 2A (EVI2A) exons 1-2; adenylate kinase (AK3) exons 1-2. | Homo sapiens | 38,898 | Nov. 23, 1999 |
|  |  | GB_PR3:AF064861 | 133965 | AF064861 | Homo sapiens Chromosome 16 BAC clone CIT987SK-A-A-218C7, complete sequence. | Homo sapiens | 37,182 | Jun. 2, 1998 |
|  |  | GB_HTG3:AC009451 | 165302 | AC009451 | Homo sapiens PAC 128M19 derived from chromosome 21q22.3, containing the HMG-14 and CHD5 genes, complete cds, complete sequence. | Homo sapiens | 33,167 | Aug. 22, 1999 |
| rxa00150 | 897 | GB_PR4:AF130343 | 292721 | AF130343 | Homo sapiens chromosome 17 clone 2286_H_12 map 17, **SEQUENCING IN PROGRESS*, 26 unordered pieces. | Homo sapiens | 36,032 | Jul. 9, 1999 |
|  |  | GB_HTG4:AC008578 | 98891 | AC008578 | Homo sapiens chromosome 8 clone PAC 87.2 map 8q24.1, complete sequence. | Homo sapiens | 38,129 | Oct. 31, 1999 |
|  |  | GB_HTG4:AC008578 | 98891 | AC008578 | Homo sapiens chromosome 5 clone CIT-HSPC_558D4. *SEQUENCING IN PROGRESS*, 143 unordered pieces. | Homo sapiens | 38,129 | Oct. 31, 1999 |
| rxa00151 | 720 | GB_PL2:AF058914 | 111767 | AF058914 | Homo sapiens chromosome 5 clone CIT-HSPC_558D4, *SEQUENCING IN PROGRESS*, 143 unordered pieces. | Arabidopsis thaliana | 36,068 | Apr. 15, 1998 |
|  |  | GB_PR1:AB019440 | 200000 | AB019440 | Arabidopsis thaliana BAC F21E10. | Homo sapiens | 36,517 | Feb. 24, 1999 |
|  |  | GB_PR2:AP000098 | 100000 | AP000098 | Homo sapiens DNA for immunoglobulin heavy-chain variable region, complete sequence, 4 of 5. | Homo sapiens | 39,224 | Sep. 25, 1999 |
| rxa00153 | 549 | GB_PR4:AC006265 | 177707 | AC006265 | Homo sapiens genomic DNA of 21q22.1, GART and AML related, Q78C10-149C3 region, segment 1/20, complete sequence. | Homo sapiens | 34,862 | Jan. 28, 1999 |
|  |  | GB_HTG2:AC007389 | 207188 | AC007389 | Homo sapiens chromosome 17, clone hRPK.566_B_16, complete sequence. | Homo sapiens | 36,044 | Jun. 5, 1999 |
|  |  | GB_HTG2:AC007389 | 207188 | AC007389 | Homo sapiens clone NH0418H16, *SEQUENCING IN PROGRESS*, 6 unordered pieces. | Homo sapiens | 36,044 | Jun. 5, 1999 |
| rxa00154 |  |  |  |  | Homo sapiens clone NH0418H16, *SEQUENCING IN PROGRESS*, 6 unordered pieces. |  |  |  |
| rxa00155 | 906 | GB_BA2:AE001707 | 19518 | AE001707 | Thermotoga maritima section 19 of 136 of the complete genome. | Thermotoga maritima | 36,854 | Jun. 2, 1999 |
|  |  | GB_PR2:HS1126I14 | 19544 | AL078589 | Human DNA sequence from clone 1126I14 on chromosome 6q16.1-16.3. Contains an STS and GSSs, complete sequence. | Homo sapiens | 36,723 | Nov. 23, 1999 |
|  |  | GB_BA1:MTCY01B2 | 35938 | Z95554 | Mycobacterium tuberculosis H37Rv complete genome; segment 72/162. | Mycobacterium tuberculosis | 40,435 | Jun. 17, 1998 |
| rxa00159 |  | GB_EST38:AW048718 | 475 | AW048718 | UI-M-BH1-amy-d-01-0-UI.s1 NIH_BMAP_M_S2 Mus musculus cDNA clone UI-M-BH1-amy-d-01-0-UI 3'; mRNA sequence. | Mus musculus | 39,789 | Sep. 18, 1999 |
|  |  | GB_EST21:AA993450 | 381 | AA993450 | ot32h09.s1 Soares_testis_NHT Homo sapiens cDNA clone IMAGE:1618529 3', mRNA sequence. | Homo sapiens | 38,684 | Aug. 27, 1998 |
| rxa00161 | 585 | GB_BA1:AB007009 | 363 | AB007009 | Cytophaga sp. 16S rRNA gene, partial sequence. | Cytophaga sp. | 39,039 | Oct. 13, 1997 |
|  |  | GB_HTG3:AC009708 | 25123 | AC009708 | Homo sapiens chromosome 8 clone 318_G_5 map 8, LOW-PASS SEQUENCE SAMPLING. | Homo sapiens | 37,108 | Aug. 28, 1999 |
|  |  | GB_HTG3:AC009708 | 25123 | AC009708 | Homo sapiens chromosome 8 clone 318_G_5 map 8, LOW-PASS SEQUENCE SAMPLING. | Homo sapiens | 37,108 | Aug. 28, 1999 |
|  |  | GB_PR3:HSN104C4 | 40203 | Z83855 | Human DNA sequence from clone N104C4 on chromosome 22 Contains GSSs, complete sequence. | Homo sapiens | 37,634 | Nov. 23, 1999 |
| rxa00162 | 477 | GB_HTG1:CEY94A7 | 41009 | Z99294 | Caenorhabditis elegans chromosome V clone Y94A7, *SEQUENCING IN PROGRESS*, in unordered pieces. | Caenorhabditis elegans | 41,502 | Sep. 18, 1997 |
|  |  | GB_HTG1:CEY94A7 | 41009 | Z99294 | Caenorhabditis elegans chromosome V clone Y94A7, *SEQUENCING IN PROGRESS*, in unordered pieces. | Caenorhabditis elegans | 41,502 | Sep. 18, 1997 |
| rxa00167 | 621 | GB_BA2:AE001182 | 11228 | AE001182 | Borrelia burgdorferi (section 68 of 70) of the complete genome. | Borrelia burgdorferi | 39,655 | Dec. 15, 1997 |
|  |  | GB_HTG7:AC007937 | 206265 | AC007937 | Mus musculus chromosome 10 clone RP21-536F4 map 10, *SEQUENCING IN PROGRESS*, 6 unordered pieces. | Mus musculus | 37,092 | Dec. 9, 1999 |
|  |  | GB_RO:MMU6590 | 6429 | AJ006590 | Mus musculus mRNA for GANP protein. | Mus musculus | 38,678 | Jun. 2, 1999 |
|  |  | GB_HTG3:AC008852 | 116219 | AC008852 | Homo sapiens chromosome 5 clone CITB-H1_2176I21, *SEQUENCING IN PROGRESS*, 13 unordered pieces. | Homo sapiens | 35,691 | Aug. 3, 1999 |
| rxa00169 | 2196 | GB_GSS3:B11032 | 896 | B11032 | T17F10-T7 TAMU Arabidopsis thaliana genomic clone T17F10, genomic survey sequence. | Arabidopsis thaliana | 42,024 | May 14, 1997 |

US 6,962,989 B1

TABLE 4-continued

ALIGNMENT RESULTS

| ID # | length (NT) | Genbank Hit | Accession | Length | Name of Genbank Hit | Source of Genbank Hit | % homology (GAP) | Date of Deposit |
|---|---|---|---|---|---|---|---|---|
| rxa00170 | 1977 | GB_GSS3:B10120 | B10120 | 909 | T27N10-Sp6.1 TAMU *Arabidopsis thaliana* genomic clone T27N10, genomic survey sequence. | *Arabidopsis thaliana* | 41,581 | May 14, 1997 |
| | | GB_GSS3:B09409 | B09409 | 915 | T27M2-Sp6 TAMU *Arabidopsis thaliana* genomic clone T27M2, genomic survey sequence. | *Arabidopsis thaliana* | 41,356 | May 14, 1997 |
| | | GB_GSS8:AQ027582 | AQ027582 | 456 | CIT-HSP-2325M20.TR CIT-HSP *Homo sapiens* genomic clone 2325M20, genomic survey sequence. | *Homo sapiens* | 40,749 | Jun. 30, 1998 |
| rxa00171 | 281 | GB_GSS6:AQ833529 | AQ833529 | 484 | HS_5304_B2_CO2_T7A RPCI-11 Human Male BAC Library *Homo sapiens* genomic clone Plate = 880 Col = 4 Row = F, genomic survey sequence. | *Homo sapiens* | 38,017 | Aug. 27, 1999 |
| | | GB_PR2:HSM800174 | AL049389 | 2326 | *Homo sapiens* mRNA; cDNA DKFZp586O0118 (from clone DKFZp586O0118). | *Homo sapiens* | 37,556 | May 21, 1999 |
| | | GB_EST38:AL118463 | AL118463 | 279 | w9112a43 Beddington mouse dissected endoderm *Mus musculus* cDNA clone 528_12E22 5′, mRNA sequence. | *Mus musculus* | 50,000 | Sep. 23, 1999 |
| | | GB_EST15:AA499834 | AA499834 | 419 | vg05e06.r1 Soares mouse NbMH *Mus musculus* cDNA clone IMAGE:860482 5′, mRNA sequence. | *Mus musculus* | 39,801 | Jul. 1, 1997 |
| | | GB_EST24:AI211527 | AI211527 | 431 | p0h01a1.r1 *Aspergillus nidulans* 24 hr asexual developmental and vegetative cDNA lambda zap library *Emericella nidulans* cDNA clone p0h01a1 5′, mRNA sequence. | *Emericella nidulans* | 41,584 | Oct. 19, 1998 |
| rxa00173 | 456 | GB_PR3:AC004400 | AC004400 | 33367 | *Homo sapiens* chromosome 19, cosmid F24069, complete sequence. | *Homo sapiens* | 38,902 | Mar. 12, 1998 |
| | | GB_PL1:VFU14956 | U14956 | 1474 | *Vicia faba* ferredoxin NADP+ reductase precursor (fnr) mRNA, complete cds. | *Vicia faba* | 38,753 | Sep. 28, 1994 |
| | | GB_PR3:AC004400 | AC004400 | 33367 | *Homo sapiens* chromosome 19, cosmid F24069, complete sequence | *Homo sapiens* | 40,515 | Mar. 12, 1998 |
| rxa00174 | 408 | GB_PL2:AF075293 | AF075293 | 4332 | *Candida albicans* strain 1161 agglutinin-like protein 6 (ALS6) gene, complete cds | *Candida albicans* | 41,235 | Jul. 2, 1999 |
| | | GB_PL2 JSPCHS1 | X94995 | 1525 | *Juglans nigra × Juglans regia* mRNA for chalcone synthase (CHS1) | *Juglans nigra × Juglans regia* | 39,558 | Nov. 19, 1999 |
| | | GB_PL2 JSPCHS2 | X94706 | 1534 | *Juglans nigra × Juglans regia* mRNA for chalcone synthase (CHS2) | *Juglans nigra × Juglans regia* | 38,821 | Nov. 19, 1999 |
| rxa00175 | | | | | | | | |
| rxa00179 | 582 | GB_BA1 CGPUTP | Y09163 | 3791 | *C. glutamicum* putP gene | *Corynebacterium glutamicum* | 100,000 | Sep. 8, 1997 |
| | | GB_IN2:L76038 | L76038 | 2421 | *Anopheles gambiae* prophenotoxidase mRNA, complete cds | *Anopheles gambiae* | 35,751 | Jul. 23, 1998 |
| | | GB_IN2:AF031626 | AF031626 | 8486 | *Anopheles gambiae* prophenotoxidase (AgProPO) gene, complete cds | *Anopheles gambiae* | 36,395 | Jan. 5, 1999 |
| rxa00180 | 663 | GB_BA1 CGPUTP | Y09163 | 3791 | *C. glutamicum* putP gene | *Corynebacterium glutamicum* | 100,000 | Sep. 8, 1997 |
| | | GB_HTG1 HS120G22 | AL031847 | 57021 | *Homo sapiens* chromosome 1 clone RP1-120G22, *SEQUENCING IN PROGRESS*, in unordered pieces. | *Homo sapiens* | 35,976 | Nov. 23, 1999 |
| | | GB_HTG1 HS120G22 | AL031847 | 57021 | *Homo sapiens* chromosome 1 clone RP1-120G22, *SEQUENCING IN PROGRESS*, in unordered pieces. | *Homo sapiens* | 35,976 | Nov. 23, 1999 |
| rxa00183 | 975 | GB_IN2 AF049132 | AF049132 | 16005 | *Florometra serratissima* mitochondrion, complete genome | Mitochondrion *Florometra serratissima* | 33,710 | Jan. 15, 1999 |
| | | GB_IN1 MTCE | X54252 | 13794 | *C. elegans* complete mitochondrial genome | Mitochondrion *Caenorhabditis elegans* | 35,036 | Nov. 30, 1997 |
| | | GB_IN2 AF049132 | AF049132 | 16005 | *Florometra serratissima* mitochondrion, complete genome | Mitochondrion *Florometra serratissima* | 36,021 | Jan. 15, 1999 |
| rxa00185 | 2751 | GB_EST31 AI693167 | AI693167 | 500 | wd68e11.x1 NCI_CGAP_Lu24 *Homo sapiens* cDNA clone IMAGE 2336756 3′ similar to SW HIOM_BOVIN P10950 HYDROXYINDOLE O-METHYLTRANSFERASE; mRNA sequence | *Homo sapiens* | 37,800 | Jun. 2, 1999 |
| | | GB_GSS1 CNS010IZ | AL099029 | 1000 | *Drosophila melanogaster* genome survey sequence SP6 end of BAC BACN04K17 of DrosBAC library from *Drosophila melanogaster* (fruit fly), genomic survey sequence | *Drosophila melanogaster* | 35,158 | Jul. 26, 1999 |
| | | GB_EST31 AI693167 | AI693167 | 500 | wd68e11.x1 NCI_CGAP_Lu24 *Homo sapiens* cDNA clone IMAGE:2338756 3′ similar to SW HIOM_BOVIN P10950 HYDROXYINDOLE O-METHYLTRANSFERASE; mRNA sequence | *Homo sapiens* | 39,052 | Jun. 2, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00194 | 564 | GB_GSS10 AQ492671 | 396 | AQ192671 | HS_2251_B2_A04_MF CIT Approved Human Genomic Sperm Library D *Homo sapiens* genomic clone Plate = 2251 Col = 8 Row = B, genomic survey sequence | *Homo sapiens* | 44,240 | Nov. 4, 1998 |
| | | GB_GSS8 AQ044307 | 644 | AQ044307 | CIT-HSP-2331N9, TR CIT-HSP *Homo sapiens* genomic clone 2331N9, genomic survey sequence | *Homo sapiens* | 36,150 | Jul. 14, 1998 |
| | | GB_EST36 AI925874 | 564 | AI925874 | wo20d11.x1 NCI_CGAP_Pan1 *Homo sapiens* cDNA clone IMAGE:2455893 3′ similar to TR O67849 O67849 GTP-BINDING PROTEIN; mRNA sequence | *Homo sapiens* | 45,688 | Sep. 2, 1999 |
| rxa00197 | 1335 | GB_GSS12 AQ399208 | 436 | AQ399208 | mgxb0001M23f CUGI Rice Blast BAC Library *Magnaporthe grisea* genomic clone mgxb0001M23f, genomic survey sequence | *Magnaporthe grisea* | 63,529 | Mar. 6, 1999 |
| | | GB_GSS12:AQ398449 | 472 | AQ398449 | mgxb0001P11fCUGI Rice Blast BAC Library *Magnaporthe grisea* genomic clone mgxb0001P11f, genomic survey sequence. | *Magnaporthe grisea* | 49,580 | Mar. 6, 1999 |
| rxa00199 | 1542 | GB_OM BTMMP9 | 2350 | X78324 | *B. taurus* bmmp9 mRNA for matrix metalloproteinase | *Bos taurus* | 40,440 | Mar. 30, 1995 |
| | | GB_BA1 AB024708 | 8734 | AB024708 | *Corynebacterium glutamicum* gltB and gltD genes for glutamine 2-oxoglutarate aminotransferase *Corynebacterium glutamicum* large and small subunits, complete cds | *Corynebacterium glutamicum* | 36,237 | Mar. 13, 1999 |
| | | GB_HTG2 AC007837 | 103949 | AC007837 | *Drosophila melanogaster* chromosome 2 clone BACR04I07 (D644) RPCI-98 04 I 7 map 57B2-B3 strain y; cn bw sp, **SEQUENCING IN PROGRESS**, 49 unordered pieces | *Drosophila melanogaster* | 36,045 | Aug. 2, 1999 |
| | | GB_HTG2 AC007837 | 103949 | AC007837 | *Drosophila melanogaster* chromosome 2 clone BACR04I07 (D644) RPCI-98 04 I 7 map 57B2-B3 strain y; cn bw sp, **SEQUENCING IN PROGRESS**, 49 unordered pieces | *Drosophila melanogaster* | 36,045 | Aug. 2, 1999 |
| rxa00200 | 3561 | GB_BA2:MSU46844 | 16951 | U46844 | *Mycobacterium smegmatis* catalase-peroxidase (katG); putative arabinosyl transferase (embC, embA, embB), genes complete cds and putative propionyl-coA carboxylase beta chain (pccB) genes, partial cds. | *Mycobacterium smegmatis* | 53,937 | May 12, 1997 |
| | | GB_BA2:MAU66560 | 7853 | U66560 | *Mycobacterium avium* EmbR (embR), EmbA (embA) and EmbB (embB) genes, complete cds. | *Mycobacterium avium* | 52,241 | Nov. 8, 1996 |
| | | GB_BA1:MTY13D12 | 37085 | Z80343 | *Mycobacterium tuberculosis* H37Rv complete genome; segment 156/162. | *Mycobacterium tuberculosis* | 52,812 | Jun. 17, 1998 |
| rxa00207 | 441 | GB_PR3:HTCRBCHR9 | 216293 | AF029308 | *Homo sapiens* chromosome 9 duplication of the T cell receptor beta locus and trypsinogen gene families. | *Homo sapiens* | 39,286 | Apr. 13, 1998 |
| | | GB_PR3:HTCRBCHR9 | 216293 | AF029308 | *Homo sapiens* chromosome 9 duplication of the T cell receptor beta locus and trypsinogen gene families. | *Homo sapiens* | 37,116 | Apr. 13, 1998 |
| rxa00211 | 786 | GB_PR2:HSU81831 | 38674 | U81831 | Human cosmid L112NCO1-67C6, ETV6 gene, intron 1A, partial sequence. | *Homo sapiens* | 35,509 | Jan. 3, 1997 |
| | | GB_RO:MUSKROX2S2 | 2868 | M28845 | *Mus musculus* zinc finger protein (Krox-24) gene, exon 2. | *Mus musculus* | 40,566 | May 21, 1996 |
| | | GB_HTG2:AC007440 | 120642 | AC007440 | *Drosophila melanogaster* chromosome 2 clone BACR37I09 (D593) RPCI-98 37.I.9 map 49A-49B strain y; cn bw sp, **SEQUENCING IN PROGRESS**, 103 unordered pieces. | *Drosophila melanogaster* | 38,753 | Aug. 2, 1999 |
| rxa00218 | | | | | | | | |
| rxa00220 | 627 | GB_BA1:ASU04436 | 4668 | U04436 | *Anabaena* sp. PCC 7120 putative polyketide synthase gene, complete cds. | *Anabaena* sp. | 33,766 | Dec. 21, 1993 |
| | | GB_RO:AF068199 | 3490 | AF068199 | *Mus musculus* D-dopachrome tautomerase gene, complete cds. | *Mus musculus* | 38,833 | Aug. 26, 1998 |
| | | GB_RO:AF068199 | 3490 | AF068199 | *Mus musculus* D-dopachrome tautomerase gene, complete cds. | *Mus musculus* | 34,776 | Aug. 26, 1998 |
| rxa00222 | 1269 | GB_PL1:AB011477 | 78181 | AB011477 | *Arabidopsis thaliana* genomic DNA, chromosome 5, P1 clone: MHK7, complete sequence. | *Arabidopsis thaliana* | 36,766 | Nov. 20, 1999 |
| | | GB_EST17:AA615900 | 427 | AA615900 | vo91b05.r1 Barsted mouse irradiated colon MPLRB7 *Mus musculus* cDNA clone IMAGE:1066449 5′ similar to SW:MUCL_RAT P98089 INTESTINAL MUCIN-LIKE PROTEIN; mRNA sequence. | *Mus musculus* | 39,782 | Oct. 7, 1997 |
| | | GB_EST38:AW039188 | 486 | AW039188 | EST281423 tomato mixed elicitor, BTI *Lycopersicon esculentum* cDNA clone cLET9F17, mRNA sequence. | *Lycopersicon esculentum* | 41,286 | Oct. 18, 1999 |
| rxa00230 | 843 | GB_PR3:AC005255 | 94343 | AC005255 | *Homo sapiens* chromosome 19, CIT-HSP-146e8, complete sequence. | *Homo sapiens* | 35,990 | Jul. 6, 1998 |
| | | GB_PR3:AC005255 | 94343 | AC005255 | *Homo sapiens* chromosome 19, CIT-HSP-146e8, complete sequence. | *Homo sapiens* | 38,175 | Jul. 6, 1998 |
| rxa00232 | 633 | GB_HTG2:AC007118 | 200000 | AC007118 | *Homo sapiens* chromosome 4, **SEQUENCING IN PROGRESS**, 45 unordered pieces. | *Homo sapiens* | 36,772 | Mar. 19, 1999 |
| | | GB_HTG2:AC007118 | 200000 | AC007118 | *Homo sapiens* chromosome 4, **SEQUENCING IN PROGRESS**, 45 unordered pieces. | *Homo sapiens* | 36,772 | Mar. 19, 1999 |
| | | GB_GSS1:CNS004WZ | 978 | AL055537 | *Drosophila melanogaster* genome survey sequence TET3 end of BAC # BACR11G02 of | *Drosophila melanogaster* | 34,518 | Jun. 3, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00233 | 517 | GB_BA1:AB06206 | 7443 | AB006206 | RPCI-98 library from *Drosophila melanogaster* (fruit fly), genomic survey sequence. | *Streptomyces griseus* | 38,690 | Feb. 5, 1999 |
| | | GB_PR4:AC006999 | 112878 | AC006999 | *Streptomyces griseus* clone NH0462A19, genomic survey sequence. | *Homo sapiens* | 40,244 | Jul. 17, 1999 |
| | | GB_HTG2:AC007042 | 132400 | AC007042 | *Homo sapiens* clone NH0399H17, **SEQUENCING IN PROGRESS**, 5 unordered pieces. | *Homo sapiens* | 40,244 | Mar. 6, 1999 |
| rxa00234 | 663 | GB_PAT:E13059 | 3480 | E13059 | gDNA encoding cytochrome b5. | unidentified | 40,091 | Jun. 24, 1998 |
| | | GB_PL1:AB022444 | 2104 | AB022444 | *Mortierella alpina* gene for cytochrome b5, complete cds. | *Mortierella alpina* | 42,314 | Jul. 14, 1999 |
| | | GB_GSS9:AQ112619 | 443 | AQ112619 | CIT-HSP-2371D11.TR CIT-HSP *Homo sapiens* genomic clone 2371D11, genomic survey sequence. | *Homo sapiens* | 39,623 | Aug. 29, 1998 |
| rxa00236 | 849 | GB_BA1:CGPROMF34 | 60 | X90361 | *C. glutamicum* DNA for promoter fragment F34. | *Corynebacterium glutamicum* | 98,333 | Nov. 4, 1996 |
| | | GB_IN1:CEF56G4 | 38062 | Z81552 | *Caenorhabditis elegans* cosmid F56G4, complete sequence. | *Caenorhabditis elegans* | 36,190 | Oct. 8, 1999 |
| | | GB_EST16:C51159 | 370 | C51159 | C51159 Yuji Kohara unpublished cDNA: Strain N2 hermaphrodite embryo *Caenorhabditis elegans* cDNA clone yk491h3 5′, mRNA sequence. | *Caenorhabditis elegans* | 41,096 | Oct. 18, 1999 |
| rxa00237 | 501 | GB_GSS9:AQ148605 | 511 | AQ148605 | HS_3137_B2_A11_T7 CIT Approved Human Genomic Sperm Library D *Homo sapiens* genomic clone Plate = 3137 Col = 22 Row = B, genomic survey sequence. | *Homo sapiens* | 37,959 | Oct. 8, 1998 |
| | | GB_GSS11:AQ274889 | 622 | AQ274889 | RPCI-5-1111N8T7 RPCI-5 *Homo sapiens* genomic clone RPCI-5-1111N8T7, genomic survey sequence. | *Homo sapiens* | 44,628 | Nov. 10, 1998 |
| | | GB_GSS11:AQ274889 | 622 | AQ274889 | RPCI-5-1111N8T7 RPCI-5 *Homo sapiens* genomic clone RPCI-5-1111N8T7, genomic survey sequence. | *Homo sapiens* | 37,321 | Nov. 10, 1998 |
| rxa00238 | 492 | GB_PL2:PBU91560 | 2605 | U91560 | *Paracoccidioides brasiliensis* heat shock protein 70 (Hsp70) gene, complete cds. | *Paracoccidioides brasiliensis* | 37,137 | Mar. 12, 1999 |
| | | GB_HTG6:AC007957 | 212658 | AC007957 | *Homo sapiens*, **SEQUENCING IN PROGRESS**, 2 ordered pieces. | *Homo sapiens* | 38,285 | Nov. 26, 1999 |
| | | GB_PR4:AC009288 | 140876 | AC009288 | *Homo sapiens*, complete sequence. | *Homo sapiens* | 36,575 | Nov. 19, 1999 |
| | | GB_PL2:PBU91560 | 2605 | U91560 | *Paracoccidioides brasiliensis* heat shock protein 70 (Hsp70) gene, complete cds. | *Paracoccidioides brasiliensis* | 45,545 | Mar. 12, 1999 |
| rxa00239 | 708 | GB_BA2:CJU96452 | 1450 | U96452 | *Campylobacter jejuni* major outer membrane porin gene, complete cds. | *Campylobacter jejuni* | 37,197 | Dec. 2, 1998 |
| | | GB_RO:RATPF4 | 1675 | M15254 | Rat platelet factor 4 (PF4) gene. | *Rattus norvegicus* | 35,014 | Apr. 27, 1993 |
| | | GB_BA1:CGLYSI | 4232 | X60312 | *C. glutamicum* lysI gene for L-lysine permease. | *Corynebacterium glutamicum* | 46,207 | Jan. 30, 1992 |
| rxa00240 | 333 | GB_PR3:AC005358 | 184886 | AC005358 | *Homo sapiens* chromosome 17, clone hRPK.746__E__8, complete sequence. | *Homo sapiens* | 35,843 | Aug. 29, 1998 |
| | | GB_BA1:CGLYSI | 4232 | X60312 | *C. glutamicum* lysI gene for L-lysine permease. | *Corynebacterium glutamicum* | 42,025 | Jan. 30, 1992 |
| rxa00242 | 1401 | GB_BA1:CGLYSI | 4232 | X60312 | *C. glutamicum* lysI gene for L-lysine permease. | *Corynebacterium glutamicum* | 100,000 | Jan. 30, 1992 |
| | | GB_PR3:HSJ514B11 | 100494 | AL049554 | Human DNA sequence from clone 514B11 on chromosome 6q16.1-21 Contains an EST, STSs and GSSs, complete sequence. | *Homo sapiens* | 37,010 | Nov. 23, 1999 |
| | | GB_HTG3:AC009393 | 137353 | AC009393 | *Drosophila melanogaster* chromosome 3 clone BACR17F05 (D977) RPCI-98 17.F.5 map 87D-87D strain y; cn bw sp; **SEQUENCING IN PROGRESS**, 111 unordered pieces. | *Drosophila melanogaster* | 39,600 | Aug. 27, 1999 |
| rxa00244 | 759 | GB_HTG4:AC011290 | 148409 | AC011290 | *Homo sapiens* clone NH0064I02, **SEQUENCING IN PROGRESS**, 3 unordered pieces. | *Homo sapiens* | 38,102 | Oct. 15, 1999 |
| | | GB_HTG4:AC011290 | 148409 | AC011290 | *Homo sapiens* clone NH0064I02, **SEQUENCING IN PROGRESS**, 3 unordered pieces. | *Homo sapiens* | 38,102 | Oct. 15, 1999 |
| | | GB_EST23:AI077162 | 527 | AI077162 | TENU3384 *T. cruzi* epimastigote normalized cDNA Library *Trypanosoma cruzi* cDNA clone 2866 5′ similar to TRANSPLANTATION ANTIGEN P35B sp|P2359l|TUM3_MOUSE, mRNA sequence. | *Trypanosoma cruzi* | 38,847 | Aug. 10, 1998 |
| rxa00245 | 1608 | GB_HTG2:AC007644 | 141048 | AC007644 | *Homo sapiens* chromosome 17 clone hRPK.19_F_16 map 17, **SEQUENCING IN PROGRESS**, 17 unordered pieces. | *Homo sapiens* | 36,929 | May 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00247 | 1050 | GB_HTG2:AC007644 | 141048 | AC007644 | Homo sapiens chromosome 17 clone hRPK.19_F_16 map 17, *SEQUENCING IN PROGRESS*, 17 unordered pieces. | Homo sapiens | 36,929 | May 23, 1999 |
| | | GB_HTG2:AC007644 | 141048 | AC007644 | Homo sapiens chromosome 17 clone hRPK.19_F_16 map 17, *SEQUENCING IN PROGRESS*, 17 unordered pieces. | Homo sapiens | 34,025 | May 23, 1999 |
| | | GB_PR2:AP000119 | 100000 | AP000119 | Homo sapiens genomic DNA of 21q22.1, GART and AML related, SLC5A3-f4A4 region, segment 2/8, complete sequence. | Homo sapiens | 36,187 | Sep. 25, 1999 |
| | | GB_PR2:AP000051 | 100000 | AP000051 | Homo sapiens genomic DNA, chromosome 21q22.1, segment 22/28, complete sequence. | Homo sapiens | 36,187 | Nov. 20, 1999 |
| | | GB_PR2:AP000166 | 100000 | AP000166 | Homo sapiens genomic DNA, chromosome 21q22.1, D21S226-AML region, clone B2344F14-f50E3, segment 2/9, complete sequence. | Homo sapiens | 37,942 | Nov. 20, 1999 |
| rxa00248 | 846 | GB_PR4:AC006464 | 99908 | AC006464 | Homo sapiens BAC clone NH0436C12 from 2, complete sequence. | Homo sapiens | 36,797 | Oct. 22, 1999 |
| | | GB_PR4:AC006238 | 211945 | AC006238 | Homo sapiens chromosome 18, clone hRPK.474_N_24, complete sequence. | Homo sapiens | 32,896 | Jan. 31, 1999 |
| | | GB_PR4:AC006238 | 211945 | AC006238 | Homo sapiens chromosome 18, clone hRPK.474_N_24, complete sequence. | Homo sapiens | 34,438 | Jan. 31, 1999 |
| rxa00250 | 870 | GB_GSS10:AQ244736 | 469 | AQ244736 | HS_2056_B1_F03_T7 CIT Approved Human Genomic Sperm Library D Homo sapiens genomic clone Plate = 2056 Col = 5 Row = L, genomic survey sequence. | Homo sapiens | 36,310 | Oct. 3, 1998 |
| | | GB_PAT:I07323 | 340 | I07323 | Sequence 5 from Patent EP 0331961. | Unknown. | 38,125 | Dec. 2, 1994 |
| | | GB_PR1:HS11Q13RP | 10777 | Y12377 | H. sapiens FGF/int-2 gene upstream flanking region. | Homo sapiens | 36,155 | Apr. 17, 1997 |
| rxa00252 | 366 | GB_BA1:MTCY20G9 | 37218 | Z77162 | Mycobacterium tuberculosis H37Rv complete genome; segment 25/162. | Mycobacterium tuberculosis | 39,554 | Jun. 17, 1998 |
| | | GB_BA1:MTV004 | 69350 | AL009198 | Mycobacterium tuberculosis H37Rv complete genome; segment 144/162. | Mycobacterium tuberculosis | 40,443 | Jun. 18, 1998 |
| | | GB_BA1:MTV004 | 69350 | AL009198 | Mycobacterium tuberculosis H37Rv complete genome; segment 144/162. | Mycobacterium tuberculosis | 41,803 | Jun. 18, 1998 |
| rxa00256 | 894 | GB_PR4:AC005343 | 137213 | AC005343 | Homo sapiens Chromosome 12p13.3 BAC RPCI11-21K20 (Roswell Park Cancer Institute Human BAC Library) complete sequence. | Homo sapiens | 36,436 | Apr. 2, 1999 |
| | | GB_PR3:AC003005 | 45084 | AC003005 | Human DNA from chromosome 19-specific cosmid F25419 containing ZNF gene family members, genomic sequence, complete sequence. | Homo sapiens | 36,395 | Oct. 22, 1997 |
| | | GB_HTG3:AC007930 | 67668 | AC007930 | Drosophila melanogaster chromosome 2 clone BACR49A06 (D772) RPCI-98 49.A.6 map 43B-43B strain y; cn bw sp, *SEQUENCING IN PROGRESS*, 40 unordered pieces. | Drosophila melanogaster | 32,503 | Sep. 20, 1999 |
| rxa00257 | 579 | GB_PR4:AC005343 | 137213 | AC005343 | Homo sapiens Chromosome 12p13.3 BAC RPCI11-21K20 (Roswell Park Cancer Institute Human BAC Library) complete sequence. | Homo sapiens | 37,063 | Apr. 2, 1999 |
| | | GB_HTG1:HS1096J16 | 194423 | AL121721 | Homo sapiens chromosome 20 clone RP5-1096J16, *SEQUENCING IN PROGRESS*, in unordered pieces. | Homo sapiens | 37,217 | Nov. 23, 1999 |
| | | GB_HTG1:HS1096J16 | 194423 | AL121721 | Homo sapiens chromosome 20 clone RP5-1096J16, *SEQUENCING IN PROGRESS*, in unordered pieces. | Homo sapiens | 37,217 | Nov. 23, 1999 |
| rxa00258 | 795 | GB_PR3:HSI747H23 | 114201 | AL049699 | Human DNA sequence from clone 747H23 on chromosome 6q13-15. Contains the 3' part of the ME1 gene for malic enzyme 1, soluble (NADP-dependent malic enzyme, malate oxidoreductase, EC 1.1.1.40), a novel gene and the 5' part of the gene for N-acetylglucosamine-phosphate mutase. Contains ESTs, STSs, GSSs and two putative CpG islands, complete sequence. | Homo sapiens | 36,469 | Nov. 23, 1999 |
| | | GB_HTG2:HSJ202D23 | 175496 | AL121716 | Homo sapiens chromosome 6 clone RP1-202D23 map q14.1-15, *SEQUENCING IN PROGRESS*, in unordered pieces. | Homo sapiens | 36,469 | Dec. 3, 1999 |
| | | GB_HTG2:HSJ202D23 | 175496 | AL121716 | Homo sapiens chromosome 6 clone RP1-202D23 map q14.1-15, *SEQUENCING IN PROGRESS*, in unordered pieces. | Homo sapiens | 36,469 | Dec. 3, 1999 |
| rxa00260 | 1299 | GB_PR3:HS360B4 | 23388 | AL031716 | Human DNA sequence from clone 360B4 on chromosome 16. Contains part of a gene for a PUTATIVE novel protein similar to predicted bacterial and worm proteins and ESTs, complete sequence. | Homo sapiens | 36,145 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00264 | | GB_EST19:AA741904 | 423 | AA741904 | LmLv39p3/71A Leishmania major promastigote full length cDNA library from early logarithmic stage (day 3) Leishmania major cDNA clone 71A 5', mRNA sequence. | Leishmania major | 39,192 | Dec. 10, 1998 |
| rxa00267 | 441 | GB_PR3:HS360B4 | 23388 | AL031716 | Human DNA sequence from clone 360B4 on chromosome 16. Contains part of a gene for a PUTATIVE novel protein similar to predicted bacterial and worm proteins and ESTs, complete sequence. | Homo sapiens | 39,494 | Nov. 23, 1999 |
| | | GB_GSS10:AQ258013 | 761 | AQ258013 | nbxb0019H05f CUGI Rice BAC Library Oryza sativa genomic clone nbxb0019H05f, genomic survey sequence. | Oryza sativa | 52,033 | Oct. 23, 1998 |
| | | GB_EST10:AA167894 | 552 | AA167894 | CpEST.021 uniZAPCpIOWAspooroLib1 Cryptosporidium parvum cDNA 5' similar to lactate dehydrogenase, mRNA sequence. | Cryptosporidium parvum | 40,462 | Dec. 19, 1996 |
| | | GB_HTG3:AC011591 | 129431 | AC011591 | Homo sapiens chromosome 17 clone 118__B__18 map 17, *SEQUENCING IN PROGRESS*, 25 unordered pieces. | Homo sapiens | 35,469 | Oct. 7, 1999 |
| rxa00271 | 1113 | GB_PL1:CHTRP1 | 3480 | X70035 | C. heterostrophus gene for trifunctional tryptophan synthase. | Cochliobolus heterostrophus | 41,636 | Oct. 31, 1996 |
| | | GB_VI:FLU47643 | 1492 | U47643 | Feline leukemia virus Notch2 gene, clone FeLV/Notch2-AP (subgenomic), partial cds. | Feline leukemia virus | 37,869 | Oct. 25, 1996 |
| | | GB_VI:FLU47644 | 1641 | U47644 | Feline leukemia virus Notch2 gene, clone FeLV/Notch2-B, partial cds. | Feline leukemia virus | 36,441 | Oct. 25, 1996 |
| rxa00272 | 495 | GB_GSS8:AQ041841 | 373 | AQ041841 | CIT-HSP-2335L1.TR CIT-HSP Homo sapiens genomic clone 2335L1, genomic survey sequence. | Homo sapiens | 45,455 | Jul. 14, 1998 |
| | | GB_GSS13:AQ429301 | 591 | AQ429301 | CITBI-E1-2562H16.TR CITBI-E1 Homo sapiens genomic clone 2562H16, genomic survey sequence. | Homo sapiens | 63,636 | Mar. 24, 1999 |
| | | GB_GSS10:AQ237541 | 667 | AQ237541 | RPCI11-61O21.TJB.1 RPCI-11 Homo sapiens genomic clone RPCI-11-61O21, genomic survey sequence. | Homo sapiens | 62,222 | Apr. 21, 1999 |
| rxa00273 | 1236 | GB_BA1:CGBETPGEN | 2339 | X93514 | C. glutamicum betP gene. | Corynebacterium glutamicum | 44,056 | Sep. 8, 1997 |
| | | GB_PR2:HS142F18 | 141672 | AL031073 | Human DNA sequence from clone 142F18 on chromosome Xq26.3-27.2 Contains part of a gene similar to melanoma-associated antigen, EST, GSS and an inverted repeat, complete sequence. | Homo sapiens | 44,643 | Nov. 23, 1999 |
| | | GB_IN2:AC007177 | 101320 | AC007177 | Drosophila melanogaster, chromosome 2R, region 59C1-59C5, P1 clones DS06621 and DS02186, complete sequence. | Drosophila melanogaster | 36,721 | Mar. 27, 1999 |
| rxa00274 | 2733 | GB_HTG3:AC011675 | 98026 | AC011675 | Homo sapiens clone 10_J_17, LOW-PASS SEQUENCE SAMPLING. | Homo sapiens | 35,405 | Oct. 10, 1999 |
| | | GB_HTG3:AC011675 | 98026 | AC011675 | Homo sapiens clone 10_J_17, LOW-PASS SEQUENCE SAMPLING. | Homo sapiens | 35,405 | Oct. 10, 1999 |
| | | GB_HTG3:AC010598 | 174019 | AC010598 | Homo sapiens chromosome 5 clone CIT-HSPC__56009, *SEQUENCING IN PROGRESS*, 50 unordered pieces. | Homo sapiens | 36,908 | Sep. 16, 1999 |
| rxa00275 | 582 | GB_GSS14:AQ574926 | 666 | AQ574926 | nbxb0086K14f CUGI Rice BAC Library Oryza sativa genomic clone nbxb0086K14f, genomic survey sequence. | Oryza sativa | 33,830 | Jun. 2, 1999 |
| | | GB_HTG2:AC004396 | 43686 | AC004396 | Homo sapiens, *SEQUENCING IN PROGRESS*, 2 unordered pieces. | Homo sapiens | 38,298 | Jul. 19, 1999 |
| | | GB_HTG2:AC004396 | 43686 | AC004396 | Homo sapiens, *SEQUENCING IN PROGRESS*, 2 unordered pieces. | Homo sapiens | 38,298 | Jul. 19, 1999 |
| rxa00276 | 465 | GB_PL1:SC9952X | 29286 | Z49212 | S. cerevisiae chromosome XIII cosmid 9952. | Saccharomyces cerevisiae | 37,118 | Aug. 11, 1997 |
| | | GB_PL1:S45357 | 4017 | S45357 | PSE-1 = protein secretion enhancer [Saccharomyces cerevisiae, Genomic, 4017 nt]. | Saccharomyces cerevisiae | 41,394 | May 8, 1993 |
| | | GB_PL1:SCPSE1G | 4017 | Z11538 | S. cerevisiae PSE-1 gene. | Saccharomyces cerevisiae | 41,394 | Aug. 13, 1996 |
| rxa00279 | 1509 | GB_HTG3:AC009911 | 99707 | AC009911 | Drosophila melanogaster chromosome 2 clone BACR01N17 (D1036) RPCI-98 01.N.17 map 38A-38A strain y; cn bw sp; **SEQUENCING IN PROGRESS**, 69 unordered pieces. | Drosophila melanogaster | 33,023 | Oct. 5, 1999 |
| | | GB_HTG3:AC009911 | 99707 | AC009911 | Drosophila melanogaster chromosome 2 clone BACR01N17 (D1036) RPCI-98 01.N.17 map 38A-38A strain y; cn bw sp; **SEQUENCING IN PROGRESS**, 69 unordered pieces. | Drosophila melanogaster | 33,023 | Oct. 5, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG4:AC008397 | 230451 | AC008397 | *Homo sapiens* chromosome 19 clone CIT-HSPC_251H24, *SEQUENCING IN PROGRESS*, 81 unordered pieces. | *Homo sapiens* | 37,432 | Oct. 31, 1999 |
| rxa00282 | 889 | GB_PR3:HSB11B7 | 37290 | Z82171 | Human DNA sequence from cosmid B11B7 on chromosome 22 contains ESTs. | *Homo sapiens* | 35,845 | Nov. 23, 1999 |
| | | GB_PR3:HSB11B7 | 37290 | Z82171 | Human DNA sequence from cosmid B11B7 on chromosome 22 contains ESTs. | *Homo sapiens* | 37,126 | Nov. 23, 1999 |
| | | GB_RO:RATMTA | 4197 | L39264 | *Rattus norvegicus* beta-2 adrenergic receptor gene, complete cds and promoter region. | *Rattus norvegicus* | 41,259 | Feb. 23, 1996 |
| rxa00283 | 1155 | GB_GSS8:AQ030327 | 411 | AQ030327 | HS_2177_B1_H06_MF CIT Approved Human Genomic Sperm Library D *Homo sapiens* genomic clone Plate = 2177 Col = 11 Row = P, genomic survey sequence. | *Homo sapiens* | 37,656 | Jul. 1, 1998 |
| | | GB_PR3:HSL118GB | 27858 | Z68883 | Human DNA sequence from cosmid L118G10, Huntington's Disease Region, chromosome 4p16.3. | *Homo sapiens* | 37,412 | Nov. 23, 1999 |
| rxa00286 | 687 | GB_PR3:HSI513G18 | 110770 | AL109760 | Human DNA sequence from clone 513G18 on chromosome 4, complete sequence. | *Homo sapiens* | 37,412 | Nov. 23, 1999 |
| | | GB_EST10:AA157040 | 414 | AA157040 | zo51c05.r1 Stratagene endothelial cell 937223 *Homo sapiens* cDNA clone IMAGE:590408 5' similar to gb:M84711 40S RIBOSOMAL PROTEIN S3A (HUMAN); mRNA sequence. | *Homo sapiens* | 37,136 | Dec. 11, 1996 |
| | | GB_EST11:AA213935 | 629 | AA213935 | zn57a04.r1 Stratagene muscle 937209 *Homo sapiens* cDNA clone IMAGE:562254 5' similar to gb:M84711 40S RIBOSOMAL PROTEIN S3A (HUMAN); mRNA sequence. | *Homo sapiens* | 34,219 | Aug. 1, 1997 |
| | | GB_STS:BLYBG | 459 | L43987 | *Hordeum vulgare* (clone ABG380) chromosome 4H, 6H, 7H STS mRNA, sequence tagged site. | *Hordeum vulgare* | 37,786 | Jul. 27, 1995 |
| rxa00294 | 552 | GB_PR2:HSAC000121 | 93163 | AC000121 | Human BAC clone RG249A12 from 7q22, complete sequence. | *Homo sapiens* | 36,735 | Jan. 31, 1997 |
| | | GB_BA2:CGU31281 | 1614 | U31281 | *Corynebacterium glutamicum* biotin synthase (bioB) gene, complete cds. | *Corynebacterium glutamicum* | 100,000 | Nov. 21, 1996 |
| rxa00297 | 1035 | GB_PR2:HSAC000121 | 93163 | AC000121 | Human BAC clone RG249A12 from 7q22, complete sequence. | *Homo sapiens* | 37,662 | Jan. 31, 1997 |
| | | GB_HTG2:AC006938 | 82665 | AC006938 | *Drosophila melanogaster* chromosome 2 clone DS01630 (D506) map 60C7-60C8 strain y; cn bw sp, **SEQUENCING IN PROGRESS**, 9 unordered pieces. | *Drosophila melanogaster* | 37,241 | Aug. 2, 1999 |
| | | GB_HTG2:AC007116 | 25478 | AC007116 | *Drosophila melanogaster* chromosome 2 clone DS04467 (D447) map 60C6-60C8 strain y; cn bw sp, **SEQUENCING IN PROGRESS**, 5 unordered pieces. | *Drosophila melanogaster* | 38,630 | Jul. 30, 1999 |
| | | GB_HTG2:AC006938 | 82665 | AC006938 | *Drosophila melanogaster* chromosome 2 clone DS01630 (D506) map 60C7-60C8 strain y; cn bw sp, **SEQUENCING IN PROGRESS**, 9 unordered pieces. | *Drosophila melanogaster* | 37,241 | Aug. 2, 1999 |
| rxa00320 | 303 | GB_GSS14:AQ585202 | 564 | AQ585202 | RPCI-11-451L11.TJ RPCI-11 *Homo sapiens* genomic clone RPCI-11-451L11, genomic survey sequence. | *Homo sapiens* | 37,319 | Jun. 7, 1999 |
| rxa00321 | | GB_BA1:NGPILC1 | 3144 | Y13022 | *N. gonorrhoeae* pilC1 gene, strain 640. | *Neisseria gonorrhoeae* | 38,667 | Oct. 7, 1997 |
| | | GB_BA1:NGPILC1 | 3144 | Y13022 | *N. gonorrhoeae* pilC1 gene, strain 640. | *Neisseria gonorrhoeae* | 36,000 | Oct. 7, 1997 |
| rxa00322 | 1227 | GB_HTG2:AC007533 | 153053 | AC007533 | *Homo sapiens* chromosome 16 clone 474B12, *SEQUENCING IN PROGRESS*, 5 ordered pieces. | *Homo sapiens* | 39,469 | May 12, 1999 |
| | | GB_HTG2:AC007533 | 153053 | AC007533 | *Homo sapiens* chromosome 16 clone 474B12, *SEQUENCING IN PROGRESS*, 5 ordered pieces. | *Homo sapiens* | 39,469 | May 12, 1999 |
| rxa00325 | 768 | GB_PR2:HUM133K23 | 82512 | AC000061 | Human BAC clone 133K23 from 7q31.2, complete sequence. | *Homo sapiens* | 38,950 | Nov. 14, 1996 |
| | | GB_BA2:CDU73860 | 1273 | U73860 | *Corynebacterium diphtheriae* heme oxygenase homolog (hmuO) gene, complete cds. | *Corynebacterium diphtheriae* | 52,604 | Feb. 7, 1997 |
| | | GB_BA1:AB019621 | 652 | AB019621 | *Corynebacterium diphtheriae* mRNA for Heme oxygenase. | *Corynebacterium diphtheriae* | 55,675 | Jul. 31, 1999 |
| | | GB_EST23:AI096171 | 554 | AI096171 | 28 EcoRI Rice Etiolated Leaf cDNA Library *Oryza sativa* cDNA clone RZ513, mRNA sequence. | *Oryza sativa* | 38,536 | Aug. 19, 1998 |
| rxa00326 | 603 | GB_PH:MYP4CG | 11624 | X51522 | Bacteriophage P4 complete DNA genome. | Bacteriophage P4 | 40,577 | Feb. 17, 1997 |
| | | GB_PH:MYP4ALPH | 3063 | X05623 | Bacteriophage P4 alpha gene and cis replication region crr. | Bacteriophage P4 | 38,640 | Sep. 12, 1993 |
| | | GB_IN1:CEF22B3 | 30480 | Z68336 | *Caenorhabditis elegans* cosmid F22B3, complete sequence. | *Caenorhabditis elegans* | 39,012 | Sep. 2, 1999 |
| rxa00334 | 459 | GB_BA1:CGGLNA | 3686 | Y13221 | *Corynebacterium glutamicum* glnA gene. | *Corynebacterium glutamicum* | 37,640 | Aug. 28, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_GSS10:AQ248516 | 259 | AQ248516 | T5J22-Sp6 TAMU *Arabidopsis thaliana* genomic clone T5J22, genomic survey sequence. | *Arabidopsis thaliana* | 38,525 | Oct. 6, 1998 |
| | | GB_BA1:CGGLNA | 3886 | Y13221 | *Corynebacterium glutamicum* glnA gene. | *Corynebacterium glutamicum* | 40,487 | Aug. 28, 1997 |
| rxa00336 | 594 | GB_BA1:CGGLNA | 3686 | Y13221 | *Corynebacterium glutamicum* glnA gene. | *Corynebacterium glutamicum* | 34,797 | Aug. 28, 1997 |
| | | GB_OV:XLFIMB1GN | 7026 | X95549 | *X. faevis* FIM-B.1 gene. | *Xenopus laevis* | 33,217 | Feb. 13, 1997 |
| | | GB_BA1:CGGLNA | 3686 | Y13221 | *Corynebacterium glutamicum* glnA gene. | *Corynebacterium glutamicum* | 37,371 | Aug. 28, 1997 |
| rxa00337 | 1173 | GB_BA1:CGU43536 | 3464 | U43536 | *Corynebacterium glutamicum* heat shock, ATP-binding protein (clpB) gene, complete cds. | *Corynebacterium glutamicum* | 36,406 | Mar. 13, 1997 |
| | | GB_BA1:CGAI4934 | 1160 | AJ004934 | *Corynebacterium glutamicum* dapD gene, complete CDS. | *Corynebacterium glutamicum* | 39,734 | Jun. 17, 1998 |
| | | GB_EST37:AI944838 | 396 | AI944838 | bs06a08.y1 *Drosophila melanogaster* adult testis library *Drosophila melanogaster* cDNA clone bs06a08 5', mRNA sequence. | *Drosophila melanogaster* | 37,626 | Aug. 17, 1999 |
| rxa00338 | 1263 | GB_BA1:BLTRP | 7725 | X04960 | *Brevibacterium lactofermentum* tryptophan operon. | *Corynebacterium glutamicum* | 39,790 | Feb. 10, 1999 |
| | | GB_PAT:E01688 | 7725 | E01688 | Genomic DNA of trp operon of prepibacterium latophelmentamn. | unidentified | 39,871 | Sep. 29, 1997 |
| | | GB_PAT:E01375 | 7726 | E01375 | DNA sequence of tryptophan operon. | *Corynebacterium glutamicum* | 39,871 | Sep. 29, 1997 |
| rxa00339 | 840 | GB_VI:OPU75930 | 131993 | U75930 | *Orgyia pseudotsugata* nuclear polyhedrosis virus complete genome. | *Orgyia pseudotsugata* nuclear polyhedrosis virus | 38,264 | Mar. 6, 1998 |
| | | GB_VI:OPU75930 | 131993 | U75930 | *Orgyia pseudotsugata* nuclear polyhedrosis virus complete genome. | *Orgyia pseudotsugata* nuclear polyhedrosis virus | 38,620 | Mar. 6, 1998 |
| | | GB_HTG3:AC008340 | 126593 | AC008340 | *Drosophila melanogaster* chromosome 2 clone BACR07120 (D918) RPCI-98 07.J.20 map 42D-42E strain y; cn bw sp, **SEQUENCING IN PROGRESS**, 92 unordered pieces. | *Drosophila melanogaster* | 38,193 | Aug. 6, 1999 |
| rxa00342 | 552 | GB_EST34:AI794353 | 636 | AI794353 | fc43d12.y1 Zebrafish WashU MPIMG EST *Danio rerio* cDNA 5' similar to TR:Q62868 Q62868 ROK-ALPHA; mRNA sequence. | *Danio rerio* | 40,283 | Jul. 2, 1999 |
| | | GB_PR2:U73635 | 33676 | U73635 | Human Chromosome 11 Cosmid cSRL156b6, complete sequence. | *Homo sapiens* | 39,366 | Jul. 25, 1997 |
| | | GB_PR2:U73635 | 33676 | U73635 | Human Chromosome 11 Cosmid cSRL156b6, complete sequence. | *Homo sapiens* | 37,970 | Jul. 25, 1997 |
| rxa00344 | 1002 | GB_HTG2:HS312E8 | 33595 | AL032819 | *Homo sapiens* chromosome 16 clone LA16-312E8, **SEQUENCING IN PROGRESS**, in unordered pieces. | *Homo sapiens* | 40,415 | Dec. 3, 1999 |
| | | GB_HTG2:HS312E8 | 33595 | AL032819 | *Homo sapiens* chromosome 16 clone LA16-312E8, **SEQUENCING IN PROGRESS**, in unordered pieces. | *Homo sapiens* | 40,415 | Dec. 3, 1999 |
| | | GB_OM:BOVINOPHOS | 1573 | M55916 | Bovine inositol polyphosphate 1-phosphatase (inositol polyphosphate 1-phosphatase gene) mRNA, complete cds. | *Bos taurus* | 38,420 | Apr. 27, 1993 |
| rxa00349 | 1590 | GB_PR3:HS353E16 | 189765 | AL031591 | Human DNA sequence from clone 353E16 on chromosome 22q11.22-12.3, complete sequence. | *Homo sapiens* | 34,766 | Nov. 23, 1999 |
| | | GB_HTG2:AC005059 | 170128 | AC005059 | *Homo sapiens* clone RG074A24, **SEQUENCING IN PROGRESS**, 25 unordered pieces. | *Homo sapiens* | 37,011 | Mar. 13, 1999 |
| | | GB_HTG2:AC005059 | 170128 | AC005059 | *Homo sapiens* clone RG074A24, **SEQUENCING IN PROGRESS**, 25 unordered pieces. | *Homo sapiens* | 37,011 | Mar. 13, 1999 |
| rxa00353 | 816 | GB_BA1:D87976 | 2352 | D87976 | *Brevibacterium lactofermentum* DNA for D-2-hydroxyisocaproate dehydrogenase (ddh), complete cds. | *Corynebacterium glutamicum* | 39,290 | Feb. 7, 1999 |
| | | GB_BA1:CGDDH | 1829 | Y00151 | *Corynebacterium glutamicum* ddh gene for meso-diaminopimelate D-dehydrogenase (EC 1.4.1.16). | *Corynebacterium glutamicum* | 39,342 | Sep. 12, 1993 |
| | | GB_BA1:CGDDH | 1829 | Y00151 | *Corynebacterium glutamicum* ddh gene for meso-diaminopimelate D-dehydrogenase (EC 1.4.1.16). | *Corynebacterium glutamicum* | 38,624 | Sep. 12, 1993 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00355 | 1143 | GB_BA1:CGDDH | 1829 | Y00151 | *Corynebacterium glutamicum* ddh gene for meso-diaminopimelate D-dehydrogenase (EC 1.4.1.16). | *Corynebacterium glutamicum* | 100,000 | Sep. 12, 1993 |
| | | GB_BA1:D87976 | 2352 | D87976 | *Brevibacterium lactofermentum* DNA for D-2-hydroxyisocaproate dehydrogenase (ddh), complete cds. | *Corynebacterium glutamicum* | 98,411 | Feb. 7, 1999 |
| | | GB_PAT:E14511 | 1034 | E14511 | DNA encoding *Brevibacterium diaminopimelic* acid dehydrogenase. | *Corynebacterium glutamicum* | 100,000 | Jul. 28, 1999 |
| rxa00362 | 1470 | GB_HTG4:AC009043 | 170748 | AC009043 | *Homo sapiens* chromosome 16 clone RPCI-11_184F14, *SEQUENCING IN PROGRESS*, 122 unordered pieces. | *Homo sapiens* | 37,337 | Oct. 31, 1999 |
| | | GB_HTG4:AC009043 | 170748 | AC009043 | *Homo sapiens* chromosome 16 clone RPCI-11_184F14, *SEQUENCING IN PROGRESS*, 122 unordered pieces. | *Homo sapiens* | 37,337 | Oct. 31, 1999 |
| rxa00373 | 439 | GB_PR4:HSZO2TIP09 | 811 | AF177521 | *Homo sapiens* tight junction protein ZO-2 (TJP2) gene, exons 8 and 9. | *Homo sapiens* | 40,758 | Sep. 28, 1999 |
| | | GB_PAT:AR004983 | 2277 | AR004983 | Sequence 5 from U.S. Pat. No. 5747317. | Unknown | 41,638 | Dec. 4, 1998 |
| | | GB_EST37:AI967505 | 380 | AI967505 | Ljimpest03-215-c10 Ljimp Lambda HybriZap two-hybrid library *Lotus japonicus* cDNA clone LP215-03-c10 5' similar to 60S ribosomal protein L39, mRNA sequence. | *Lotus japonicus* | 45,882 | Aug. 24, 1999 |
| rxa00375 | 670 | GB_EST27:AI399460 | 670 | AI399460 | NCSP4F6T7 Subtracted Perithecial *Neurospora crassa* cDNA clone SP4F6_3, mRNA sequence. | *Neurospora crassa* | 38,571 | Feb. 8, 1999 |
| | | GB_IN2:AC004445 | 61852 | AC004445 | *Drosophila melanogaster* DNA sequence (P1 DS00445 (D93)), complete sequence. | *Drosophila melanogaster* | 37,236 | May 1, 1998 |
| | | GB_HTG6:AC011694 | 160557 | AC011694 | *Homo sapiens* clone RP11-19D19, *SEQUENCING IN PROGRESS*, 33 unordered pieces. | *Homo sapiens* | 34,087 | Dec. 3, 1999 |
| | | GB_HTG6:AC011694 | 160557 | AC011694 | *Homo sapiens* clone RP11-19D19, *SEQUENCING IN PROGRESS*, 33 unordered pieces. | *Homo sapiens* | 40,523 | Dec. 3, 1999 |
| rxa00380 | 744 | GB_BA1:COXHSPAB | 2302 | M20482 | *C. burnetii* heat shock operon encoding two heat shock proteins (htpA and htpB), complete cds. | *Coxiella burnetii* | 37,788 | Apr. 26, 1993 |
| | | GB_RO:CBGPIMR | 1735 | Z37977 | *C. barabensis* (griseus) mRNA for glucose phosphate isomerase. | *Cricetulus griseus* | 37,823 | Sep. 14, 1995 |
| | | GB_GSS10:AQ172617 | 505 | AQ172617 | HS_3197_A2_G09_T7, CIT Approved Human Genomic Sperm Library D *Homo sapiens* genomic clone Plate = 3197 Col = 18 Row = M, genomic survey sequence. | *Homo sapiens* | 37,580 | Oct. 17, 1998 |
| rxa00387 | 978 | GB_BA1:MTY25D10 | 40838 | Z95558 | *Mycobacterium tuberculosis* H37Rv complete genome; segment 28/162. | *Mycobacterium tuberculosis* | 60,477 | Jun, 17, 1998 |
| | | GB_BA1:MSGY224 | 40051 | AD000004 | *Mycobacterium tuberculosis* sequence from clone y224. | *Mycobacterium tuberculosis* | 60,270 | Dec. 3, 1996 |
| rxa00390 | 528 | GB_BA1:U00018 | 42991 | U00018 | *Mycobacterium leprae* cosmid B2168. | *Mycobacterium leprae* | 37,913 | Mar. 1, 1994 |
| | | GB_IN1:DMU29153 | 8230 | U29153 | *Drosophila melanogaster* nudel (ndl) mRNA, complete cds. | *Drosophila melanogaster* | 36,190 | Dec. 8, 1995 |
| | | GB_IN1:DMU29153 | 8230 | U29153 | *Drosophila melanogaster* nudel (ndl) mRNA, complete cds. | *Drosophila melanogaster* | 37,202 | Dec. 8, 1995 |
| rxa00392 | 987 | GB_IN2:AE001274 | 268984 | AE001274 | *Leishmania major* chromosome 1, complete sequence. | *Leishmania major* | 37,885 | Mar. 24, 1999 |
| | | GB_EST11:AA270543 | 516 | AA270543 | va68h06.r1 Soares mouse 3NME12.5 *Mus musculus* cDNA clone IMAGE:736571 5', mRNA sequence. | *Mus musculus* | 40,546 | Mar. 26, 1997 |
| rxa00394 | 456 | GB_IN2:AE001274 | 268984 | AE001274 | *Leishmania major* chromosome 1, complete sequence. | *Leishmania major* | 36,103 | Mar. 24, 1999 |
| | | GB_GSS9:AQ158990 | 728 | AQ158990 | nbxb0012L11r CUGI Rice BAC Library *Oryza sativa* genomic clone nbxb0012L11r, genomic survey sequence. | *Oryza sativa* | 41,463 | Sep. 12, 1998 |
| | | GB_GSS12:AQ342952 | 761 | AQ342952 | RPCI11-122O15.TV RPCI-11 *Homo sapiens* genomic clone RPCI-11-122O15, genomic survey sequence. | *Homo sapiens* | 37,556 | May 7, 1999 |
| | | GB_GSS9:AQ158990 | 728 | AQ158990 | nbxb0012L11r CUGI Rice BAC Library *Oryza sativa* genomic clone nbxb0012L11r, genomic survey sequence. | *Oryza sativa* | 37,923 | Sep. 12, 1998 |
| rxa00395 | 423 | GB_PR2:HS1052M9 | 134245 | AL022718 | Human DNA sequence from clone 1052M9 on chromosome Xq25. Contains the SH2D1A gene for SH2 domain protein 1A, Duncan's disease (lymphoproliferative syndrome) (DSHP), part of a 60S Acidic Ribosomal protein 1 (RPLP1) LIKE gene and part of a mouse DOC4 LIKE gene. Contains ESTs and GSSs, complete sequence. | *Homo sapiens* | 43,564 | Nov. 23, 1999 |
| | | GB_BA2:RCPHSYNG | 45959 | Zl1165 | *R. capsulatus* complete photosynthesis gene cluster. | *Rhodobacter capsulatus* | 36,930 | Sep. 2, 1999 |
| | | GB_PR2:HS1052M9 | 134245 | AL022718 | Human DNA sequence from clone 1052M9 on chromosome Xq25. Contains the SH2D1A gene for SH2 domain protein 1A, Duncan's disease (lymphoproliferative syndrome) (DSHP), part of | *Homo sapiens* | 33,981 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00396 | 594 | GB_PL2:AC002311 | 85855 | AC002311 | a 60S Acidic Ribosomal protein 1 (RPLP1) LIKE gene and part of a mouse DOC4 LIKE gene. Contains ESTs and GSSs, complete sequence. | *Arabidopsis thaliana* | 38,957 | Feb. 4, 1998 |
| | | GB_PL2:AC002311 | 85855 | AC002311 | *Arabidopsis thaliana* chromosome I BAC T26I12 genomic sequence, complete sequence. | *Arabidopsis thaliana* | 36,300 | Feb. 4, 1998 |
| rxa00397 | 924 | GB_PL1:HASMT | 27694 | D31785 | *Hansenula wingei* mitochondrial DNA, complete sequence. | *Mitochondrion Pichia canadensis* | 33,985 | Jun. 10, 1999 |
| | | GB_PL1:HASMT | 27694 | D31785 | *Hansenula wingei* mitochondrial DNA, complete sequence. | *Mitochondrion Pichia canadensis* | 33,775 | Jun. 10, 1999 |
| rxa00398 | 873 | GB_HTG1:CNS01DRT | 222150 | AL118557 | *Homo sapiens* chromosome 14 clone R-1033H12, *SEQUENCING IN PROGRESS*, in ordered pieces. | *Homo sapiens* | 35,417 | Sep. 25, 1999 |
| | | GB_HTG1:CNS01DRT | 222150 | AL118557 | *Homo sapiens* chromosome 14 clone R-1033H12, *SEQUENCING IN PROGRESS*, in ordered pieces. | *Homo sapiens* | 35,417 | Sep. 25, 1999 |
| | | GB_HTG1:CNS01DRT | 222150 | AL118557 | *Homo sapiens* chromosome 14 clone R-1033H12, *SEQUENCING IN PROGRESS*, in ordered pieces. | *Homo sapiens* | 38,005 | Sep. 25, 1999 |
| rxa00399 | 438 | GB_IN1:CELC32B5 | 42545 | U80843 | *Caenorhabditis elegans* cosmid C32B5. | *Caenorhabditis elegans* | 36,468 | Dec. 5, 1996 |
| | | GB_IN1:CELC32B5 | 42545 | U80843 | *Caenorhabditis elegans* cosmid C32B5. | *Caenorhabditis elegans* | 40,000 | Dec. 5, 1996 |
| rxa00408 | 570 | GB_PR4:AC005940 | 158414 | AC005940 | *Homo sapiens* chromosome 17, clone hRPK.167_N_20, complete sequence. | *Homo sapiens* | 35,219 | Mar. 18, 1999 |
| | | GB_PR1:HSSERCA11 | 3050 | Y15726 | *Homo sapiens* SERCA3 gene, exons 11-14. | *Homo sapiens* | 35,036 | Jun. 30, 1998 |
| | | GB_PR4:AC005940 | 158414 | AC005940 | *Homo sapiens* chromosome 17, clone hRPK.167_N_20, complete sequence. | *Homo sapiens* | 36,926 | Mar. 18, 1999 |
| rxa00409 | 1536 | GB_PR1:HSSERCA11 | 3050 | Y15726 | *Homo sapiens* SERCA3 gene, exons 11-14. | *Homo sapiens* | 38,555 | Jun. 30, 1998 |
| | | GB_PR4:AC005940 | 158414 | AC005940 | *Homo sapiens* chromosome 17, clone hRPK.167_N_20, complete sequence. | *Homo sapiens* | 36,370 | Mar. 18, 1999 |
| | | GB_PR3:HS591B8 | 142552 | AL035410 | Human DNA sequence from clone 591B8 on chromosome 1p13.1, complete sequence. | *Homo sapiens* | 35,891 | Nov. 23, 1999 |
| rxa00411 | 798 | GB_BA1:AP000003 | 233000 | AP000003 | *Pyrococcus horikoshii* OT3 genomic DNA, 544001-777000 nt. position (3/7). | *Pyrococcus horikoshii* | 36,849 | Feb. 8, 1999 |
| | | GB_PL2:F25A4 | 115721 | AC008263 | *Arabidopsis thaliana* chromosome 1 BAC F25A4 sequence, complete sequence. | *Arabidopsis thaliana* | 37,628 | Sep. 15, 1999 |
| | | GB_PR3:HS413H6 | 142599 | AL022724 | Human DNA sequence from clone 413H8 on chromosome 6p22.3-24.3. Contains a hamster Androgen-dependent Expressed Protein like protein gene, ESTs and GSSs, complete sequence | *Homo sapiens* | 36,755 | Nov. 23, 1999 |
| rxa00416 | 1673 | GB_EST8:C10137 | 360 | C10137 | C10137 Yuji Kohara unpublished cDNA:Strain N2 hermaphrodite embryo *Caenorhabditis elegans* cDNA clone yk188a1 5', mRNA sequence. | *Caenorhabditis elegans* | 35,574 | Oct. 18, 1999 |
| | | GB_EST36:AV186952 | 376 | AV186952 | AV186952 Yuji Kohara unpublished cDNA:Strain N2 hermaphrodite embryo *Caenorhabditis elegans* cDNA clone yk506a5 5', mRNA sequence. | *Caenorhabditis elegans* | 36,702 | Jul. 22, 1999 |
| | | GB_EST16:C48235 | 383 | C48235 | C48235 Yuji Kohara unpublished cDNA:Strain N2 hermaphrodite embryo *Caenorhabditis elegans* cDNA clone yk459h10 5', mRNA sequence. | *Caenorhabditis elegans* | 42,440 | Oct. 18, 1999 |
| rxa00422 | 1017 | GB_BA1:MTCY227 | 35946 | Z77724 | *Mycobacterium tuberculosis* H37Rv complete genome; segment 114/162. | *Mycobacterium tuberculosis* | 39,822 | Jun. 17, 1998 |
| | | GB_BA1:MTV023 | 47852 | AL022022 | *Mycobacterium tuberculosis* H37Rv complete genome; segment 148/162. | *Mycobacterium tuberculosis* | 39,841 | Jun. 17, 1998 |
| rxa00423 | 576 | GB_PR3:AC003091 | 137817 | AC003091 | Human BAC clone RG326G04 from 7p21, complete sequence. | *Homo sapiens* | 36,653 | Nov. 6, 1997 |
| | | GB_BA1:AP000063 | 185300 | AP000063 | *Aeropyrum pernix* genomic DNA, section 6/7. | *Aeropyrum pernix* | 38,908 | Jun. 22, 1999 |
| | | GB_IN1:LDHSP100 | 7726 | Z94053 | *L. donovani* hsp100 gene. | *Leishmania donovani* | 39,646 | Apr. 28, 1997 |
| | | GB_GSS11:AQ274393 | 572 | AQ274393 | nbxb0035G12r CUGI Rice BAC Library *Oryza sativa* genomic clone nbxb0035G12r, genomic survey sequence. | *Oryza sativa* | 35,714 | Nov. 3, 1998 |
| rxa00424 | 594 | GB_BA1:AP000063 | 185300 | AP000063 | *Aeropyrum pernix* genomic DNA, section 6/7. | *Aeropyrum pernix* | 38,225 | Jun. 22, 1999 |
| | | GB_BA1:AP000063 | 185300 | AP000063 | *Aeropyrum pernix* genomic DNA, section 6/7. | *Aeropyrum pernix* | 36,735 | Jun. 22, 1999 |
| | | GB_IN1:LDHSP100 | 7726 | Z94053 | *L. donovani* hsp100 gene. | *Leishmania donovani* | 35,125 | Apr. 28, 1997 |
| rxa00425 | 348 | GB_EST30:AV021214 | 281 | AV021214 | AV021214 *Mus musculus* 18-day embryo C57BL/6J *Mus musculus* cDNA clone 1190021P08, mRNA sequence. | *Mus musculus* | 35,849 | Aug. 28, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00428 | 756 | GB_HTG3:AC009278 | 164119 | AC009278 | Homo sapiens clone 44_J_4, **SEQUENCING IN PROGRESS**, 14 unordered pieces. | Homo sapiens | 36,705 | Aug. 12, 1999 |
| | | GB_HTG3:AC009278 | 164119 | AC009278 | Homo sapiens clone 44_J_4, **SEQUENCING IN PROGRESS**, 14 unordered pieces. | Homo sapiens | 36,705 | Aug. 12, 1999 |
| | | GB_BA2:AF127082 | 10847 | AF127082 | Myxococcus xanthus ATP-dependent protease proteolytic subunit ClpP (clpP), ATP-dependent protease ATPase subunit ClpX (clpX), prolyl endopeptidase precursor Pep (pep), ATP-dependent protease LonV (lonV), oligopeptide permease homolog OppA (oppA), oligopeptide permease homolog OppB (oppB), and oligopeptide permease homolog OppC (oppC) genes, complete cds. | Myxococcus xanthus | 40,995 | May 18, 1999 |
| rxa00429 | | GB_PL1:AB017080 | 653 | AB017080 | Porphyra sp. DNA, internal transcribed spacer 1 (ITS1). | Porphyra sp. | 38,491 | Sep. 10, 1999 |
| | | GB_EST27:AI442425 | 541 | AI442425 | sa2gg05.y1 Gm-c1004 Glycine max cDNA clone GENOME SYSTEMS CLONE ID: GM-c1004-465 5' similar to SW:NDC1_RABIT Q28615 RENAL SODIUM/DICARBOXYLATE COTRANSPORTER, mRNA sequence. | Glycine max | 40,000 | Dec. 1, 1999 |
| | | GB_EST3:R33129 | 440 | R33129 | yh81c08.s1 Soares placenta Nb2HP Homo sapiens cDNA clone IMAGE:136142 3' similar to gb:X53742_mal FIBULIN 1, ISOFORM B PRECURSOR (HUMAN); mRNA sequence. | Homo sapiens | 37,216 | Apr. 28, 1995 |
| | | GB_PH:AF115103 | 40739 | AF115103 | Streptococcus thermophilus bacteriophage Sfi21, complete genome. | Streptococcus thermophilus bacteriophage Sfi21 | 36,069 | Jul. 18, 1999 |
| | | GB_PH:AF115102 | 37370 | AF115102 | Streptococcus thermophilus bacteriophage Sfi19, complete genome. | Streptococcus thermophilus bacteriophage Sfi19 | 36,260 | Jul. 18, 1999 |
| rxa00430 | | GB_BA1:MSGY126 | 37164 | AD000012 | Mycobacterium tuberculosis sequence from clone y126. | Mycobacterium tuberculosis | 55,491 | Dec. 10, 1996 |
| | | GB_BA1:MTY13D12 | 37085 | Z80343 | Mycobacterium tuberculosis H37Rv complete genome; segment 156/162. | Mycobacterium tuberculosis | 55,491 | Jun. 17, 1998 |
| rxa00433 | 648 | GB_BA1:MSGB971CS | 37566 | L78821 | Mycobacterium leprae cosmid B971 DNA sequence. | Mycobacterium leprae | 36,905 | Jun. 15, 1996 |
| | | GB_PR2:AP000073 | 100000 | AP000073 | Homo sapiens genomic DNA, chromosome 8p11.2, senescence gene region, section 9/19, complete sequence. | Homo sapiens | 38,043 | Nov. 20, 1999 |
| | | GB_IN1:CELF29G9 | 42751 | AF016440 | Caenorhabditis elegans cosmid F29G9. | Caenorhabditis elegans | 35,474 | Aug. 7, 1997 |
| | | GB_BA1:MSGY414A | 40121 | AD000007 | Mycobacterium tuberculosis sequence from clone y414a. | Mycobacterium tuberculosis | 36,809 | Dec. 3, 1996 |
| rxa00447 | | | | | | | | |
| rxa00451 | 615 | GB_EST26:AI389267 | 643 | AI389267 | GH20396.5prime GH Drosophila melanogaster head pOT2 Drosophila melanogaster cDNA clone GH20396 5prime, mRNA sequence. | Drosophila melanogaster | 41,085 | Jan. 28, 1999 |
| | | GB_EST37:AI945493 | 574 | AI945493 | bs13e05.y1 Drosophila melanogaster adult testis library Drosophila melanogaster cDNA clone bs13e05 5', mRNA sequence. | Drosophila melanogaster | 44,040 | Aug. 17, 1999 |
| | | GB_GSS11:AQ288118 | 630 | AQ288118 | nbxb0032II8r CUGI Rice BAC Library Oryza sativa genomic clone nbxb0032II8r, genomic survey sequence. | Oryza sativa | 37,885 | Dec. 3, 1998 |
| rxa00455 | 873 | GB_IN1:DMOVO | 6655 | X59772 | D. melanogaster ovo gene required for female germ line development. | Drosophila melanogaster | 35,104 | Feb. 24, 1999 |
| | | GB_EST14:AA390588 | 513 | AA390588 | LD09657.5 prime LD Drosophila melanogaster embryo BlueScript Drosophila melanogaster cDNA clone LD09857 5prime, mRNA sequence. | Drosophila melanogaster | 39,759 | Nov. 28, 1998 |
| | | GB_EST19:AA801874 | 621 | AA801874 | GM03519.5prime GM Drosophila melanogaster ovary BlueScript Drosophila melanogaster cDNA clone GM03519 5prime similar to U11383: ovo FBgn0003028 PID:g520527 SWISS-PROT:P51521, mRNA sequence. | Drosophila melanogaster | 35,437 | Nov. 25, 1998 |
| rxa00457 | 1203 | GB_GSS8:AQ000125 | 398 | AQ000125 | CIT-HSP-2282P3.TF CIT-HSP Homo sapiens genomic clone 2282P3, genomic survey sequence. | Homo sapiens | 41,730 | Jun. 26, 1998 |
| | | GB_IN1:DROADDLIKE | 4209 | L14330 | Drosophila melanogaster adducin-like protein, complete cds. | Drosophila melanogaster | 37,795 | Jun. 11, 1993 |
| | | GB_IN1:DROHTSC | 3922 | L05016 | Drosophila melanogaster hu-li tai shao (hts) mRNA, complete cds. | Drosophila melanogaster | 37,081 | Apr. 26, 1993 |
| rxa00462 | 1503 | GB_HTG3:AC009210 | 103814 | AC009210 | Drosophila melanogaster chromosome 2 clone BACR01I06 (D1054) RPCI-98 01.I.6 map 55D-55D strain y; cn bw sp, *SEQUENCING IN PROGRESS*, 86 unordered pieces. | Drosophila melanogaster | 33,356 | Aug. 20, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00463 | | GB_HTG3:AC009210 | 103814 | AC009210 | Drosophila melanogaster chromosome 2 clone BACR01I06 (D1054) RPCI-98 01.I.6 map 55D-55D strain y; cn bw sp, *SEQUENCING IN PROGRESS*, 86 unordered pieces. | Drosophila melanogaster | 33,356 | Aug. 20, 1999 |
| | | GB_BA1:SCE9 | 37730 | AL049841 | Streptomyces coelicolor cosmid E9. | Streptomyces coelicolor | 37,308 | May 19, 1999 |
| | 945 | GB_BA2:AF052652 | 2096 | AF052652 | Corynebacterium glutamicum homoserine O-acetyltransferase (metA) gene, complete cds. | Corynebacterium glutamicum | 99,481 | Mar. 19, 1998 |
| | | GB_GSS12:AQ407770 | 500 | AQ407770 | HS_5069_B1_F03_T7A RPCI-11 Human Male BAC Library Homo sapiens genomic clone Plate = 645 Col = 5 Row = L, genomic survey sequence. | Homo sapiens | 40,081 | Mar. 17, 1999 |
| | | GB_GSS15:AQ596209 | 358 | AQ596209 | HS_5482_A2_H10_SP6E RPCI-11 Human Male BAC Library Homo sapiens genomic clone Plate = 1058 Col = 20 Row = O, genomic survey sequence. | Homo sapiens | 40,000 | Jun. 8, 1999 |
| rxa00468 | 942 | GB_EST32:AI763196 | 341 | AI763196 | wi65h04.x1 NCI_CGAP_Kid12 Homo sapiens cDNA clone IMAGE:2398231 3', mRNA sequence. | Homo sapiens | 38,824 | Jun. 24, 1999 |
| | | GB_EST17:AA652964 | 329 | AA652964 | ns62e02.s1 NCI_CGAP_Pr22 Homo sapiens cDNA clone IMAGE:1188218 3', mRNA sequence. | Homo sapiens | 41,104 | Nov. 13, 1997 |
| | | GB_EST20:AA864303 | 411 | AA864303 | oh54l02.s1 NCI_CGAP_GC4 Homo sapiens cDNA clone IMAGE:1470435 3', mRNA sequence. | Homo sapiens | 41,422 | May 13, 1998 |
| rxa00469 | 1299 | GB_PR4:AC005988 | 173126 | AC005988 | Homo sapiens chromosome 17, clone hRPK.299_G_24, complete sequence. | Homo sapiens | 34,699 | Jan. 15, 1999 |
| | | GB_PR4:AC005988 | 173126 | AC005988 | Homo sapiens chromosome 17, clone hRPK.299_G_24, complete sequence. | Homo sapiens | 35,725 | Jan. 15, 1999 |
| | | GB_HTG3:AC009116 | 186292 | AC009116 | Homo sapiens chromosome 16 clone RPCI-11_477D3, *SEQUENCING IN PROGRESS*, 47 unordered pieces. | Homo sapiens | 36,222 | Aug. 3, 1999 |
| rxa00472 | 942 | GB_HTG3:AC007882 | 214882 | AC007882 | Homo sapiens clone NH0499D05, *SEQUENCING IN PROGRESS*, 2 unordered pieces. | Homo sapiens | 38,245 | Sep. 8, 1999 |
| | | GB_HTG3:AC007882 | 214882 | AC007882 | Homo sapiens clone NH0499D05, *SEQUENCING IN PROGRESS*, 2 unordered pieces. | Homo sapiens | 38,245 | Sep. 8, 1999 |
| | | GB_PR2:HUAC002038 | 161973 | AC002038 | Homo sapiens chromosome 2 clone 101B6 map 2p11, complete sequence. | Homo sapiens | 37,961 | Jun. 30, 1997 |
| rxa00473 | 912 | GB_HTG3:AC011445 | 144370 | AC011445 | Homo sapiens chromosome 19 clone CIT-HSPC_246B18, *SEQUENCING IN PROGRESS*, 31 unordered pieces. | Homo sapiens | 38,470 | Oct. 7, 1999 |
| | | GB_HTG3:AC011445 | 144370 | AC011445 | Homo sapiens chromosome 19 clone CIT-HSPC_246B18, *SEQUENCING IN PROGRESS*, 31 unordered pieces. | Homo sapiens | 38,470 | Oct. 7, 1999 |
| | | GB_RO:AB026437 | 2097 | AB026437 | Mus musculus DNA, 5' flanking region of interleukin 12 receptor beta 1. | Mus musculus | 40,000 | Oct. 2, 1999 |
| rxa00474 | 1701 | GB_GSS10:AQ223838 | 543 | AQ223838 | HS_2218_A1_H03_MR CIT Approved Human Genomic Sperm Library D Homo sapiens genomic clone Plate = 2218 Col = 5 Row = O, genomic survey sequence. | Homo sapiens | 40,189 | Sep. 20, 1998 |
| | | GB_GSS10:AQ223838 | 543 | AQ223838 | HS_2218_A1_H03_MR CIT Approved Human Genomic Sperm Library D Homo sapiens genomic clone Plate = 2218 Col = 5 Row = O, genomic survey sequence. | Homo sapiens | 37,944 | Sep. 20, 1998 |
| rxa00475 | 783 | GB_PL2:GMAKHSDH2 | 10535 | AF049708 | Glycine max aspartokinase-homoserine dehydrogenase (AK-HSDH) gene, partial cds. | Glycine max | 36,446 | Jul. 7, 1999 |
| | | GB_EST14:AA386651 | 351 | AA386651 | vb54b04.r1 Ko mouse embryo 11 5dpc Mus musculus cDNA clone IMAGE:760783 5', mRNA sequence. | Mus musculus | 41,311 | Apr. 23, 1997 |
| | | GB_EST14:AA386603 | 498 | AA386603 | vb53c02.r1 Ko mouse embryo 11 5dpc Mus musculus cDNA clone IMAGE:760706 5' similar to Mus musculus TR:G56689 G56689 DIMETHYLGLYCINE DEHYDROGENASE; mRNA sequence. | Mus musculus | 40,644 | Apr. 23, 1997 |
| rxa00476 | 984 | GB_GSS5:AQ770769 | 554 | AQ770769 | HS_5357_B2_H01_T7A RPCI-11 Human Male BAC Library Homo sapiens genomic clone Plate = 933 Col = 2 Row = P, genomic survey sequence. | Homo sapiens | 35,560 | Jul. 28, 1999 |
| | | GB_IN1:CEM162 | 39977 | Z82278 | Caenorhabditis elegans cosmid M162, complete sequence. | Caenorhabditis elegans | 34,224 | Nov. 19, 1999 |
| | | GB_IN1:CEM162 | 39977 | Z82278 | Caenorhabditis elegans cosmid M162, complete sequence. | Caenorhabditis elegans | 33,777 | Nov. 19, 1999 |
| rxa00481 | 708 | GB_PR4:AC005013 | 195910 | AC005013 | Homo sapiens BAC clone GS165L15 from 7p15, complete sequence. | Homo sapiens | 35,755 | Nov. 28, 1998 |
| | | GB_HTG1:PFMAL4P4 | 224448 | AL035477 | Plasmodium falciparum chromosome 4 strain 3D7, *SEQUENCING IN PROGRESS*, in unordered pieces. | Plasmodium falciparum | 37,213 | Aug. 11, 1999 |
| | | GB_HTG1:PFMAL4P4 | 224448 | AL035477 | Plasmodium falciparum chromosome 4 strain 3D7, *SEQUENCING IN PROGRESS*, in unordered pieces. | Plasmodium falciparum | 37,213 | Aug. 11, 1999 |
| rxa00485 | 2418 | GB_EST30:AV017239 | 238 | AV017239 | AV017239 Mus musculus 18-day embryo C57BL/6J Mus musculus cDNA clone 1110069G23, | Mus musculus | 39,916 | Aug. 28, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00486 | | GB_EST33:AV093875 | 254 | AV093875 | mRNA sequence. AV093875 *Mus musculus* C57BL/6J ES cell *Mus musculus* cDNA clone 2400006D21, mRNA sequence. | *Mus musculus* | 38,189 | Nov. 22, 1999 |
| | | GB_EST33:AV084536 | 287 | AV084536 | AV084536 *Mus musculus* tongue C57BL/6J adult *Mus musculus* cDNA clone 2310007K01, mRNA sequence. | *Mus musculus* | 37,282 | Jun. 25, 1999 |
| rxa00488 | 1032 | GB_RO:MUSP3VPR2 | 1089 | AF098867 | *Mus* sp. 129SV V3/V1b vasopressin receptor gene, exon 2 and complete cds. | *Mus musculus* | 38,163 | Apr. 28, 1999 |
| | | GB_GSS9:AQ166448 | 407 | AQ166448 | HS_3137_B2_A06_MR CIT Approved Human Genomic Sperm Library D *Homo sapiens* genomic clone Plate = 3137 Col = 12 Row = B, genomic survey sequence. | *Homo sapiens* | 40,250 | Oct. 16, 1998 |
| | | GB_GSS15:AQ614261 | 505 | AQ614261 | HS_5123_B1_F11_SP6E RPCI-11 Human Male BAC Library *Homo sapiens* genomic clone Plate = 699 Col = 21 Row = L, genomic survey sequence. | *Homo sapiens* | 37,905 | Jun. 15, 1999 |
| rxa00490 | 1026 | GB_EST15:AA463205 | 282 | AA463205 | zx71c06.s1 Soares_total_fetus_Nb2HF8_9w *Homo sapiens* cDNA clone IMAGE:796906 3', mRNA sequence. | *Homo sapiens* | 39,502 | Jun. 10, 1997 |
| | | GB_BA1:SLLINC | 36270 | X79146 | S. lincolnensis (7B-11) Lincomycin production genes. | *Streptomyces lincolnensis* | 37,278 | May 15, 1996 |
| | | GB_GSS3:B10984 | 646 | B10984 | F2218-Sp6 IGF *Arabidopsis thaliana* genomic clone F2218, genomic survey sequence. | *Arabidopsis thaliana* | 39,205 | May 14, 1997 |
| rxa00491 | 543 | GB_HTG1:CEY87G2 | 330612 | AL022597 | *Caenorhabditis elegans* chromosome I clone Y87G2, *SEQUENCING IN PROGRESS*, in unordered pieces. | *Caenorhabditis elegans* | 37,405 | Oct. 26, 1999 |
| | | GB_HTG1:CEY87G2 | 330612 | AL022597 | *Caenorhabditis elegans* chromosome I clone Y87G2, *SEQUENCING IN PROGRESS*, in unordered pieces. | *Caenorhabditis elegans* | 37,405 | Oct. 26, 1999 |
| | | GB_HTG1:CEY6B3 | 253516 | Z92865 | *Caenorhabditis elegans* chromosome I clone Y6B3, *SEQUENCING IN PROGRESS*, in unordered pieces. | *Caenorhabditis elegans* | 38,213 | Jul. 30, 1998 |
| rxa00493 | 1737 | GB_BA1:SC6G4 | 41055 | AL031317 | *Streptomyces coelicolor* cosmid 6G4. | *Streptomyces coelicolor* | 61,649 | Aug. 20, 1998 |
| | | GB_BA2:U00015 | 42325 | U00015 | *Mycobacterium leprae* cosmid B1620. | *Mycobacterium leprae* | 38,567 | Mar. 1, 1994 |
| | | GB_BA1:U00020 | 36947 | U00020 | *Mycobacterium leprae* cosmid B229. | *Mycobacterium leprae* | 38,567 | Mar. 1, 1994 |
| rxa00496 | 1149 | GB_VI:TVRNAP | 6404 | X68414 | *Toscana Virus* genomic RNA for RNA-dependent RNA polymerase. | *Toscana virus* | 35,428 | Oct. 27, 1992 |
| | | GB_IN2:DMU09808 | 9239 | U09808 | *Drosophila melanogaster* twisted gastrulation (tsg) and serine protease (gd) genes, complete cds. | *Drosophila melanogaster* | 36,837 | Jun. 25, 1998 |
| | | GB_IN2:DMU09808 | 9239 | U09808 | *Drosophila melanogaster* twisted gastrulation (tsg) and serine protease (gd) genes, complete cds. | *Drosophila melanogaster* | 37,782 | Jun. 25, 1998 |
| rxa00504 | 543 | GB_BA1:MTCY159 | 33818 | Z83863 | *Mycobacterium tuberculosis* H37Rv complete genome; segment 111/162. | *Mycobacterium tuberculosis* | 36,961 | Jun. 17, 1998 |
| | | GB_PR1:HUMHM145 | 2214 | D10925 | Human mRNA for HM145. | *Homo sapiens* | 36,066 | Feb. 3, 1999 |
| | | GB_EST14:AA415083 | 332 | AA415083 | Mg0017 RCW Lambda Zap Express Library *Pyricularia grisea* cDNA clone RCW17 5', mRNA sequence. | *Pyricularia grisea* | 40,181 | Dec. 9, 1999 |
| rxa00505 | 618 | GB_PAT1:I92047 | 551 | I92047 | Sequence 14 from U.S. Pat. No. 5726299. | Unknown. | 46,250 | Dec. 1, 1998 |
| | | GB_PAT1:I78759 | 549 | I78759 | Sequence 15 from U.S. Pat. No. 5693781. | Unknown. | 44,813 | Apr. 3, 1998 |
| | | GB_PAT1:I92048 | 549 | I92048 | Sequence 15 from U.S. Pat. No. 5726299. | Unknown. | 44,813 | Dec. 1, 1998 |
| rxa00507 | 978 | GB_PR2:HS1063B2 | 114596 | AL035683 | Human DNA sequence from clone 1063B2 on chromosome 20q13.1-13.2. Contains the 3' part of the gene for Beta-1,4-galactosyltransferase, ESTs, STSs and GSSs, complete sequence. | *Homo sapiens* | 36,449 | Nov. 23, 1999 |
| | | GB_HTG2:AC007225 | 218892 | AC007225 | *Homo sapiens* chromosome 16 clone 480G7, **SEQUENCING IN PROGRESS**, 38 unordered pieces. | *Homo sapiens* | 36,646 | Apr. 6, 1999 |
| | | GB_HTG2:AC007225 | 218892 | AC007225 | *Homo sapiens* chromosome 16 clone 480G7, **SEQUENCING IN PROGRESS**, 38 unordered pieces. | *Homo sapiens* | 36,646 | Apr. 6, 1999 |
| rxa00510 | 1632 | GB_GSS4:AQ707590 | 499 | AQ707590 | HS_5560_B1_H02_SP6E RPCI-11 Human Male BAC Library *Homo sapiens* genomic clone Plate = 1136 Col = 3 Row = P, genomic survey sequence. | *Homo sapiens* | 37,275 | Jul. 7, 1999 |
| | | GB_GSS4:AQ707590 | 499 | AQ707590 | HS_5560_B1_H02_SP6E RPCI-11 Human Male BAC Library *Homo sapiens* genomic clone Plate = 1136 Col = 3 Row = P, genomic survey sequence. | *Homo sapiens* | 37,275 | Jul. 7, 1999 |
| rxa00515 | 825 | GB_BA1:CGICD | 3595 | X71489 | *C. glutamicum* icd gene for monomeric isocitrate dehydrogenase. | *Corynebacterium glutamicum* | 100,000 | Feb. 17, 1995 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_BA1:CGICD | 3595 | X71489 | *C. glutamicum* icd gene for monomeric isocitrate dehydrogenase. | *Corynebacterium glutamicum* | 38,150 | Feb. 17, 1995 |
| | | GB_GSS13:AQ451896 | 509 | AQ451896 | HS_5184_B1_C03_SP6E RPCI-11 Human Male BAC Library *Homo sapiens* genomic clone Plate = 760 Col = 5 Row = F, genomic survey sequence. | *Homo sapiens* | 36,638 | Apr. 21, 1999 |
| rxa00519 | 2337 | GB_BA1:CGICD | 3595 | X71489 | *C. glutamicum* icd gene for monomeric isocitrate dehydrogenase. | *Corynebacterium glutamicum* | 100,000 | Feb. 17, 1995 |
| | | GB_BA2:AF127018 | 2560 | AF127018 | *Streptomyces coelicolor* isocitrate dehydrogenase (idh) gene, idh-B allele, complete cds. | *Streptomyces coelicolor* | 66,667 | Jun. 1, 1999 |
| | | GB_BA1:AVIICD | 3550 | D73443 | *Azotobacter vinelandii* icd gene for isocitrate dehydrogenase, complete cds. | *Azotobacter vinelandii* | 63,652 | Feb. 4, 1999 |
| rxa00527 | 1887 | GB_PAT:I92049 | 2248 | I92049 | Sequence 16 from U.S. Pat. No. 5726299. | Unknown. | 39,250 | Dec. 1, 1998 |
| | | GB_PAT:I92053 | 2213 | I92053 | Sequence 20 from U.S. Pat. No. 5726299. | Unknown. | 70,635 | Dec. 1, 1998 |
| | | GB_BA1:MTCY98 | 31225 | Z83860 | *Mycobacterium tuberculosis* H37Rv complete genome; segment 103/162. | *Mycobacterium tuberculosis* | 37,741 | Jun. 17, 1998 |
| rxa00528 | 1212 | GB_BA1:MSGY219 | 38721 | AD000013 | *Mycobacterium tuberculosis* sequence from clone y219. | *Mycobacterium tuberculosis* | 68,672 | Dec. 10, 1996 |
| | | GB_BA1:MTCY21D4 | 20760 | Z80775 | *Mycobacterium tuberculosis* H37Rv complete genome; segment 3/262. | *Mycobacterium tuberculosis* | 39,762 | Jun. 24, 1999 |
| rxa00529 | 666 | GB_BA1:SCH24 | 41625 | AL049826 | *Streptomyces coelicolor* cosmid H24. | *Streptomyces coelicolor* | 40,411 | May 11, 1999 |
| | | GB_PR2:HSAC000109 | 41122 | AC000109 | Human Cosmid g0771a222 from 7q31.3, complete sequence. | *Homo sapiens* | 37,462 | Sep. 11, 1997 |
| | | GB_PR2:HSAC000110 | 45508 | AC000110 | Human Cosmid g0771a233, complete sequence. | *Homo sapiens* | 37,462 | Jan. 30, 1997 |
| | | GB_PR2:HSAC000109 | 41122 | AC000109 | Human Cosmid g0771a222 from 7q31.3, complete sequence. | *Homo sapiens* | 39,724 | Sep. 11, 1997 |
| rxa00530 | 1404 | GB_PR3:HS435C23 | 151798 | Z92844 | Human DNA sequence from PAC 435C23 on chromosome X. Contains ESTs. | *Homo sapiens* | 36,482 | Nov. 23, 1999 |
| | | GB_PR3:HS435C23 | 151798 | Z92844 | Human DNA sequence from PAC 435C23 on chromosome X. Contains ESTs. | *Homo sapiens* | 37,918 | Nov. 23, 1999 |
| | | GB_PL1:YSCADE3 | 4883 | M12878 | *Saccharomyces cerevisiae* C-1-tetrahydrofolate synthase (ADE3) gene, complete cds. | *Saccharomyces cerevisiae* | 37,034 | May 11, 1995 |
| rxa00535 | 840 | GB_BA1:CGLEUA | 3492 | X70959 | *C. glutamicum* gene leuA for isopropylmalate synthase. | *Corynebacterium glutamicum* | 100,000 | Feb. 10, 1999 |
| | | GB_BA1:CORASKD | 2957 | L16848 | *Corynebacterium flavum* aspartokinase (ask), and aspartate-semialdehyde dehydrogenase (asd) genes, complete cds. | *Corynebacterium flavescens* | 43,750 | Jun. 11, 1993 |
| | | GB_GSS10:AQ193141 | 515 | AQ193141 | HS_3060_B1_F11_MF CIT Approved Human Genomic Sperm Library D *Homo sapiens* genomic clone Plate = 3060 Col = 21 Row = L, genomic survey sequence. | *Homo sapiens* | 44,773 | Nov. 4, 1998 |
| rxa00540 | 366 | GB_PAT:I92052 | 2115 | I92052 | Sequence 19 from U.S. Pat. No. 5726299. | Unknown. | 74,795 | Dec. 1, 1998 |
| | | GB_HTG2:AC008095 | 126322 | AC008095 | *Drosophila melanogaster* chromosome 2 clone BACR11H16 (D932) RPCI-98 11.H.16 map 52A-52A strain y; cn bw sp, **SEQUENCING IN PROGRESS*, 95 unordered pieces. | *Drosophila melanogaster* | 41,899 | Aug. 2, 1999 |
| | | GB_HTG2:AC008095 | 126322 | AC008095 | *Drosophila melanogaster* chromosome 2 clone BACR11H16 (D932) RPCI-98 11.H.16 map 52A-52A strain y; cn bw sp, **SEQUENCING IN PROGRESS*, 95 unordered pieces. | *Drosophila melanogaster* | 41,899 | Aug. 2, 1999 |
| rxa00547 | 1521 | GB_BA1:MSGY219 | 38721 | AD000013 | *Mycobacterium tuberculosis* sequence from clone y219. | *Mycobacterium tuberculosis* | 36,910 | Dec. 10, 1996 |
| | | GB_BA1:MTCY21D4 | 20760 | Z80775 | *Mycobacterium tuberculosis* H37Rv complete genome; segment 3/262. | *Mycobacterium tuberculosis* | 51,125 | Jun. 24, 1999 |
| | | GB_EST27:AI415174 | 292 | AI415174 | mc05c02.x1 Soares mouse p3NMF19.5 *Mus musculus* cDNA clone IMAGE:338018 3', mRNA sequence. | *Mus musculus* | 39,384 | Feb. 9, 1999 |
| rxa00549 | 1797 | GB_PL2:ATAC007135 | 27313 | AC007135 | *Arabidopsis thaliana* chromosome II BAC F9C22 genomic sequence, complete sequence. | *Arabidopsis thaliana* | 35,584 | May 26, 1999 |
| | | GB_PL2:ATAC006921 | 76042 | AC006921 | *Arabidopsis thaliana* chromosome II BAC F2H17 genomic sequence, complete sequence. | *Arabidopsis thaliana* | 36,581 | Mar. 23, 1999 |
| | | GB_PL2:ATAC007135 | 27313 | AC007135 | *Arabidopsis thaliana* chromosome II BAC F9C22 genomic sequence, complete sequence. | *Arabidopsis thaliana* | 35,827 | May 26, 1999 |
| rxa00550 | | | | | | | | |
| rxa00552 | 1059 | GB_BA1:D90742 | 19201 | D90742 | *Escherichia coli* genomic DNA. (23.8–24.2 min). | *Escherichia coli* | 46,072 | Feb. 7, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00553 | 444 | GB_BA1:ECHTRB | 3129 | X61000 | *E. coli* K12 HtrB gene. | *Escherichia coli* | 39,164 | Jun. 30, 1993 |
| | | GB_BA2:AE000207 | 11148 | AE000207 | *Escherichia coli* K-12 MG1655 section 97 of 400 of the complete genome. | *Escherichia coli* | 46,072 | Nov. 12, 1998 |
| | | GB_EST18:AB009093 | 479 | AB009093 | *Chlamydomonas* W80 lambda ZAP II *Chlamydomonas* sp. cDNA similar to photosystem II 10 kDA protein, mRNA sequence. | *Chlamydomonas* sp. | 41,808 | Dec. 5, 1997 |
| | | GB_EST30:AI640954 | 641 | AI640954 | AEMTAP02 *Aedes aegypti* MT pSPORT Library *Aedes aegypti* cDNA clone AP02 5', mRNA sequence. | *Aedes aegypti* | 38,991 | Apr. 28, 1999 |
| | | GB_GSS13:AQ467517 | 206 | AQ467517 | HS_5219_A2_F02_SP6E RPCI-11 Human Male BAC Library *Homo sapiens* genomic clone Plate = 795 Col = 4 Row = K, genomic survey sequence. | *Homo sapiens* | 45,255 | Apr. 23, 1999 |
| rxa00554 | 594 | GB_EST6:W04418 | 364 | W04418 | za43c06.r1 Soares fetal liver spleen 1NFLS *Homo sapiens* cDNA clone IMAGE:295306 5', mRNA sequence. | *Homo sapiens* | 39,688 | Apr. 22, 1996 |
| | | GB_EST35:AL041829 | 564 | AL041829 | DKFZp434C0318_s1 434 (synonym: htes3) *Homo sapiens* cDNA clone DKFZp434C0318 3', mRNA sequence. | *Homo sapiens* | 40,433 | Sep. 29, 1999 |
| | | GB_EST35:AL041828 | 386 | AL041828 | DKFZp434C0318_r1 434 (synonym: htes3) *Homo sapiens* cDNA clone DKFZp434C0318 5', mRNA sequence. | *Homo sapiens* | 39,688 | Sep. 29, 1999 |
| rxa00555 | | | | | | | | |
| rxa00560 | 498 | GB_BA1:MTCY7H7A | 10451 | Z95618 | *Mycobacterium tuberculosis* H37Rv complete genome; segment 39/162. | *Mycobacterium tuberculosis* | 52,727 | Jun. 17, 1998 |
| | | GB_BA1:BAPURF | 1885 | X91252 | *B. ammoniagenes* purF gene. | *Corynebacterium ammoniagenes* | 61,092 | Jun. 5, 1997 |
| | | GB_PL1:YSCMET10A | 3650 | L26504 | *Saccharomyces carlsbergensis* assimilatory sulfite reductase (MET10) gene, complete cds. | *Saccharomyces pastorianus* | 41,273 | Feb. 7, 1995 |
| rxa00563 | 2762 | GB_BA1:BAFASAA | 10549 | X64795 | *B. ammoniagenes* FAS gene. | *Corynebacterium ammoniagenes* | 66,910 | Oct. 14, 1997 |
| | | GB_BA1:MTCY159 | 33818 | Z83863 | *Mycobacterium tuberculosis* H37Rv complete genome, segment 111/162. | *Mycobacterium tuberculosis* | 40,066 | Jun. 17, 1998 |
| rxa00564 | 528 | GB_BA1:MBU36763 | 8391 | U36763 | *Mycobacterium bovis* fatty acid synthase gene, complete cds. | *Mycobacterium bovis* | 61,178 | Jul. 15, 1996 |
| | | GB_PR3:HS833B7 | 86574 | AL008637 | Human DNA sequence from clone 833B7 on chromosome 22q12.3-13.2 Contains genes for NCF4 (P40PHOX) protein, cytokine receptor common beta chain precursor CSF2RB (partial), ESTs, CA repeat, STS, GSS, complete sequence. | *Homo sapiens* | 39,015 | Nov. 23, 1999 |
| rxa00573 | | GB_HTG3:AC008543 | 278334 | AC008543 | *Homo sapiens* chromosome 19 clone CIT-HSPC_499B15, *SEQUENCING IN PROGRESS*, 134 unordered pieces. | *Homo sapiens* | 36,328 | Sep. 2, 1999 |
| rxa00574 | 1002 | GB_HTG3:AC008543 | 278334 | AC008543 | *Homo sapiens* chromosome 19 clone CIT-HSPC_499B15, *SEQUENCING IN PROGRESS*, 134 unordered pieces. | *Homo sapiens* | 36,328 | Sep. 2, 1999 |
| | | GB_GSS11:AQ301816 | 481 | AQ301816 | HS_3174_A1_B04_T7 CIT Approved Human Genomic Sperm Library D *Homo sapiens* genomic clone Plate = 3174 Col = 7 Row = C, genomic survey sequence. | *Homo sapiens* | 43,137 | Dec. 16, 1998 |
| | | GB_PR3:AC004537 | 88872 | AC004537 | *Homo sapiens* PAC clone DJ0872F07 from 7q31, complete sequence. | *Homo sapiens* | 34,712 | Apr. 9, 1998 |
| | | GB_EST29:AI563059 | 339 | AI563059 | EST00183 watermelon lambda zap library *Citrullus lanatus* cDNA clone WMI.S355 5' similar to unknown protein, mRNA sequence. | *Citrullus lanatus* | 37,758 | Mar. 26, 1999 |
| rxa00576 | 795 | GB_EST37:AI947508 | 533 | AI947508 | 603022E09.x1 603 - stressed root cDNA library from Wang/Bohnert lab *Zea mays* cDNA, mRNA sequence. | *Zea mays* | 38,728 | Aug. 19, 1999 |
| | | GB_GSS11:AQ296770 | 347 | AQ296770 | HS_3087_A2_B12_MF CIT Approved Human Genomic Sperm Library D *Homo sapiens* genomic clone Plate = 3087 Col = 24 Row = C, genomic survey sequence. | *Homo sapiens* | 40,058 | Dec. 15, 1998 |
| | | GB_GSS13:AQ503769 | 589 | AQ503769 | RPCI-11-282O13.TV RPCI-11 *Homo sapiens* genomic clone RPCI-11-282O13, genomic survey sequence. | *Homo sapiens* | 37,993 | Apr. 29, 1999 |
| rxa00577 | 471 | GB_GSS14:AQ553027 | 638 | AQ553027 | RPCI-11-351M24.TJ RPCI-11 *Homo sapiens* genomic clone RPCI-11-351M24, genomic survey | *Homo sapiens* | 34,944 | May 18, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | | | | sequence. | | | |
| rxa00578 | | GB_PR3:HS440B3 | 28047 | AL022331 | Homo sapiens DNA sequence from clone 440B3 on chromosome 22q12.1-3 Contains a pseudogene similar to 60S Ribosomal protein L17. Contains ESTs and an STS (genomic marker D22S1176), complete cds. | Homo sapiens | 33,626 | Nov. 23, 1999 |
| rxa00582 | 642 | GB_PL2:ZEU19267 | 1230 | U19267 | Zinnia elegans cysteine proteinase mRNA, complete cds. | Zinnia elegans | 35,456 | Aug. 26, 1996 |
| | | GB_BA1:CORAHPS | 2570 | L07603 | Corynebacterium glutamicum 3-deoxy-D-arabinoheptulosonate-7-phosphate synthase gene, complete cds. | Corynebacterium glutamicum | 98,901 | Apr. 26, 1993 |
| | | GB_PR3:AC005389 | 120359 | AC005389 | Homo sapiens chromosome 17, clone hRPK.601_N_13, complete sequence. | Homo sapiens | 38,315 | Aug. 14, 1998 |
| | | GB_HTG6:AC008002 | 126629 | AC008002 | Drosophila melanogaster chromosome 2 clone BACR48E08 (D843) RPCI-98 48.E.8 map 21D-21E strain y; cn bw sp, **SEQUENCING IN PROGRESS*, 85 unordered pieces. | Drosophila melanogaster | 32,437 | Dec. 7, 1999 |
| rxa00585 | 441 | GB_BA1:CORAHPS | 2570 | L07603 | Corynebacterium glutamicum 3-deoxy-D-arabinoheptulosonate-7-phosphate synthase gene, complete cds. | Corynebacterium glutamicum | 98,039 | Apr. 26, 1993 |
| | | GB_PR4:AC004970 | 149951 | AC004970 | Homo sapiens BAC clone DJ1122F04 from 7q11.23-q21.2, complete sequence. | Homo sapiens | 39,900 | Aug. 27, 1999 |
| | | GB_PR2:HS102G20 | 99207 | Z99127 | Human DNA sequence from PAC 102G20 on chromosome 1q24-q25. Contains ESTs, STSs and a predicted CpG Island. | Homo sapiens | 41,509 | Nov. 23, 1999 |
| rxa00586 | 1005 | GB_BA1:MTV017 | 67200 | AL021897 | Mycobacterium tuberculosis H37Rv complete genome; segment 48/162. | Mycobacterium tuberculosis | 56,219 | Jun. 24, 1999 |
| | | GB_BA1:MLU15183 | 36800 | U15183 | Mycobacterium leprae cosmid B1740. | Mycobacterium leprae | 55,622 | Mar. 9, 1995 |
| | | GB_BA1:MTV017 | 67200 | AL021897 | Mycobacterium tuberculosis H37Rv complete genome; segment 48/162. | Mycobacterium tuberculosis | 37,838 | Jun. 24, 1999 |
| rxa00587 | 459 | GB_EST37:AI993539 | 514 | AI993539 | 701496589 A. thaliana, Ohio State clone set Arabidopsis thaliana cDNA clone 701496589, mRNA sequence. | Arabidopsis thaliana | 40,153 | Sep. 8, 1999 |
| | | GB_GSS10:AQ224941 | 511 | AQ224941 | HS_2009_B1_B06_T7 CIT Approved Human Genomic Sperm Library D Homo sapiens genomic clone Plate = 2009 Col = 11 Row = D, genomic survey sequence. | Homo sapiens | 43,750 | Sep. 20, 1998 |
| rxa00589 | 573 | GB_EST23:AI099719 | 475 | AI099719 | 33872 Lambda-PRL2 Arabidopsis thaliana cDNA clone 120M10XP 3', mRNA sequence. | Arabidopsis thaliana | 36,752 | Aug. 21, 1998 |
| | | GB_PL2:ATAC003673 | 70575 | AC003673 | Arabidopsis thaliana chromosome II BAC F19F24 genomic sequence, complete sequence. | Arabidopsis thaliana | 39,785 | Apr. 1, 1998 |
| | | GB_PR3:HS427A4 | 149466 | Z98049 | Human DNA sequence from PAC 427A4 on chromosome 6q26-q27. Contains ribosomal protein S6 kinase, RSK3, ESTs, CpG island. | Homo sapiens | 35,145 | Nov. 23, 1999 |
| rxa00595 | | GB_PL2:ATAC005724 | 86671 | AC005724 | Arabidopsis thaliana chromosome II P1 MSF3 genomic sequence, complete sequence. | Arabidopsis thaliana | 39,785 | Jan. 24, 1999 |
| rxa00597 | 393 | GB_PR3:AC004659 | 129577 | AC004659 | Homo sapiens chromosome 19, CIT-HSP-87m17 BAC clone, complete sequence. | Homo sapiens | 39,459 | May 2, 1998 |
| | | GB_GSS14:AQ575039 | 927 | AQ575039 | nbxb00086L01r CUGI Rice BAC Library Oryza sativa genomic clone nbxb00086L01r, genomic survey sequence. | Oryza sativa | 37,786 | Jun. 2, 1999 |
| rxa00598 | | GB_BA1:NMRRNA | 5209 | X72495 | N. magadii rRNA operon. | Natrialba magadii | 39,788 | Feb. 10, 1995 |
| rxa00601 | 414 | GB_BA2:AF175719 | 1368 | AF175719 | Porphyromonas gingivalis strain W50 immunoreactive 51 kD antigen PG52 gene, complete cds. | Porphyromonas gingivalis | 35,331 | Aug. 23, 1999 |
| | | GB_GSS9:AQ140775 | 464 | AQ140775 | HS_3128_A1_B11_MR CIT Approved Human Genomic Sperm Library D Homo sapiens genomic clone Plate = 3128 Col = 21 Row = C, genomic survey sequence. | Homo sapiens | 40,431 | Sep. 24, 1998 |
| | | GB_EST8:AA018824 | 542 | AA018824 | ze57e09.s1 Soares retina N2b4HR Homo sapiens cDNA clone IMAGE:363112 3', mRNA sequence. | Homo sapiens | 40,590 | Jan. 30, 1997 |
| rxa00602 | 876 | GB_EST30:AI642687 | 479 | AI642687 | vw02h03.x1 Soares mouse mammary gland NbMMG Mus musculus cDNA clone IMAGE:1230773 3', mRNA sequence. | Mus musculus | 40,042 | Apr. 29, 1999 |
| | | GB_EST20:AA879989 | 412 | AA879989 | vw03a05.r1 Soares mouse mammary gland NbMMG Mus musculus cDNA clone IMAGE:1230800 5', mRNA sequence. | Mus musculus | 39,948 | Mar. 26, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00604 | 438 | GB_EST28:AI481047 | 438 | AI481047 | vf91a05.x1 Soares mouse mammary gland NbMMG Mus musculus cDNA clone IMAGE:851120 3′, mRNA sequence. | Mus musculus | 38,128 | Mar. 9, 1999 |
|  | 414 | GB_HTG2:AC008205 | 131658 | AC008205 | Drosophila melanogaster chromosome 3 clone BACR33F18 (D764) RPCI-98 33.F.18 map 96A-96B strain y; cn bw sp, **SEQUENCING IN PROGRESS*, 118 unordered pieces. | Drosophila melanogaster | 33,907 | Aug. 2, 1999 |
|  |  | GB_HTG2:AC008205 | 131658 | AC008205 | Drosophila melanogaster chromosome 3 clone BACR33F18 (D764) RPCI-98 33.F.18 map 96A-96B strain y; cn bw sp, **SEQUENCING IN PROGRESS*, 118 unordered pieces. | Drosophila melanogaster | 33,907 | Aug. 2, 1999 |
| rxa00610 | 987 | GB_IN1:DMBR7C10 | 56820 | AL121804 | Drosophila melanogaster chromosome 3 clone BACR7C10. | Drosophila melanogaster | 44,267 | Oct. 10, 1999 |
|  |  | GB_BA1:SME242575 | 1403 | AJ242575 | Sinorhizobium meliloti partial oxi1 and dehydrogenase genes, isolate lpu119. | Sinorhizobium meliloti | 41,760 | May 26, 1999 |
|  |  | GB_PR3:AC004655 | 134929 | AC004655 | Homo sapiens Xp22-140-141 BAC GSHB-128G5 (Genome Systems Human BAC library) complete sequence. | Homo sapiens | 38,422 | Sep. 17, 1998 |
|  |  | GB_PR3:HS598F2 | 99886 | AL021579 | Human DNA sequence from clone 598F2 on chromosome 1q23.1-24.3 Contains ESTs, STS and GSS, complete sequence. | Homo sapiens | 38,351 | Nov. 23, 1999 |
| rxa00611 | 1599 | GB_HTG2:AC007108 | 190000 | AC007108 | Homo sapiens chromosome 4, **SEQUENCING IN PROGRESS*, 24 unordered pieces. | Homo sapiens | 17,451 | Mar. 17, 1999 |
|  |  | GB_HTG2:AC007108 | 190000 | AC007108 | Homo sapiens chromosome 4, **SEQUENCING IN PROGRESS*, 24 unordered pieces. | Homo sapiens | 17,451 | Mar. 17, 1999 |
|  |  | GB_HTG4:AC010893 | 176176 | AC010893 | Homo sapiens chromosome unknown clone NH0480A20, WORKING DRAFT SEQUENCE, in unordered pieces. | Homo sapiens | 35,819 | Oct. 29, 1999 |
| rxa00613 | 576 | GB_IN2:AC004361 | 87747 | AC004361 | Drosophila melanogaster DNA sequence (P1 DS07851 (D49)), complete sequence. | Drosophila melanogaster | 35,081 | May 29, 1998 |
|  |  | GB_PL2:AC006268 | 105420 | AC006268 | Arabidopsis thaliana BAC T24G23 from chromosome IV near 21 cM, complete sequence. | Arabidopsis thaliana | 43,682 | Jan. 1, 1999 |
|  |  | GB_BA1:MLCB596 | 38426 | AL035472 | Mycobacterium leprae cosmid B596. | Mycobacterium leprae | 35,026 | Aug. 27, 1999 |
| rxa00614 | 1038 | GB_BA1:MTV025 | 121125 | AL022121 | Mycobacterium tuberculosis H37Rv complete genome; segment 155/162. | Mycobacterium tuberculosis | 53,061 | Jun. 24, 1999 |
|  |  | GB_BA1:SCH66 | 9153 | AL049731 | Streptomyces coelicolor cosmid H66. | Streptomyces coelicolor | 52,817 | Apr. 29, 1999 |
|  |  | GB_EST14:AA446728 | 411 | AA446728 | zw84f03.r1 Soares_total_fetus_Nb2HF8_9w Homo sapiens cDNA clone IMAGE:783677 5′, mRNA sequence. | Homo sapiens | 36,548 | Jun. 3, 1997 |
| rxa00616 |  |  |  |  |  |  |  |  |
| rxa00617 | 351 | GB_PL1:AB009030 | 2589 | AB009030 | Panax ginseng OSCPNY1 mRNA for beta-Amyrin Synthase, complete cds. | Panax ginseng | 39,048 | Oct. 3, 1998 |
|  |  | GB_PR3:HS905G11 | 122469 | AL035045 | Human DNA sequence from clone 905G11 on chromosome 20p11.2-12.1 Contains STSs, GSSs and genomic marker D20S182, complete sequence. | Homo sapiens | 39,255 | Nov. 23, 1999 |
| rxa00628 | 531 | GB_RO:MMT1CPS | 8147 | X15147 | Mouse T1a region T1c pseudogene for class I antigen major histocompatibility complex. | Mus musculus | 36,311 | Feb. 19, 1990 |
|  |  | GB_HTG5:AC010674 | 220575 | AC010674 | Homo sapiens chromosome 15 clone RP11-430B1 map 15q21, **SEQUENCING IN PROGRESS*, 46 ordered pieces. | Homo sapiens | 37,714 | Nov. 5, 1999 |
|  |  | GB_HTG5:AC010674 | 220575 | AC010674 | Homo sapiens chromosome 15 clone RP11-430B1 map 15q21, **SEQUENCING IN PROGRESS*, 46 ordered pieces. | Homo sapiens | 39,293 | Nov. 5, 1999 |
| rxa00631 | 1578 | GB_BA1:BRLBIOAD | 2272 | D14083 | Brevibacterium flavum genes for 7,8-diaminopelargonic acid aminotransferase and dethiobiotin synthetase, complete cds. | Corynebacterium glutamicum | 47,368 | Feb. 3, 1999 |
|  |  | GB_PAT:E04041 | 675 | E04041 | DNA sequence coding for desthiobiotinsynthetase. | Corynebacterium glutamicum | 46,552 | Sep. 29, 1997 |
|  |  | GB_EST20:AA820386 | 453 | AA820386 | LD23968.5prime LD Drosophila melanogaster embryo pOT2 Drosophila melanogaster cDNA clone LD23968 5prime, mRNA sequence. | Drosophila melanogaster | 45,679 | Feb. 25, 1999 |
| rxa00637 | 876 | GB_HTG2:AC007589 | 134659 | AC007589 | Drosophila melanogaster chromosome 3 clone BACR20D10 (D667) RPCI-98 20.D.10 map 82D-82E strain y; cn bw sp, **SEQUENCING IN PROGRESS*, 73 unordered pieces. | Drosophila melanogaster | 32,102 | Aug. 2, 1999 |
|  |  | GB_HTG2:AC007589 | 134659 | AC007589 | Drosophila melanogaster chromosome 3 clone BACR20D10 (D667) RPCI-98 20.D.10 map 82D-82E strain y; cn bw sp, **SEQUENCING IN PROGRESS*, 73 unordered pieces. | Drosophila melanogaster | 32,102 | Aug. 2, 1999 |
|  |  | GB_HTG3:AC009212 | 125452 | AC009212 | Drosophila melanogaster chromosome 3 clone BACR01A18 (D669) RPCI-98 01.A.18 map 82E-82F strain y; cn bw sp, **SEQUENCING IN PROGRESS*, 119 unordered pieces. | Drosophila melanogaster | 37,126 | Aug. 23, 1999 |
| rxa00646 | 541 | GB_HTG1:AP000488 | 123363 | AP000488 | Homo sapiens chromosome 11 clone B75OH8 map 11q23, ****SEQUENCING IN | Homo sapiens | 38,264 | Sep. 13, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00647 | | GB_HTG1:AP000488 | 123363 | AP000488 | *Homo sapiens* chromosome 11 clone B759H8 map 11q23, **SEQUENCING IN PROGRESS*, in unordered pieces. | *Homo sapiens* | 38,264 | Sep. 13, 1999 |
| | | GB_HTG1:AP000488 | 123363 | AP000488 | *Homo sapiens* chromosome 11 clone B759H8 map 11q23, **SEQUENCING IN PROGRESS*, in unordered pieces. | *Homo sapiens* | 36,484 | Sep. 13, 1999 |
| | 756 | GB_GSS13:AQ431426 | 536 | AQ431426 | HS_5140_A2_E01_T7A RPCI-11 Human Male BAC Library *Homo sapiens* genomic clone Plate = 716 Col = 2 Row = I, genomic survey sequence. | *Homo sapiens* | 35,635 | Mar. 31, 1999 |
| | | GB_OV:CHKP4HA | 3149 | M26217 | Chicken prolyl 4-hydroxylase alpha subunit gene, 3′ end. | *Gallus gallus* | 40,655 | Apr. 28, 1993 |
| | | GB_HTG2:AC008271 | 168302 | AC008271 | *Homo sapiens* clone NH0123E16, **SEQUENCING IN PROGRESS*, 2 unordered pieces. | *Homo sapiens* | 37,417 | Jul. 31, 1999 |
| rxa00649 | 579 | GB_PR2:AC002563 | 136436 | AC002563 | Human PAC clone 127H14 from 12q, complete sequence. | *Homo sapiens* | 37,937 | Sep. 26, 1997 |
| | | GB_HTG3:AC011466 | 165953 | AC011466 | *Homo sapiens* chromosome 19 clone CIT-HSPC_453G23, **SEQUENCING IN PROGRESS*, 74 unordered pieces. | *Homo sapiens* | 38,179 | Oct. 7, 1999 |
| rxa00652 | | GB_HTG3:AC011466 | 165953 | AC011466 | *Homo sapiens* chromosome 19 clone CIT-HSPC_453G23, **SEQUENCING IN PROGRESS*, 74 unordered pieces. | *Homo sapiens* | 38,179 | Oct. 7, 1999 |
| rxa00653 | | | | | | | | |
| rxa00654 | 1389 | GB_EST1:Z34080 | 271 | Z34080 | ATTS3128 Grenoble-B *Arabidopsis thaliana* cDNA clone GBGe328 5′, mRNA sequence. | *Arabidopsis thaliana* | 40,370 | Jun. 6, 1994 |
| | | GB_PR3:AC004460 | 113803 | AC004460 | *Homo sapiens* PAC clone DJ1086D14, complete sequence. | *Homo sapiens* | 36,150 | Mar. 24, 1998 |
| | | GB_GSS6:AQ835185 | 571 | AQ835185 | HS_4832_A1_E02_T7A CIT Approved Human Genomic Sperm Library D *Homo sapiens* genomic clone Plate = 4832 Col = 3 Row = I, genomic survey sequence | *Homo sapiens* | 39,429 | Aug. 27, 1999 |
| rxa00656 | 384 | GB_HTG3:AC009948 | 172463 | AC009948 | *Homo sapiens* clone NH0065L03, **SEQUENCING IN PROGRESS*, 2 unordered pieces. | *Homo sapiens* | 43,164 | Sep. 25, 1999 |
| | | GB_HTG3:AC009948 | 172463 | AC009948 | *Homo sapiens* clone NH0065L03, **SEQUENCING IN PROGRESS*, 2 unordered pieces. | *Homo sapiens* | 43,164 | Sep. 25, 1999 |
| | | GB_GSS13:AQ462899 | 522 | AQ462899 | HS_5212_A1_C09_T7A RPCI-11 Human Male BAC Library *Homo sapiens* genomic clone Plate = 788 Col = 17 Row = E, genomic survey sequence. | *Homo sapiens* | 42,529 | Apr. 23, 1999 |
| rxa00657 | 1026 | GB_BA2:AF064700 | 3481 | AF064700 | *Rhodococcus* sp. NO1-1 CprS and CprR genes, complete cds. | *Rhodococcus* sp. NO1-1 | 40,558 | Jul. 15, 1998 |
| | | GB_PR3:AC005346 | 38849 | AC005346 | *Homo sapiens* chromosome 16, cosmid clone 2H2 (LANL), complete sequence. | *Homo sapiens* | 35,553 | Jul. 31, 1998 |
| | | GB_HTG3:AC008905 | 129915 | AC008905 | *Homo sapiens* chromosome 5 clone CITB-H1_2259I14, **SEQUENCING IN PROGRESS*, 40 unordered pieces. | *Homo sapiens* | 37,179 | Aug. 3, 1999 |
| rxa00661 | 813 | GB_PL2:AC006193 | 118335 | AC006193 | *Arabidopsis thaliana* chromosome I BAC F13O11 genomic sequence, complete sequence. | *Arabidopsis thaliana* | 35,513 | Jun. 11, 1999 |
| | | GB_RO:MMFABPE | 6593 | AJ223066 | *Mus musculus* Fabpe gene. | *Mus musculus* | 37,500 | Jul. 27, 1998 |
| | | GB_PL2:AC006193 | 118335 | AC006193 | *Arabidopsis thaliana* chromosome I BAC F13O11 genomic sequence, complete sequence. | *Arabidopsis thaliana* | 33,552 | Jun. 11, 1999 |
| rxa00662 | 1392 | GB_EST29:AI551960 | 718 | AI551960 | vi48d09.y1 Beddington mouse embryonic region *Mus musculus* cDNA clone IMAGE:907025 5′ similar to gb:D10576 Mouse mRNA for ubiquitin activating enzyme E1 (MOUSE); mRNA sequence. | *Mus musculus* | 39,972 | Mar. 23, 1999 |
| | | GB_BA2:AE000633 | 19734 | AE000633 | *Helicobacter pylori* 26695 section 111 of 134 of the complete genome. | *Helicobacter pylori* 26695 | 36,606 | Apr. 6, 1999 |
| | | GB_GSS10:AQ216730 | 529 | AQ216730 | HS_2262_A1_G06_MR CIT Approved Human Genomic Sperm Library D *Homo sapiens* genomic clone Plate = 2262 Col = 11 Row = M, genomic survey sequence. | *Homo sapiens* | 32,703 | Sep. 19, 1998 |
| rxa00666 | 1038 | GB_HTG3:AC009205 | 113482 | AC009205 | *Drosophila melanogaster* chromosome 2 clone BACR04C20 (D1035) RPCI-98 04.C.20 map 36E-37C strain y; cn bw sp, **SEQUENCING IN PROGRESS*, 101 unordered pieces. | *Drosophila melanogaster* | 36,713 | Sep. 17, 1999 |
| | | GB_EST25:AI259480 | 626 | AI259480 | LP02903.5prime LP *Drosophila melanogaster* larval-early pupal pOT2 *Drosophila melanogaster* cDNA clone LP02903 5prime, mRNA sequence. | *Drosophila melanogaster* | 37,173 | Nov. 17, 1998 |
| | | GB_HTG3:AC009205 | 113482 | AC009205 | *Drosophila melanogaster* chromosome 2 clone BACR04C20 (D1035) RPCI-98 04.C.20 map 36E-37C strain y; cn bw sp, **SEQUENCING IN PROGRESS*, 101 unordered pieces. | *Drosophila melanogaster* | 36,713 | Sep. 17, 1999 |
| rxa00667 | 1137 | GB_PAT:AR048317 | 2627 | AR048317 | Sequence 3 from U.S. Pat. No. 5821090. | Unknown. | 39,805 | Sep. 29, 1999 |
| | | GB_PAT:A46560 | 2627 | A46560 | Sequence 3 from Patent WO 9526406. | *Eremothecium gossypii* | 39,805 | Mar. 7, 1997 |
| | | GB_VI:HEHCMVCG | 229354 | X17403 | Human cytomegalovirus strain AD169 complete genome. | human herpesvirus 5 | 39,854 | Feb. 10, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00676 | 870 | GB_HTG1:CEY38F1 | 178443 | Z98861 | *Caenorhabditis elegans* chromosome II clone Y38F1, *SEQUENCING IN PROGRESS*, in unordered pieces. | *Caenorhabditis elegans* | 35,880 | Dec. 3, 1998 |
|  |  | GB_HTG1:CEY38F1 | 178443 | Z98861 | *Caenorhabditis elegans* chromosome II clone Y38F1, *SEQUENCING IN PROGRESS*, in unordered pieces. | *Caenorhabditis elegans* | 35,880 | Dec. 3, 1998 |
|  |  | GB_PR3:HS934G17 | 107603 | AL021155 | *Homo sapiens* DNA sequence from PAC 934G17 on chromosome 1p36.21. Contains the alternatively spliced CLCN6 gene for chloride chanel proteins CLC-6A (KIAA0046) -B, -C and -D, the alternatively spliced NPPA gene coding for Atrial Natriuretic Factor ANF precursor (Atrial Natriuretic peptide ANP, Prepronatriodilatin), the NPPB gene for Brain Natriuretic Protein BNP, and a pseudogene similar to SBF 1 (and other Myotubularin-related protein genes). Contains ESTs, STSs and the genomic marker DIS2740, complete sequence. | *Homo sapiens* | 38,489 | Nov. 23, 1999 |
| rxa00678 | 858 | GB_PR2:CNS00004 | 205573 | AL049778 | Human chromosome 14, DNA sequence *IN PROGRESS* BAC R-643C12 of RPCI-11 library from chromosome 14 of *Homo sapiens* (Human), complete sequence. | *Homo sapiens* | 33,138 | Jun. 17, 1999 |
|  |  | GB_GSS1:AG000894 | 723 | AG000894 | *Homo sapiens* genomic DNA, 21q region, clone: 64E11X19, genomic survey sequence. | *Homo sapiens* | 37,391 | Feb. 6, 1999 |
|  |  | GB_IN1:TSMIEXRNA | 481 | X90847 | *Trypanosoma simiae* mini-exon DNA. | *Trypanosoma simiae* | 35,135 | Feb. 15, 1999 |
| rxa00691 | 1053 | GB_EST26:AA899042 | 505 | AA899042 | UI-R-E0-bz-a-06-0-UI s2 UI-R-E0 *Rattus norvegicus* cDNA clone UI-R-F0-bz-a-06-0-UI 3' similar to gi|485266|gb|U09256|RNU09256 *Rattus norvegicus* Sprague-Dawley transketolase mRNA, complete cds, mRNA sequence. | *Rattus norvegicus* | 41,400 | Jul. 4, 1999 |
|  |  | GB_RO:RNU09256 | 2098 | U09256 | *Rattus norvegicus* Sprague-Dawley transketolase mRNA, complete cds. | *Rattus norvegicus* | 39,652 | May 11, 1994 |
|  |  | GB_EST29:AI599628 | 510 | AI599628 | EST251331 Normalized rat embryo, Bento Soares *Rattus* sp. cDNA clone REMEH65 3' end, mRNA sequence. | *Rattus* sp. | 39,096 | Apr. 21, 1999 |
| rxa00692 | 1257 | GB_PL2:SPU66305 | 8226 | U66305 | *Schizosaccharomyces pombe* ABC transporter (mam1) gene, complete cds. | *Schizosaccharomyces pombe* | 36,842 | Jul. 30, 1997 |
|  |  | GB_PL1:SPBC25B2 | 26016 | AL031853 | *S. pombe* chromosome II cosmid c25B2. | *Schizosaccharomyces pombe* | 36,803 | Oct. 9, 1998 |
|  |  | GB_PL1:SPBC2G5 | 23645 | AL033385 | *S. pombe* chromosome II cosmid c2G5. | *Schizosaccharomyces pombe* | 36,803 | Dec. 4, 1998 |
| rxa00693 | 606 | GB_BA2:RRU65510 | 16259 | U65510 | *Rhodospirillum rubrum* CO-induced hydrogenase operon (cooM, cooK, cooL, cooX, cooU, cooH) genes, iron sulfur protein (cooF) gene, carbon monoxide dehydrogenase (cooS) gene, carbon monoxide dehydrogenase accessory proteins (cooC, cooT, cooJ) genes, putative transcriptional activator (cooA) gene, nicotinate-nucleotide pyrophosphorylase (nadC) gene, complete cds, L-aspartate oxidase (nadB) gene, and alkyl hydroperoxide reductase (ahpC) gene, partial cds. | *Rhodospirillum rubrum* | 41,970 | Apr. 9, 1997 |
| rxa00701 | 498 | GB_PL1:LETHM27 | 1152 | X95296 | *L. esculentum* mRNA for THM27 protein. | *Lycopersicon esculentum* | 38,919 | Jun. 10, 1996 |
|  |  | GB_EST38:AW033855 | 646 | AW033855 | EST277426 tomato callus, TAMU *Lycopersicon esculentum* cDNA clone cLEC29F6 similar to transcription factor, myb-related, mRNA sequence. | *Lycopersicon esculentum* | 35,945 | Sep. 15, 1999 |
|  |  | GB_EST34:AI785570 | 454 | AI785570 | uj44d03.x1 Sugano mouse liver mlia *Mus musculus* cDNA clone IMAGE:1922789 3' similar to gb:Z28407 60S RIBOSOMAL PROTEIN L8 (HUMAN); mRNA sequence. | *Mus musculus* | 37,565 | Jul. 2, 1999 |
|  |  | GB_EST25:AI256147 | 684 | AI256147 | ui95e12.x1 Sugano mouse liver mlia *Mus musculus* cDNA clone IMAGE:1890190 3' similar to gb:Z28407 60S RIBOSOMAL PROTEIN L8 (HUMAN); mRNA sequence. | *Mus musculus* | 41,232 | Nov. 12, 1998 |
| rxa00704 | 2079 | GB_BA1:CARCG12 | 456 | X14979 | *C. aurantiacus* reaction center genes 1 and 2. | *Chloroflexus aurantiacus* | 36,943 | Apr. 23, 1991 |
|  | 750 | GB_EST15:AA497266 | 515 | AA497266 | fa04f08.s1 Zebrafish ICRF zfls *Danio rerio* cDNA clone 3A13 3', mRNA sequence. | *Danio rerio* | 38,631 | Jun. 30, 1997 |
|  |  | GB_EST36:AI884217 | 110000 | AI884217 | fc75e10.x1 Zebrafish WashU MPIMG EST *Danio rerio* cDNA 3', mRNA sequence. | *Danio rerio* | 38,012 | Jul. 26, 1999 |
|  |  | GB_HTG1:CEY43F8_1 |  | Z95393 | *Caenorhabditis elegans* chromosome V clone Y43F8, *SEQUENCING IN PROGRESS*, in unordered pieces. | *Caenorhabditis elegans* | 37,889 | Z95393 |
| rxa00707 | 906 | GB_GSS8:AQ013755 | 715 | AQ013755 | RPCI11-23F24.TKBF RPCI-11 *Homo sapiens* genomic clone RPCI-11-23F24, genomic survey | *Homo sapiens* | 41,724 | Apr. 14, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | | | | sequence. | | | |
| | | GB_GSS3:B86449 | 434 | B86449 | RPCI11-23F24.TV RPCI-11 Homo sapiens genomic clone RPCI-11-23F24, genomic survey sequence. | Homo sapiens | 42,936 | Apr. 9, 1999 |
| | | GB_GSS5:AQ797072 | 449 | AQ797072 | nbxb0071D10f CUGI Rice BAC Library Oryza sativa genomic clone nbxb0071D10f, genomic survey sequence. | Oryza sativa | 39,101 | Aug. 4, 1999 |
| rxa00712 | 819 | GB_BA2:AF011544 | 7527 | AF011544 | Bacillus subtilis phosphoribosylaminoimidazole-carboxamide formyltransferase (purH-J) gene, partial cds, phosphoribosylglycinamide synthetase (purD), YecA (yecA), putative adenine deaminase (yecB), YecC (yecC), and YecD (yecD) genes, complete cds, and putative glutamate synthase (yecE) gene, partial cds. | Bacillus subtilis | 36,927 | Oct. 6, 1997 |
| | | GB_BA2:AF011544 | 7527 | AF011544 | Bacillus subtilis phosphoribosylaminoimidazole-carboxamide formyltransferase (purH-J) gene, partial cds, phosphoribosylglycinamide synthetase (purD), YecA (yecA), putative adenine deaminase (yecB), YecC (yecC), and YecD (yecD) genes, complete cds, and putative glutamate synthase (yecE) gene, partial cds. | Bacillus subtilis | 39,752 | Oct. 6, 1997 |
| rxa00713 | 1056 | GB_PAT:I92037 | 241 | I92037 | Sequence 4 from U.S. Pat. No. 5726299. | Unknown. | 99,048 | Dec. 1, 1998 |
| | | GB_PAT:I78748 | 241 | I78748 | Sequence 4 from U.S. Pat. No. 5693781. | Unknown. | 99,048 | Apr. 3, 1998 |
| | | GB_HTG3:AC009281 | 221178 | AC009281 | Homo sapiens chromosome 15 clone 8_C_22 map 15, **SEQUENCING IN PROGRESS**, 49 unordered pieces. | Homo sapiens | 36,255 | Aug. 12, 1999 |
| rxa00714 | 684 | GB_PL1:CCR5839 | 871 | AI005839 | Cyclotella cryptica mRNA for fucoxanthin chlorophyll a/c binding protein, fcp12. | Cyclotella cryptica | 36,364 | Jul. 30, 1998 |
| | | GB_PR2:HS1002M8 | 111768 | AL035454 | Human DNA sequence from clone 1002M8 on chromosome 20p11.21-11.23, complete sequence. | Homo sapiens | 36,444 | Nov. 23, 1999 |
| | | GB_PR2:HS1002M8 | 111768 | AL035454 | Human DNA sequence from clone 1002M8 on chromosome 20p11.21-11.23, complete sequence. | Homo sapiens | 34,894 | Nov. 23, 1999 |
| rxa00716 | 636 | GB_PAT:I78753 | 1187 | I78753 | Sequence 9 from U.S. Pat. No. 5693781. | Unknown. | 36,022 | Apr. 3, 1998 |
| | | GB_PAT:I92042 | 1187 | I92042 | Sequence 9 from U.S. Pat. No. 5726299. | Unknown. | 36,022 | Dec. 1, 1998 |
| | | GB_HTG3:AC005769 | 200000 | AC005769 | Homo sapiens chromosome 4, **SEQUENCING IN PROGRESS**, 5 unordered pieces. | Homo sapiens | 36,745 | Aug. 21, 1999 |
| rxa00719 | 1752 | GB_BA2:U32687 | 11847 | U32687 | Haemophilus influenzae Rd section 2 of 163 of the complete genome. | Haemophilus influenzae Rd | 36,937 | May 29, 1998 |
| | | GB_EST13:AA333602 | 357 | AA333602 | EST37710 Embryo, 8 week I Homo sapiens cDNA 5' end similar to guanine nucleotide-binding protein rap2, ras-oncogene related, mRNA sequence. | Homo sapiens | 45,938 | Apr. 21, 1997 |
| | | GB_BA2:U32687 | 11847 | U32687 | Haemophilus influenzae Rd section 2 of 163 of the complete genome. | Haemophilus influenzae Rd | 36,390 | May 29, 1998 |
| rxa00720 | 789 | GB_EST1:M61974 | 437 | M61974 | EST00024 Fetal brain, Stratagene (cat#936206) Homo sapiens cDNA clone HFBA87, mRNA sequence. | Homo sapiens | 40,138 | May 26, 1992 |
| | | GB_EST3:R73776 | 389 | R73776 | yi55h07.r1 Soares placenta Nb2HP Homo sapiens cDNA clone IMAGE:143197 5', mRNA sequence. | Homo sapiens | 41,818 | Jun. 5, 1995 |
| | | GB_EST35:AL043192 | 793 | AL043192 | DKFZp434G0723_r1 434 (synonym: htes3) Homo sapiens cDNA clone DKFZp434G0723 5', mRNA sequence. | Homo sapiens | 38,571 | Sep. 29, 1999 |
| rxa00722 | 1088 | GB_HTG3:AC008573 | 205755 | AC008573 | Homo sapiens chromosome 5 clone CIT-HSPC_551/11, **SEQUENCING IN PROGRESS**, 95 unordered pieces. | Homo sapiens | 38,506 | Aug. 3, 1999 |
| | | GB_HTG3:AC008573 | 205755 | AC008573 | Homo sapiens chromosome 5 clone CIT-HSPC_551/11, **SEQUENCING IN PROGRESS**, 95 unordered pieces. | Homo sapiens | 38,506 | Aug. 3, 1999 |
| | | GB_BA1:MTV014 | 58280 | AL021646 | Mycobacterium tuberculosis H37Rv complete genome; segment 137/162. | Mycobacterium tuberculosis | 41,392 | Jun. 18, 1998 |
| rxa00724 | 2100 | GB_BA1:SC7A1 | 32039 | AL034447 | Streptomyces coelicolor cosmid 7A1. | Streptomyces coelicolor | 54,858 | Dec. 15, 1998 |
| | | GB_BA1:BSY13937 | 27779 | Y13937 | Bacillus subtilis genomic DNA from the spoVM region. | Bacillus subtilis | 47,010 | Mar. 30, 1998 |
| | | GB_BA2:L78127 | 1225 | L78127 | Enterococcus faecium genomic DNA fragment. | Enterococcus faecium | 36,880 | Aug. 18, 1999 |
| rxa00726 | 614 | GB_BA1:BACJH642 | 282700 | D84432 | Bacillus subtilis DNA, 283 Kb region containing skin element. | Bacillus subtilis | 56,694 | Feb. 6, 1999 |
| | | GB_BA1:BSUB0013 | 218470 | Z99116 | Bacillus subtilis complete genome (section 13 of 21): from 2395261 to 2613730. | Bacillus subtilis | 36,513 | Nov. 26, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00729 | | GB_BA1:SC4H8 | 15560 | AL020958 | *Streptomyces coelicolor* cosmid 4H8. | *Streptomyces coelicolor* | 35,073 | Dec. 10, 1997 |
| rxa00730 | 930 | GB_HTG3:AC010758 | 145821 | AC010758 | *Homo sapiens* clone 1_B_18, *SEQUENCING IN PROGRESS*, 20 unordered pieces. | *Homo sapiens* | 35,738 | Sep. 22, 1999 |
| | | GB_HTG3:AC010758 | 145821 | AC010758 | *Homo sapiens* clone 1_B_18, *SEQUENCING IN PROGRESS*, 20 unordered pieces. | *Homo sapiens* | 35,738 | Sep. 22, 1999 |
| | | GB_GSS13:AQ469090 | 414 | AQ469090 | CITBI-E1-2596D12.TF CITBI-E1 *Homo sapiens* genomic clone 2596D12, genomic survey sequence. | *Homo sapiens* | 36,842 | Apr. 23, 1999 |
| rxa00731 | 2619 | GB_BA1:CGLYSI | 4232 | X60312 | *C. glutamicum* lysI gene for L-lysine permease. | *Corynebacterium glutamicum* | 100,000 | Jan. 30, 1992 |
| | | GB_BA1:CGLYSI | 4232 | X60312 | *C. glutamicum* lysI gene for L-lysine permease. | *Corynebacterium glutamicum* | 37,645 | Jan. 30, 1992 |
| rxa00738 | 386 | GB_BA1:MTCY10G2 | 38970 | Z92539 | *Mycobacterium tuberculosis* H37Rv complete genome; segment 47/162. | *Mycobacterium tuberculosis* | 54,427 | Jun. 17, 1998 |
| | | GB_HTG1:HSJ564F22 | 106277 | AL080249 | *Homo sapiens* chromosome 20 clone RP4-564F22, *SEQUENCING IN PROGRESS*, in unordered pieces. | *Homo sapiens* | 44,000 | Nov. 23, 1999 |
| | | GB_HTG1:HSJ564F22 | 106277 | AL080249 | *Homo sapiens* chromosome 20 clone RP4-564F22, *SEQUENCING IN PROGRESS*, in unordered pieces. | *Homo sapiens* | 44,000 | Nov. 23, 1999 |
| rxa00740 | 702 | GB_PL2:AF100167 | 1557 | AF100167 | *Glycine max* unknown mRNA. | *Glycine max* | 35,823 | Nov. 4, 1998 |
| | | GB_EST28:AI465702 | 268 | AI465702 | vw83g01.y1 Stratagene mouse skin (#937313) *Mus musculus* cDNA clone IMAGE:1261584 5′, mRNA sequence. | *Mus musculus* | 43,226 | Mar. 9, 1999 |
| | | GB_EST20:AA856157 | 359 | AA856157 | vw83g01.r1 Stratagene mouse skin (#937313) *Mus musculus* cDNA clone IMAGE:1261584 5′, mRNA sequence. | *Mus musculus* | 43,226 | Mar. 6, 1998 |
| rxa00741 | 1056 | GB_HTG2:AC007185 | 199340 | AC007185 | *Drosophila melanogaster* chromosome 2 clone BACR44N04 (D545) RPCI-98 44.N.4 map 36A—36A strain y; cn bw sp, *SEQUENCING IN PROGRESS*, 50 unordered pieces. | *Drosophila melanogaster* | 39,583 | Aug. 2, 1999 |
| | | GB_HTG2:AC007185 | 199340 | AC007185 | *Drosophila melanogaster* chromosome 2 clone BACR44N04 (D545) RPCI-98 44.N.4 map 36A—36A strain y; cn bw sp, *SEQUENCING IN PROGRESS*, 50 unordered pieces. | *Drosophila melanogaster* | 39,583 | Aug. 2, 1999 |
| rxa00742 | 1773 | GB_PL2:F17123 | 134784 | AF160182 | *Arabidopsis thaliana* BAC F17123. | *Arabidopsis thaliana* | 37,788 | Jun. 20, 1999 |
| | | GB_IN1:CEC05C10 | 26263 | Z48178 | *Caenorhabditis elegans* cosmid C05C10, complete sequence. | *Caenorhabditis elegans* | 39,243 | Sep. 2, 1999 |
| | | GB_IN1:CEC05C10 | 26263 | Z48178 | *Caenorhabditis elegans* cosmid C05C10, complete sequence. | *Caenorhabditis elegans* | 38,041 | Sep. 2, 1999 |
| rxa00743 | 546 | GB_GSS9:AQ093649 | 320 | AQ093649 | HS_3022_A1_E06_MR CIT Approved Human Genomic Sperm Library D *Homo sapiens* genomic clone Plate = 3022 Col = 11 Row = I, genomic survey sequence. | *Homo sapiens* | 34,277 | Aug. 27, 1998 |
| | | GB_GSS9:AQ093649 | 320 | AQ093649 | HS_3022_A1_E06_MR CIT Approved Human Genomic Sperm Library D *Homo sapiens* genomic clone Plate = 3022 Col = 11 Row = I, genomic survey sequence. | *Homo sapiens* | 34,277 | Aug. 27, 1998 |
| rxa00745 | 657 | GB_HTG2:AC008195 | 130309 | AC008195 | *Drosophila melanogaster* chromosome 3 clone BACR42I20 (D748) RPCI-98 42.I.20 map 93F—93F strain y; cn bw sp, *SEQUENCING IN PROGRESS*, 77 unordered pieces. | *Drosophila melanogaster* | 38,095 | Aug. 2, 1999 |
| | | GB_IN2:DMU53190 | 3477 | U53190 | *Drosophila melanogaster* Camguk (cmg) mRNA, complete cds. | *Drosophila melanogaster* | 39,623 | Nov. 30, 1998 |
| | | GB_HTG2:AC008195 | 130309 | AC008195 | *Drosophila melanogaster* chromosome 3 clone BACR42I20 (D748) RPCI-98 42.I.20 map 93F—93F strain y; cn bw sp, *SEQUENCING IN PROGRESS*, 77 unordered pieces. | *Drosophila melanogaster* | 38,095 | Aug. 2, 1999 |
| rxa00746 | 1314 | GB_HTG3:AC010076 | 148614 | AC010076 | *Homo sapiens* chromosome 15 clone BAC 64K10 map 14q25, LOW-PASS SEQUENCE SAMPLING. | *Homo sapiens* | 36,336 | Sep. 11, 1999 |
| | | GB_HTG3:AC010076 | 148614 | AC010076 | *Homo sapiens* chromosome 15 clone BAC 64K10 map 14q25, LOW-PASS SEQUENCE SAMPLING. | *Homo sapiens* | 36,336 | Sep. 11, 1999 |
| | | GB_PR3:HS402G11 | 177241 | AL022328 | Human DNA sequence from clone 402G11 on chromosome 22q13.31-13.33 Contains genes for SAPK3 (stress-activated protein kinase 3). PRKM11 (protein kinase mitogen-activated 11), KIAA0315, ESTs, GSSs and CpG islands, complete sequence. | *Homo sapiens* | 38,752 | Nov. 23, 1999 |
| rxa00747 | 711 | GB_HTG4:AC010081 | 176777 | AC010081 | *Homo sapiens* clone NH0065E07, *SEQUENCING IN PROGRESS*, 1 unordered pieces. | *Homo sapiens* | 37,016 | Oct. 29, 1999 |
| | | GB_HTG4:AC010081 | 176777 | AC010081 | *Homo sapiens* clone NH0065E07, *SEQUENCING IN PROGRESS*, 1 unordered pieces. | *Homo sapiens* | 37,016 | Oct. 29, 1999 |

US 6,962,989 B1

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG3:AC011194 | 196098 | AC011194 | Mus musculus chromosome 11 clone 196_F_5 map 11, **SEQUENCING IN PROGRESS**, 32 unordered pieces. | Mus musculus | 38,735 | Oct. 1, 1999 |
| rxa00748 | 567 | GB_GSS13:AQ457887 | 478 | AQ457887 | HS_5189_B2_B06_SP6E RPCI-11 Human Male BAC Library Homo sapiens genomic clone Plate = 765 Col = 12 Row = D, genomic survey sequence. | Homo sapiens | 37,844 | Apr. 23, 1999 |
| | | GB_IN1:EHEXRIDRI | 170 | X58630 | E. histolytica extrachromosomal ribosomal DNA for DRA I repeat unit. | Entamoeba histolytica | 42,353 | Aug. 13, 1991 |
| | | GB_IN1:EHEXRDNA | 3699 | X61182 | E. histolytica extrachromosomal ribosomal DNA downstream of rRNA genes. | Entamoeba histolytica | 38,905 | Sep. 2, 1996 |
| rxa00749 | 822 | GB_BA1:BSUB0003 | 209100 | Z99106 | Bacillus subtilis complete genome (section 3 of 21): from 402751 to 611850. | Bacillus subtilis | 37,238 | Nov. 26, 1997 |
| | | GB_BA1:AB001488 | 148068 | AB001488 | Bacillus subtilis genome sequence, 148 kb sequence of the region between 35 and 47 degree. | Bacillus subtilis | 37,238 | Feb. 13, 1999 |
| | | GB_HTG3:AC008060 | 161486 | AC008060 | Homo sapiens clone DJ0912I13, **SEQUENCING IN PROGRESS**, 4 unordered pieces. | Homo sapiens | 39,474 | Aug. 13, 1999 |
| rxa00750 | | | | | | | | |
| rxa00751 | 951 | GB_PR4:AC006449 | 286758 | AC006449 | Homo sapiens chromosome 17, clone hCIT.58_E_17, complete sequence. | Homo sapiens | 38,223 | Oct. 23, 1999 |
| | | GB_HTG2:AC002118 | 170891 | AC002118 | Homo sapiens chromosome 17 clone 303_E_14, **SEQUENCING IN PROGRESS**, 20 unordered pieces. | Homo sapiens | 37,112 | Feb. 13, 1998 |
| rxa00752 | 552 | GB_HTG2:AC002118 | 170891 | AC002118 | Homo sapiens chromosome 17 clone 303_E_14, **SEQUENCING IN PROGRESS**, 20 unordered pieces. | Homo sapiens | 37,112 | Feb. 13, 1998 |
| | | GB_PL2:F5K24 | 109786 | AF128395 | Arabidopsis thaliana BAC F5K24. | Arabidopsis thaliana | 38,899 | Mar. 3, 1999 |
| | | GB_BA1:MBHRDED | 6300 | Y09870 | M. barkeri hdrE & hdrD genes, ORF1, ORF2, ORF3 & ORF4. | Methanosarcina barkeri | 40,609 | Dec. 4, 1998 |
| | | GB_PL1:SC9920 | 23498 | Z48639 | S. cerevisiae chromosome XIII cosmid 9920. | Saccharomyces cerevisiae | 35,754 | Aug. 11, 1997 |
| rxa00757 | 1377 | GB_PAT:E13655 | 2260 | E13655 | gDNA encoding glucose-6-phosphate dehydrogenase. | Corynebacterium glutamicum | 46,045 | Jun. 24, 1998 |
| | | GB_GSS9:AQ103710 | 369 | AQ103710 | HS_3092_B1_C01_MF, CIT Approved Human Genomic Sperm Library D Homo sapiens genomic clone Plate = 3092 Col = 1 Row = F, genomic survey sequence. | Homo sapiens | 36,339 | Aug. 27, 1998 |
| | | GB_HTG3:AC009305 | 167705 | AC009305 | Homo sapiens clone NH0153B21, **SEQUENCING IN PROGRESS**, 3 unordered pieces. | Homo sapiens | 36,691 | Aug. 13, 1999 |
| | | GB_BA1:SC7B7 | 13800 | AL009199 | Streptomyces coelicolor cosmid 7B7. | Streptomyces coelicolor | 39,013 | Dec. 2, 1997 |
| rxa00763 | 906 | GB_HTG2:HSJ473J16 | 203460 | AL109942 | Homo sapiens chromosome 6 clone RP3-473J16 map q25.3-26, **SEQUENCING IN PROGRESS**, in unordered pieces. | Homo sapiens | 38,192 | Dec. 3, 1999 |
| | | GB_HTG2:HSJ473J16 | 203460 | AL109942 | Homo sapiens chromosome 6 clone RP3-473J16 map q25.3-26, **SEQUENCING IN PROGRESS**, in unordered pieces. | Homo sapiens | 38,192 | Dec. 3, 1999 |
| rxa00765 | 810 | GB_BA1:MTV043 | 68848 | AL022004 | Mycobacterium tuberculosis H37Rv complete genome; segment 40/162. | Mycobacterium tuberculosis | 38,568 | Jun. 24, 1999 |
| | | GB_BA2:PAU93274 | 8008 | U93274 | Pseudomonas aeruginosa YafE (yafE), LeuB (leuB), Asd (asd), FimV (fimV), and HisT (hisT) genes, complete cds; TnpF (tnpF) gene, partial cds; and unknown gene. | Pseudomonas aeruginosa | 37,656 | Jun. 23, 1998 |
| | | GB_BA1:MTCY31 | 37630 | Z73101 | Mycobacterium tuberculosis H37Rv complete genome; segment 41/162. | Mycobacterium tuberculosis | 38,209 | Jun. 17, 1998 |
| rxa00768 | 1242 | GB_HTG5:AC008194 | 194555 | AC008194 | Drosophila melanogaster chromosome X clone BACR49A05 (D745) RPCI-98 49.A.5 map 18A—18A strain y; cn bw sp, **SEQUENCING IN PROGRESS**, 90 unordered pieces. | Drosophila melanogaster | 34,078 | Nov. 15, 1999 |
| | | GB_HTG5:AC008194 | 194555 | AC008194 | Drosophila melanogaster chromosome X clone BACR49A05 (D745) RPCI-98 49.A.5 map 18A—18A strain y; cn bw sp, **SEQUENCING IN PROGRESS**, 90 unordered pieces. | Drosophila melanogaster | 31,194 | Nov. 15, 1999 |
| | | GB_BA2:AF044495 | 9599 | AF044495 | Agrobacterium tumefaciens chemotaxis operon, complete sequence. | Agrobacterium tumefaciens | 40,165 | Jul. 2, 1998 |
| rxa00769 | 336 | GB_PR3:AC003068 | 42184 | AC003068 | Human Cosmid g5129z059 from 7q31.3, complete sequence. | Homo sapiens | 35,152 | Nov. 6, 1997 |
| | | GB_PR2:HSAC000374 | 41585 | AC000374 | Human cosmid g1980a170, complete sequence. | Homo sapiens | 35,152 | Mar. 12, 1997 |
| | | GB_PR3:AC003068 | 42184 | AC003068 | Human Cosmid g5129z059 from 7q31.3, complete sequence. | Homo sapiens | 37,309 | Nov. 6, 1997 |
| rxa00771 | 942 | GB_PR2:HS172K2 | 131234 | Z84814 | Human DNA sequence from PAC 172K2 on chromosome 6 contains HLA CLASS II DRA pseudogene, DRB3*01012 genes, DRB9 pseudogene butyrophilin precursor and ESTs. | Homo sapiens | 34,719 | Nov. 23, 1999 |
| | | GB_HTG1:HSA555E18 | 1177 | AL121780 | Homo sapiens chromosome 20 clone RP11-555E18, **SEQUENCING IN PROGRESS**, | Homo sapiens | 41,450 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG1:HSA555E18 | 1177 | AL121780 | in unordered pieces. *Homo sapiens* chromosome 20 clone RP11-555E18, **SEQUENCING IN PROGRESS*, in unordered pieces. | *Homo sapiens* | 41,450 | Nov. 23, 1999 |
| rxa00781 | 411 | GB_PR3:HS48A11 | 129294 | AL031132 | Human DNA sequence from clone 48A11 on chromosome 20p12 Contains EST, STS, GSS, complete sequence. | *Homo sapiens* | 37,284 | Nov. 23, 1999 |
| | | GB_IN1:CELC03B1 | 42297 | U40952 | *Caenorhabditis elegans* cosmid C03B1. | *Caenorhabditis elegans* | 38,177 | Nov. 25, 1995 |
| | | GB_PR3:HS48A11 | 129294 | AL031132 | Human DNA sequence from clone 48A11 on chromosome 20p12 Contains EST, STS, GSS, complete sequence. | *Homo sapiens* | 35,162 | Nov. 23, 1999 |
| rxa00785 | 680 | GB_EST11:AA223451 | 349 | AA223451 | zr06d01.r1 Stratagene NT2 neuronal precursor 937230 *Homo sapiens* cDNA clone IMAGE:650689 5′, mRNA sequence. | *Homo sapiens* | 38,682 | Feb. 19, 1997 |
| | | GB_EST9:AA081255 | 446 | AA081255 | zn33d08.r1 Stratagene endothelial cell 937223 *Homo sapiens* cDNA clone IMAGE:549231 5′, mRNA sequence. | *Homo sapiens* | 40,271 | Oct. 21, 1996 |
| | | GB_EST9:C16722 | 314 | C16722 | C16722 Clontech human aorta poly A+ mRNA (#6572) *Homo sapiens* cDNA clone GEN-522C02 5′, mRNA sequence. | *Homo sapiens* | 44,013 | Sep. 30, 1996 |
| rxa00788 | 348 | GB_PL2:UMU62738 | 13812 | U62738 | *Ustilago maydis* ferrichrome siderophore peptide synthetase (sid2) gene, complete cds. | *Ustilago maydis* | 31,792 | Dec. 30, 1997 |
| | | GB_PR1:AB012723 | 40850 | AB012723 | *Homo sapiens* gene for kinesin-like protein, complete cds. | *Homo sapiens* | 35,398 | Jan. 8, 1999 |
| | | GB_HTG3:AC008625 | 16830 | AC008625 | *Homo sapiens* chromosome 5 clone CIT978SKB_157D17, *SEQUENCING IN PROGRESS*, 19 unordered pieces. | *Homo sapiens* | 42,560 | Aug. 3, 1999 |
| rxa00795 | 651 | GB_IN2:AC003120 | 59991 | AC003120 | *Drosophila melanogaster* DNA sequence (P1 DS01523 (D34)), complete sequence. | *Drosophila melanogaster* | 39,252 | Jul. 17, 1998 |
| | | GB_EST19:AA802212 | 574 | AA802212 | GM04027.5prime GM *Drosophila melanogaster* ovary BlueScript *Drosophila melanogaster* cDNA clone GM04027 5prime; mRNA sequence. | *Drosophila melanogaster* | 37,828 | Nov. 25, 1998 |
| rxa00804 | 567 | GB_IN2:AF168467 | 4652 | AF168467 | *Drosophila melanogaster* dual specificity kinase DYRK2 mRNA, complete cds. | *Drosophila melanogaster* | 36,933 | Aug. 5, 1999 |
| | | GB_GSS12:AQ356039 | 499 | AQ356039 | CITBI-E1-2535P11.TR CITBI-E1 *Homo sapiens* genomic clone 2535P11, genomic survey sequence. | *Homo sapiens* | 40,569 | Jan. 24, 1999 |
| | | GB_PR4:AC005037 | 190508 | AC005037 | *Homo sapiens* clone NH0469M07, complete sequence. | *Homo sapiens* | 41,209 | May 14, 1999 |
| | | GB_HTG5:AC007272 | 175463 | AC007272 | *Homo sapiens* clone NH0013J08, *SEQUENCING IN PROGRESS*, 5 unordered pieces. | *Homo sapiens* | 41,209 | Nov. 2, 1999 |
| rxa00805 | 1005 | GB_GSS1:CNS00U61 | 320 | AL090583 | *Arabidopsis thaliana* genome survey sequence SP6 end of BAC T6D17 of TAMU library from strain Columbia of *Arabidopsis thaliana*, genomic survey sequence. | *Arabidopsis thaliana* | 36,364 | Jun. 28, 1999 |
| | | GB_PL1:AB026639 | 63921 | AB026639 | *Arabidopsis thaliana* genomic DNA, chromosome 5, TAC clone: K21L13, complete sequence. | *Arabidopsis thaliana* | 38,485 | May 7, 1999 |
| | | GB_PL1:AB026639 | 63921 | AB026639 | *Arabidopsis thaliana* genomic DNA, chromosome 5, TAC clone: K21L13, complete sequence. | *Arabidopsis thaliana* | 35,451 | May 7, 1999 |
| rxa00808 | 1581 | GB_BA1:MLCB2548 | 38916 | AL023093 | *Mycobacterium leprae* cosmid B2548. | *Mycobacterium leprae* | 50,854 | Aug. 27, 1999 |
| | | GB_BA1:MICL373 | 37304 | AL035500 | *Mycobacterium leprae* cosmid L373. | *Mycobacterium leprae* | 40,295 | Aug. 27, 1999 |
| | | GB_PL2:SCE9781 | 68302 | U18916 | *Saccharomyces cerevisiae* chromosome V cosmids 9781, 8198, 9115, 9981, and lambda clones 3955 and 6052. | *Saccharomyces cerevisiae* | 37,677 | Aug. 1, 1997 |
| rxa00812 | 1182 | GB_HTG2:AC006003 | 114949 | AC006003 | *Homo sapiens* clone DJ0783K24, *SEQUENCING IN PROGRESS*, 16 unordered pieces. | *Homo sapiens* | 35,284 | Nov. 22, 1998 |
| | | GB_HTG2:AC006003 | 114949 | AC006003 | *Homo sapiens* clone DJ0782K24, *SEQUENCING IN PROGRESS*, 16 unordered pieces. | *Homo sapiens* | 35,284 | Nov. 22, 1998 |
| | | GB_GSS9:AQ090529 | 323 | AQ090529 | HS_3007_B1_E09_MR CIT Approved Human Genomic Sperm Library D *Homo sapiens* genomic clone Plate = 3007 Col = 17 Row = J, genomic survey sequence. | *Homo sapiens* | 41,176 | Aug. 26, 1998 |
| rxa00814 | 897 | GB_VI:EHVU20824 | 184427 | U20824 | Equine herpesvirus 2, complete genome. | Equine herpesvirus 2 | 35,274 | Feb. 2, 1996 |
| | | GB_VI:EHVU20824 | 184427 | U20824 | Equine herpesvirus 2, complete genome. | Equine herpesvirus 2 | 38,808 | Feb. 2, 1996 |
| | | GB_PR3:HS466N1 | 79528 | Z97630 | Human DNA sequence from clone 466N1 on chromosome 22q12-13 Contains H1F0 (H1 histone family, member 0) gene, 2-amino-3-ketobutyrate-CoA ligase (nuclear gene encoding mitochondrial protein), GALR3 (galanin receptor) gene, ESTs, GSSs and CpG islands, complete sequence. | *Homo sapiens* | 38,496 | Nov. 23, 1999 |
| rxa00815 | 696 | GB_PR3:CNS01DRL | 174928 | AL117355 | Human chromosome 14 DNA sequence *IN PROGRESS* BAC R-354E14 of RPCI-11 library from chromosome 14 of *Homo sapiens* (Human), complete sequence. | *Homo sapiens* | 36,578 | Nov. 26, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa0816 | 420 | GB_PR4:AC007283 | 127361 | AC007283 | Homo sapiens clone NH0536I18, complete sequence. | Homo sapiens | 37,609 | Sep. 28, 1999 |
| | | GB_EST14:AA406984 | 477 | AA406984 | MBAFC27H08T3 Brugia malayi adult female cDNA (SAW96MLW-BmAF) Brugia malayi cDNA clone AFC27H08 5', mRNA sequence. | Brugia malayi | 41,919 | May 1, 1997 |
| | | GB_EST27:AI414036 | 467 | AI414036 | ma03e08.x1 Soares mouse p3NMF 19.5 Mus musculus cDNA clone IMAGE:303494 3' similar to TR:Q85299 Q85299 HOMOLOGUE OF RETROVIRAL PSEUDOPROTEASE; mRNA sequence. | Mus musculus | 40,176 | Feb. 9, 1999 |
| | | GB_GSS15:AQ642295 | 501 | AQ642295 | RPCI93-Dpnll-28G21.TV RPCI93-Dpnll Trypanosoma brucei genomic clone RPCI93-Dpnll-28G21, genomic survey sequence. | Trypanosoma brucei | 37,540 | Jul. 8, 1999 |
| rxa0826 | 654 | GB_PL2:ZMU82481 | 2750 | U82481 | Zea mays KI domain interacting kinase 1 (KIK1) mRNA, complete cds. | Zea mays | 41,783 | Jan. 1, 1998 |
| | | GB_PR4:AC008179 | 181745 | AC008179 | Homo sapiens clone NH0576F01, complete sequence. | Homo sapiens | 35,736 | Sep. 28, 1999 |
| | | GB_HTG1:AC002413 | 63369 | AC002413 | Homo sapiens chromosome X clone bWXD111, *SEQUENCING IN PROGRESS*, 2 unordered pieces. | Homo sapiens | 37,600 | Aug. 12, 1997 |
| | | GB_HTG1:AC002413 | 63369 | AC002413 | Homo sapiens chromosome X clone bWXD111, *SEQUENCING IN PROGRESS*, 2 unordered pieces. | Homo sapiens | 37,600 | Aug. 12, 1997 |
| rxa0830 | 846 | GB_GSS6:AQ823465 | 535 | AQ823465 | HS_3217_A1_D08_T7C CIT Approved Human Genomic Sperm Library D Homo sapiens genomic clone Plate = 3217 Col = 15 Row = G, genomic survey sequence. | Homo sapiens | 40,417 | Aug. 26, 1999 |
| | | GB_GSS6:AQ825402 | 381 | AQ825402 | HS_5498_A1_G01_SP6E RPCI-11 Human Male BAC Library Homo sapiens genomic clone Plate = 1074 Col = 1 Row = M, genomic survey sequence. | Homo sapiens | 43,068 | Aug. 26, 1999 |
| | | GB_HTG1:HSU242F8 | 92944 | AL022167 | Homo sapiens chromosome X clone LL0XNC01-242F8, **SEQUENCING IN PROGRESS*, in unordered pieces. | Homo sapiens | 38,321 | Nov. 23, 1999 |
| rxa0831 | | | | | | | | |
| rxa0835 | 1077 | GB_EST35:AI864917 | 468 | AI864917 | wj66f11.x1 NCI_CGAP_Lu19 Homo sapiens cDNA clone IMAGE:2407821 3' similar to WP:F01F1.9 CE01235 VACUOLAR AMINOPEPTIDASE, mRNA sequence. | Homo sapiens | 37,607 | Aug. 30, 1999 |
| | | GB_EST35:AI864917 | 468 | AI864917 | wj66f11.x1 NCI_CGAP_Lu19 Homo sapiens cDNA clone IMAGE:2407821 3' similar to WP:F01F1.9 CE01235 VACUOLAR AMINOPEPTIDASE, mRNA sequence. | Homo sapiens | 38,444 | Aug. 30, 1999 |
| rxa0836 | 1816 | GB_EST11:AA212728 | 424 | AA212728 | mw81g02.r1 Soares mouse NML Mus musculus cDNA clone IMAGE:677138 5', mRNA sequence. | Mus musculus | 40,284 | Feb. 18, 1997 |
| | | GB_EST26:AI390258 | 557 | AI390258 | mw81g02.y1 Soares mouse NML Mus musculus cDNA clone IMAGE:677138 5', mRNA sequence. | Mus musculus | 41,261 | Feb. 2, 1999 |
| | | GB_PR3:AC003669 | 159446 | AC003669 | Homo sapiens Xp22 BAC GS-594A7 (Genome Systems Human BAC library) contains Bmx gene, complete sequence. | Homo sapiens | 34,914 | Mar. 24, 1998 |
| rxa0840 | | | | | | | | |
| rxa0841 | | | | | | | | |
| rxa0846 | 993 | GB_BA1:U00017 | 42157 | U00017 | Mycobacterium leprae cosmid B2126. | Mycobacterium leprae | 35,635 | Mar. 1, 1994 |
| | | GB_BA1:MLCB2533 | 40245 | AL035310 | Mycobacterium leprae cosmid B2533. | Mycobacterium leprae | 38,280 | Aug. 27, 1999 |
| | | GB_RO:AB02204757 | 18721 | AB022053 | Mus musculus gene for prolyl oligopeptidase, exon 11, 12, 13, 14, 15 and complete cds. | Mus musculus | 36,633 | Aug. 20, 1999 |
| rxa0853 | 726 | GB_PR3:HS531H16 | 155116 | AL031664 | Human DNA sequence *SEQUENCING IN PROGRESS* from clone 531H16, complete sequence. | Homo sapiens | 41,110 | Nov. 23, 1999 |
| | | GB_PR3:HS531H16 | 155116 | AL031664 | Human DNA sequence *SEQUENCING IN PROGRESS* from clone 531H16, complete sequence. | Homo sapiens | 37,343 | Nov. 23, 1999 |
| | | GB_HTG3:AC010264 | 81671 | AC010264 | Homo sapiens chromosome 5 clone CIT-HSPC_468K18, *SEQUENCING IN PROGRESS*, 66 unordered pieces. | Homo sapiens | 38,776 | Sep. 15, 1999 |
| rxa0854 | 336 | GB_IN1:CELM04G7 | 41778 | AF036700 | Caenorhabditis elegans cosmid M04G7. | Caenorhabditis elegans | 37,349 | Dec. 5, 1997 |
| | | GB_EST20:AA850405 | 451 | AA850405 | EST193172 Normalized rat ovary, Bento Soares Rattus sp. cDNA clone ROVAF27 3' end, mRNA sequence. | Rattus sp. | 40,789 | Apr. 30, 1998 |
| | | GB_HTG2:AF165144 | 110891 | AF165144 | Homo sapiens chromosome 8 clone BAC 393A07 map 8q, *SEQUENCING IN PROGRESS* | Homo sapiens | 34,234 | Jul. 16, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00855 | 408 | GB_HTG2:AC007173 | 140775 | AC007173 | PROGRESS*, in ordered pieces. Drosophila melanogaster chromosome 2 clone BACR01A03 (D538) RPCI-98 01.A.3 map 36E—36E strain y; cn bw sp, SEQUENCING IN PROGRESS*, 36 unordered pieces. | Drosophila melanogaster | 36,341 | Aug. 2, 1999 |
| | | GB_HTG2:AC007173 | 140775 | AC007173 | Drosophila melanogaster chromosome 2 clone BACR01A03 (D538) RPCI-98 01.A.3 map 36E—36E strain y; cn bw sp, **SEQUENCING IN PROGRESS*, 36 unordered pieces. | Drosophila melanogaster | 36,341 | Aug. 2, 1999 |
| rxa00861 | 426 | GB_PL2:YSCH8179 | 44113 | U00062 | Saccharomyces cerevisiae chromosome VIII cosmid 8179. | Saccharomyces cerevisiae | 38,560 | Sep. 4, 1997 |
| | | GB_BA1:CGORF4GEN | 2398 | X95649 | C. glutamicum ORF4 gene. | Corynebacterium glutamicum | 100,000 | Mar. 10, 1998 |
| | | GB_BA1:SC9A10 | 9000 | AL031260 | Streptomyces coelicolor cosmid 9A10. | Streptomyces coelicolor | 63,830 | Aug. 11, 1998 |
| | | GB_BA2:AF039028 | 2475 | AF039028 | Streptomyces toyocaensis D-ala-D-ala dipeptidase (vanXst) gene, complete cds; and unknown gene. | Streptomyces toyocaensis | 61,939 | Jan. 5, 1999 |
| rxa00862 | 682 | GB_PAT:E14520 | 2001 | E14520 | DNA encoding Brevibacterium dihydrodipicolinic acid synthase. | Corynebacterium glutamicum | 36,154 | Jul. 28, 1999 |
| | | GB_PAT:E12773 | 2001 | E12773 | DNA encoding Brevibacterium dihydrodipicolinic acid reductase. | Corynebacterium glutamicum | 36,154 | Jun. 24, 1998 |
| | | GB_PAT:E16749 | 2001 | E16749 | gDNA encoding dihydrodipicolinate synthase (DDPS). | Corynebacterium glutamicum | 36,154 | Jul. 28, 1999 |
| rxa00869 | 1044 | GB_EST24:AI166579 | 645 | AI166579 | xylem.est.398 Poplar xylem Lambda ZAPII library Populus balsamifera subsp. trichocarpa cDNA 5', mRNA sequence. | Populus balsamifera | 39,854 | Dec. 3, 1998 |
| | | GB_BA1:MTCY06H11 | 38000 | Z85982 | Mycobacterium tuberculosis H37Rv complete genome; segment 73/162. | Mycobacterium tuberculosis | 42,801 | Jun. 17, 1998 |
| | | GB_EST34:AV153098 | 283 | AV153098 | AV153098 Mus musculus hippocampus C57BL/6J adult Mus musculus cDNA clone 2900052110, mRNA sequence. | Mus musculus | 39,576 | Jul. 7, 1999 |
| rxa00874 | 1212 | GB_HTG2:AC007885 | 108561 | AC007885 | Drosophila melanogaster chromosome 2 clone BACR02G15 (D643) RPCI-98 02.G.15 map 60F—60F strain y; cn bw sp. **SEQUENCING IN PROGRESS*, 65 unordered pieces. | Drosophila melanogaster | 38,276 | Aug. 2, 1999 |
| | | GB_HTG2:AC007582 | 127205 | AC007582 | Drosophila melanogaster chromosome 2 clone BACR17E16 (D642) RPCI-98 17.E.16 map 60F—60F strain y; cn bw sp. **SEQUENCING IN PROGRESS*, 81 unordered pieces. | Drosophila melanogaster | 36,246 | Aug. 2, 1999 |
| | | GB_HTG2:AC007885 | 108561 | AC007885 | Drosophila melanogaster chromosome 2 clone BACR02G15 (D643) RPCI-98 02.G.15 map 60F—60F strain y; cn bw sp. **SEQUENCING IN PROGRESS*, 65 unordered pieces. | Drosophila melanogaster | 38,276 | Aug. 2, 1999 |
| rxa00876 | 1878 | GB_EST10:AA144736 | 479 | AA144736 | mr72d08.r1 Stratagene mouse testis (#937308) Mus musculus cDNA clone IMAGE:602991 5', mRNA sequence. | Mus musculus | 41,474 | Feb. 11, 1997 |
| | | GB_EST32:AU069076 | 316 | AU069076 | Rice callus Oryza sativa cDNA clone C51993_1A, mRNA sequence. | Oryza sativa | 46,330 | Jun. 7, 1999 |
| | | GB_EST10:AA144736 | 479 | AA144736 | mr72d08.r1 Stratagene mouse testis (#937308) Mus musculus cDNA clone IMAGE:602991 5', mRNA sequence. | Mus musculus | 43,243 | Feb. 11, 1997 |
| rxa00881 | 501 | GB_HTG4:AC010103 | 192320 | AC010103 | Homo sapiens chromosome unknown clone NH0508H21, WORKING DRAFT SEQUENCE, in unordered pieces. | Homo sapiens | 36,620 | Oct. 29, 1999 |
| | | GB_HTG4:AC010103 | 192320 | AC010103 | Homo sapiens chromosome unknown clone NH0508H21, WORKING DRAFT SEQUENCE, in unordered pieces. | Homo sapiens | 36,620 | Oct. 29, 1999 |
| | | GB_HTG4:AC010103 | 192320 | AC010103 | Homo sapiens chromosome unknown clone NH0508H21, WORKING DRAFT SEQUENCE, in unordered pieces. | Homo sapiens | 34,280 | Oct. 29, 1999 |
| rxa00882 | 801 | GB_BA1:MTCY48 | 35377 | Z74020 | Mycobacterium tuberculosis H37Rv complete genome, segment 69/162. | Mycobacterium tuberculosis | 37,927 | Jun. 17, 1998 |
| rxa00883 | 642 | GB_PAT:AR005211 | 3453 | AR005211 | Sequence 1 from U.S. Pat. No. 5747651. | Unknown. | 39,620 | Dec. 4, 1998 |
| | | GB_PAT:I40600 | 3453 | I40600 | Sequence 1 from U.S. Pat. No. 5621090. | Unknown. | 39,620 | May 13, 1997 |
| | | GB_PR2:HS217O16 | 87552 | AL031771 | Human DNA sequence from clone 217O16 on chromosome 6q24 Contains GSS, complete sequence. | Homo sapiens | 33,866 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00887 | | GB_PR2:HS217O16 | 87552 | AL031771 | Human DNA sequence from clone 217O16 on chromosome 6q24 Contains GSS, complete sequence. | Homo sapiens | 35,479 | Nov. 23, 1999 |
| rxa00889 | 711 | GB_BA1:MTCY27 | 27548 | Z95208 | Mycobacterium tuberculosis H37Rv complete genome; segment 104/162. | Mycobacterium tuberculosis | 36,978 | Jun. 17, 1998 |
| | | GB_BA1:U00016 | 42931 | U00016 | Mycobacterium leprae cosmid B1937. | Mycobacterium leprae | 55,651 | Mar. 1, 1994 |
| | | GB_PR4:AC007326 | 102898 | AC007326 | Homo sapiens, complete sequence. | Homo sapiens | 40,205 | Nov. 2, 1999 |
| rxa00893 | 720 | GB_PL1:HVCPMII | 6225 | Y09602 | H. vulgare gene encoding serine carboxypeptidase II, CP-MII. | Hordeum vulgare | 35,704 | Mar. 10, 1997 |
| | | GB_EST35:AI814621 | 441 | AI814621 | wj75d04.x1 NCI_CGAP_Lu19 Homo sapiens cDNA clone IMAGE:2408647 3′ similar to TR:O00578 O00578 KIAA0167,[1]; mRNA sequence. | Homo sapiens | 37,788 | Aug. 24, 1999 |
| | | GB_EST3:R51723 | 376 | R51723 | yg77h06.r1 Soares infant brain 1NIB Homo sapiens cDNA clone IMAGE:39671 5′ similar to gb:M77016 TROPOMODULIN (HUMAN); mRNA sequence. | Homo sapiens | 41,489 | May 18, 1995 |
| rxa00895 | 714 | GB_HTG3:AC009414 | 188673 | AC009414 | Homo sapiens clone NH0490M08, *SEQUENCING IN PROGRESS*, 5 unordered pieces. | Homo sapiens | 36,775 | Sep. 17, 1999 |
| | | GB_HTG3:AC009414 | 188673 | AC009414 | Homo sapiens clone NH0490M08, *SEQUENCING IN PROGRESS*, 5 unordered pieces. | Homo sapiens | 36,775 | Sep. 17, 1999 |
| | | GB_PR3:HSJ824F16 | 139330 | AL050325 | Human DNA sequence from clone 824F16 on chromosome 20, complete sequence. | Homo sapiens | 37,286 | Nov. 23, 1999 |
| rxa00904 | 815 | GB_HTG5:AC006447 | 141662 | AC006447 | Mus musculus, *SEQUENCING IN PROGRESS*, 2 unordered pieces. | Mus musculus | 35,945 | Nov. 17, 1999 |
| | | GB_HTG5:AC011064 | 233428 | AC011064 | Drosophila melanogaster chromosome X clone BACN05G06 (D1107) RPCI-98 05.G.6 map 12F–13A strain y; cn bw sp, *SEQUENCING IN PROGRESS*, 220 unordered pieces. | Drosophila melanogaster | 37,783 | Nov. 16, 1999 |
| | | GB_HTG6:AC008334 | 154566 | AC008334 | Drosophila melanogaster chromosome X clone BACR08K05 (D885) RPCI-98 08.K.5 map 12F—12F strain y; cn bw sp, *SEQUENCING IN PROGRESS*, 84 unordered pieces. | Drosophila melanogaster | 37,783 | Dec. 2, 1999 |
| rxa00908 | 681 | GB_GSS12:AQ409791 | 561 | AQ409791 | HS_5090_B2_B12_T7A RPCI-11 Human Male BAC Library Homo sapiens genomic clone Plate = 666 Col = 24 Row = D, genomic survey sequence. | Homo sapiens | 39,711 | Mar. 17, 1999 |
| | | GB_GSS3:B83773 | 535 | B83773 | CpG0110A CpIOWAgDNA1 Cryptosporidium parvum genomic, genomic survey sequence. | Cryptosporidium parvum | 44,615 | May 6, 1999 |
| | | GB_GSS12:AQ409791 | 561 | AQ409791 | HS_5090_B2_B12_T7A RPCI-11 Human Male BAC Library Homo sapiens genomic clone Plate = 666 Col = 24 Row = D, genomic survey sequence. | Homo sapiens | 41,333 | Mar. 17, 1999 |
| rxa00915 | 753 | GB_HTG2:HS1118M15 | 190466 | AL109964 | Homo sapiens chromosome 20 clone RP5-1118M15, *SEQUENCING IN PROGRESS*, in unordered pieces. | Homo sapiens | 40,027 | Nov. 30, 1999 |
| | | GB_HTG2:HS1057B20 | 204291 | AL109823 | Homo sapiens chromosome 20 clone RP5-1057B20 map q11.21-12, *SEQUENCING IN PROGRESS*, in unordered pieces. | Homo sapiens | 38,535 | Nov. 30, 1999 |
| | | GB_HTG2:HS1118M15 | 190466 | AL109964 | Homo sapiens chromosome 20 clone RP5-1118M15, *SEQUENCING IN PROGRESS*, in unordered pieces. | Homo sapiens | 40,027 | Nov. 30, 1999 |
| rxa00916 | 3714 | GB_EST28:AI543268 | 568 | AI543268 | SD09973.5prime SD Drosophila melanogaster Schneider L2 cell culture pOT2 Drosophila melanogaster cDNA clone SD09973 5 prime, mRNA sequence. | Drosophila melanogaster | 40,426 | Mar. 22, 1999 |
| | | GB_IN2:AC004301 | 68620 | AC004301 | Drosophila melanogaster DNA sequence (P1 DS07134 (D192)), complete sequence. | Drosophila melanogaster | 37,696 | May 29, 1998 |
| | | GB_EST37:AI994315 | 524 | AI994315 | 701502677 A. thaliana, Ohio State clone set Arabidopsis thaliana cDNA clone 701502677, mRNA sequence. | Arabidopsis thaliana | 40,076 | Sep. 8, 1999 |
| rxa00917 | 2802 | GB_BA1:SYCSLRB | 146271 | D84000 | Synechocystis sp. PCC6803 complete genome, 19/27, 2392729-2538999. | Synechocystis sp. | 38,447 | Feb. 13, 1999 |
| | | GB_HTG1:CEY39E4_2 | 110000 | Z94158 | Caenorhabditis elegans chromosome III clone Y39E4, *SEQUENCING IN PROGRESS*, in unordered pieces. | Caenorhabditis elegans | 38,218 | Z94158 |
| | | GB_HTG1:CEY39E4_2 | 110000 | Z94158 | Caenorhabditis elegans chromosome III clone Y39E4, *SEQUENCING IN PROGRESS*, in unordered pieces. | Caenorhabditis elegans | 38,218 | Z94158 |
| rxa00921 | | | | | | | | |
| rxa00926 | 486 | GB_OM:SSU75316 | 5996 | U75316 | Sus scrofa beta-myosin heavy chain mRNA, complete cds. | Sus scrofa | 38,958 | Dec. 3, 1996 |
| | | GB_EST21:AA970971 | 371 | AA970971 | op10h11.s1 NCI_CGAP_Kid6 Homo sapiens cDNA clone IMAGE:1575261 3′, mRNA sequence. | Homo sapiens | 40,841 | Apr. 13, 1999 |
| | | GB_OM:SSU75316 | 5996 | U75316 | Sus scrofa beta-myosin heavy chain mRNA, complete cds. | Sus scrofa | 38,578 | Dec. 3, 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00930 | 876 | GB_BA1:MTCI270A | 1670 | Z98045 | *Mycobacterium tuberculosis* H37Rv complete genome; segment 116/162. | *Mycobacterium tuberculosis* | 37,927 | Jun. 17, 1998 |
|  |  | GB_BA1:U00011 | 40429 | U00011 | *Mycobacterium leprae* cosmid B1177. | *Mycobacterium leprae* | 38,623 | Mar. 1, 1994 |
|  |  | GB_RO:S58745 | 817 | S58745 | thyrotroph embryonic factor = leucine zipper transcription factor [rats, pituitary, mRNA, 817 nt]. | *Rattus sp.* | 41,483 | May 7, 1993 |
| rxa00932 | 597 | GB_PR4:AC009509 | 192690 | AC009509 | *Homo sapiens* 12p11-37.2-54.4 BAC RP11-1060I15 (Roswell Park Cancer Institute Human BAC Library) complete sequence. | *Homo sapiens* | 38,776 | Dec. 1, 1999 |
|  |  | GB_PR3:AC004072 | 170658 | AC004072 | Human Chromosome X clone bWXD342, complete sequence. | *Homo sapiens* | 35,000 | Mar. 8, 1998 |
|  |  | GB_PR4:AC004617 | 176552 | AC004617 | *Homo sapiens* chromosome Y, clone 264, M, 20, complete sequence. | *Homo sapiens* | 35,702 | Oct. 13, 1999 |
| rxa00933 | 585 | GB_PL1:MGNGAGPOLH | 5638 | L35053 | Transposon MAGGY gag and pol gene homologues, partial cds's. | *Magnaporthe grisea* | 40,283 | Aug. 4, 1994 |
|  |  | GB_PL1:MGNGAGPOLH | 5638 | L35053 | Transposon MAGGY gag and pol gene homologues, partial cds's. | *Magnaporthe grisea* | 37,739 | Aug. 4, 1994 |
| rxa00940 | 519 | GB_PR2:HS179N16 | 172048 | Z95152 | *Homo sapiens* DNA sequence from PAC 179N16 on chromosome 6p21.1-21.33. Contains the SAPK4 (MAPK p38delta) gene, and the alternatively spliced SAPK2 gene coding for CSaids binding protein CSBP2 and a MAPK p38beta LIKE protein. Contains ESTs, STSs and two predicted CpG islands, complete sequence. | *Homo sapiens* | 38,252 | Nov. 23, 1999 |
|  |  | GB_EST26:AU001018 | 304 | AU001018 | AU001018 *Bombyx mori* p50 (Daizo) *Bombyx mori* cDNA clone fbf0932f, mRNA sequence. | *Bombyx mori* | 45,745 | Jan. 15, 1999 |
|  |  | GB_EST26:AU001019 | 304 | AU001019 | AU001019 *Bombyx mori* p50 (Daizo) *Bombyx mori* cDNA clone fbf0934f, mRNA sequence. | *Bombyx mori* | 45,745 | Jan. 15, 1999 |
| rxa00943 | 1035 | GB_BA2:AF079317 | 184457 | AF079317 | *Sphingomonas aromaticivorans* plasmid pNL1, complete plasmid sequence. | *Sphingomonas aromaticivorans* | 38,151 | Jan. 12, 1999 |
|  |  | GB_HTG3:AC008329 | 114408 | AC008329 | *Drosophila melanogaster* chromosome 2 clone BACR31D05 (D861) RPCI-98 31.ID.5 map 28C–28D strain y; cn bw sp, **SEQUENCING IN PROGRESS**, 105 unordered pieces. | *Drosophila melanogaster* | 34,317 | Aug. 17, 1999 |
|  |  | GB_HTG3:AC008329 | 114408 | AC008329 | *Drosophila melanogaster* chromosome 2 clone BACR31D05 (D861) RPCI-98 31.ID.5 map 28C–28D strain y; cn bw sp, **SEQUENCING IN PROGRESS**, 105 unordered pieces. | *Drosophila melanogaster* | 34,317 | Aug. 17, 1999 |
| rxa00946 | 897 | GB_BA1:MTV008 | 63033 | AL021246 | *Mycobacterium tuberculosis* H37Rv complete genome; segment 108/162. | *Mycobacterium tuberculosis* | 36,045 | Jun. 17, 1998 |
|  |  | GB_GSS14:AQ571765 | 526 | AQ571765 | HS_2094_A2_B09_MR CIT Approved Human Genomic Sperm Library D *Homo sapiens* genomic clone Plate = 2094 Col = 18 Row = C, genomic survey sequence. | *Homo sapiens* | 38,021 | Jun. 1, 1999 |
|  |  | GB_RO:RRFE65G | 2464 | X60468 | *R. rattus* FE65 gene for adaptor protein interacting with the beta-amyloid precursor protein intracellular domain. | *Rattus rattus* | 38,417 | Feb. 1, 1996 |
| rxa00949 | 771 | GB_VI:PPCCGAAA | 5366 | M26281 | Hampster papovavirus complete genome. | Hamster papovavirus | 36,579 | May 22, 1995 |
|  |  | GB_VI:HAPVXX | 5366 | X02449 | Hampster Papovavirus (HapV) genome. | Hamster papovavirus | 36,579 | Oct. 22, 1999 |
|  |  | GB_BA2:AE000878 | 15432 | AE000878 | *Methanobacterium thermoautotrophicum* from bases 976801 to 992232 (section 84 of 148) of the complete genome. | *Methanobacterium thermoautotrophicum* | 36,856 | Nov. 15, 1997 |
| rxa00959 | 579 | GB_BA1:CGMTRAR | 951 | X75083 | *C. glutamicum* mtrA gene locus with 5-methyltryptophan resistance. | *Corynebacterium glutamicum* | 99,133 | Aug. 18, 1994 |
|  |  | GB_BA1:CGMTRA | 587 | X75084 | *C. glutamicum* sequence corresponding to mtrA locus. | *Corynebacterium glutamicum* | 99,216 | Aug. 18, 1994 |
|  |  | GB_BA1:BLTRP | 7725 | X04960 | *Brevibacterium lactofermentum* tryptophan operon. | *Corynebacterium glutamicum* | 96,800 | Feb. 10, 1999 |
| rxa00963 | 960 | GB_EST15:AA484511 | 504 | AA484511 | nf08f07.s1 NCI_CGAP_Li1 *Homo sapiens* cDNA clone IMAGE:913189 similar to gb:Y00764 UBIQUINOL-CYTOCHROME C REDUCTASE 11 KD PROTEIN (HUMAN); mRNA sequence. | *Homo sapiens* | 43,750 | Aug. 18, 1997 |
|  |  | GB_EST20:AA894481 | 544 | AA894481 | nw76b10.s1 NCI_CGAP_Pr12 *Homo sapiens* cDNA clone IMAGE:1252507 similar to gb:Y00764 UBIQUINOL-CYTOCHROME C REDUCTASE 11 KD PROTEIN (HUMAN); mRNA sequence. | *Homo sapiens* | 37,500 | Apr. 6, 1998 |
|  |  | GB_EST15:AA526497 | 582 | AA526497 | ni96d07.s1 NCI_CGAP_Pr21 *Homo sapiens* cDNA clone IMAGE:984685 3' similar to | *Homo sapiens* | 38,554 | Aug. 5, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00969 | 1458 | GB_BA1:CGHOMTHR | 3685 | Y00546 | gb:Y00764 UBIQUINOL-CYTOCHROME C REDUCTASE 11 KD PROTEIN (HUMAN); mRNA sequence. Corynebacterium glutamicum hom-thrB genes for homoserine dehydrogenase and homoserine kinase. | Corynebacterium glutamicum | 99,588 | Sep. 12, 1993 |
| | | GB_PAT:I09077 | 3685 | I09077 | Sequence 1 from Patent WO 8809819. | Unknown. | 99,246 | Dec. 2, 1994 |
| | | GB_BA1:BLTHRA | 1483 | Y00476 | B. lactofermentum thr A gene. | Corynebacterium glutamicum | 99,378 | May 5, 1993 |
| rxa00971 | 341 | GB_BA1:CGHOMTHR | 3685 | Y00546 | Corynebacterium glutamicum hom-thrB genes for homoserine dehydrogenase and homoserine kinase. | Corynebacterium glutamicum | 35,435 | Sep. 12, 1993 |
| | | GB_PAT:I09077 | 3685 | I09077 | Sequence 1 from Patent WO 8809819. | Unknown. | 35,435 | Dec. 2, 1994 |
| | | GB_BA1:BLTHRB | 1139 | Y00140 | Brevibacterium lactofermentum thrB gene for homoserine kinase. | Corynebacterium glutamicum | 40,964 | Sep. 12, 1993 |
| rxa00973 | 726 | GB_BA1:CGHOMTHR | 3685 | Y00546 | Corynebacterium glutamicum hom-thrB genes for homoserine dehydrogenase and homoserine kinase. | Corynebacterium glutamicum | 41,797 | Sep. 12, 1993 |
| | | GB_PAT:I09077 | 3685 | I09077 | Sequence 1 from Patent WO 8809819. | Unknown. | 41,797 | Dec. 2, 1994 |
| | | GB_IN2:AC006574 | 127035 | AC006574 | Drosophila melanogaster, chromosome 2R, region 39A3-39B1, P1 clones DS02919 and DS05130, complete sequence. | Drosophila melanogaster | 37,355 | Feb. 16, 1999 |
| rxa00978 | 738 | GB_PR2:HSAC000372 | 41730 | AC000372 | Human cosmid g1980a186, complete sequence. | Homo sapiens | 34,674 | Mar. 12, 1997 |
| | | GB_PR3:AC005503 | 40998 | AC005503 | Homo sapiens clone UWGC:g5129s003 from 7q31, complete sequence. | Homo sapiens | 34,674 | Aug. 20, 1998 |
| | | GB_PR2:HSAC000372 | 41730 | AC000372 | Human cosmid g1980a186, complete sequence. | Homo sapiens | 38,881 | Mar. 12, 1997 |
| rxa00986 | 465 | GB_GSS10:AQ258013 | 761 | AQ258013 | nbxb0019H05f CUG1 Rice BAC Library Oryza sativa genomic clone nbxb0019H05f, genomic survey sequence. | Oryza sativa | 31,533 | Oct. 23, 1998 |
| | | GB_PR3:HS83L6 | 61187 | Z99130 | Human DNA sequence from PAC 83L6 on chromosome Xp11.11-11.22. Contains ZXDA (ZFPA) zinc finger gene, ESTs and STSs, complete sequence. | Homo sapiens | 38,395 | Nov. 23, 1999 |
| | | GB_PR3:HS598A24 | 96558 | AL031115 | Human DNA sequence from clone 598A24 on chromosome Xp11.11-11.23 Contains zinc finger X-linked proteins ZXDA, ZXDB, ESTs and STS, complete sequence. | Homo sapiens | 37,333 | Nov. 23, 1999 |
| rxa00987 | 588 | GB_HTG1:HS24A17 | 2000 | AL035452 | Homo sapiens chromosome X clone RP6-24A17, **SEQUENCING IN PROGRESS**, in unordered pieces. | Homo sapiens | 38,821 | Nov. 23, 1999 |
| | | GB_HTG1:HS24A17 | 2000 | AL035452 | Homo sapiens chromosome X clone RP6-24A17, **SEQUENCING IN PROGRESS**, in unordered pieces. | Homo sapiens | 38,821 | Nov. 23, 1999 |
| | | GB_PR2:HS1156N12 | 146360 | AL009047 | Human DNA sequence from clone 1156N12 on chromosome X. Contains an STS and GSSs, complete sequence. | Homo sapiens | 38,821 | Nov. 23, 1999 |
| rxa00988 | 546 | GB_IN1:CELZC328 | 30350 | AF000194 | Caenorhabditis elegans cosmid ZC328. | Caenorhabditis elegans | 36,122 | Apr. 23, 1997 |
| | | GB_IN1:CELZC328 | 30350 | AF000194 | Caenorhabditis elegans cosmid ZC328. | Caenorhabditis elegans | 37,959 | Apr. 23, 1997 |
| rxa01005 | 969 | GB_BA1:FVBPOAD2A | 45519 | D26094 | Flavobacterium sp. plasmid pOAD2 DNA, whole sequence. | Flavobacterium sp. | 37,998 | Feb. 6, 1999 |
| | | GB_GSS1:CNS00UGV | 472 | AL090973 | Arabidopsis thaliana genome survey sequence SP6 end of BAC T6P9 of TAMU library from strain Columbia of Arabidopsis thaliana, genomic survey sequence. | Arabidopsis thaliana | 39,024 | Jun. 28, 1999 |
| rxa01007 rxa01008 | | GB_GSS1:CNS00S69 | 512 | AL087999 | Arabidopsis thaliana genome survey sequence SP6 end of BAC T1C4 of TAMU library from strain Columbia of Arabidopsis thaliana, genomic survey sequence. | Arabidopsis thaliana | 35,938 | Jun. 28, 1999 |
| rxa01011 | 1356 | GB_EST38:AW039107 | 598 | AW039107 | EST281080 tomato mixed elicitor, BTI Lycopersicon esculentum cDNA clone cLET12F19, mRNA sequence. | Lycopersicon esculentum | 39,724 | Oct. 18, 1999 |
| | | GB_BA1:MTY13E12 | 43401 | Z95390 | Mycobacterium tuberculosis H37Rv complete genome; segment 147/162. | Mycobacterium tuberculosis | 38,618 | Jun. 17, 1998 |
| | | GB_BA1:MBU15140 | 2136 | U15140 | Mycobacterium bovis ribosomal proteins IF-1 (InfA), L36 (rpmJ), S13 (rpsM) and S11 (rpsK) | Mycobacterium bovis | 37,070 | Oct. 28, 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01016 | 771 | GB_BA1:CGBPH16 | 962 | Y12472 | genes, complete cds, and S4 (rpsD) gene, partial cds. *C. glutamicum* DNA, attachment site bacteriophage Phi-16. | *Corynebacterium glutamicum* | 45,098 | Mar. 5, 1999 |
| | | GB_BA1:CGBPH16 | 962 | Y12472 | *C. glutamicum* DNA, attachment site bacteriophage Phi-16. | *Corynebacterium glutamicum* | 37,251 | Mar. 5, 1999 |
| rxa01017 | 732 | GB_BA1:CGBPH16 | 962 | Y12472 | *C. glutamicum* DNA, attachment site bacteriophage Phi-16. | *Corynebacterium glutamicum* | 39,245 | Mar. 5, 1999 |
| | | GB_BA2:AF099014 | 2500 | AF099014 | *Streptomyces coelicolor* strain A3(2) transposase (tnpA) and Fe-containing superoxide dismutase I (sodF1) genes, complete cds. | *Streptomyces coelicolor* | 38,036 | Jun. 1, 1999 |
| | | GB_HTG3:AC009249 | 119461 | AC009249 | *Drosophila melanogaster* chromosome 3 clone BACR02M06 (D1003) RPCI-98 02.M.6 map 98B—98B strain y; cn bw sp, **SEQUENCING IN PROGRESS**, 97 unordered pieces. | *Drosophila melanogaster* | 37,853 | Aug. 27, 1999 |
| rxa01021 | 622 | GB_BA2:U39718 | 8603 | U39718 | *Mycoplasma genitalium* section 40 of 51 of the complete genome. | *Mycoplasma genitalium* | 39,348 | Nov. 5, 1998 |
| | | GB_GSS3:B46221 | 457 | B46221 | HS-1063-A2-D06-MR.abi CIT Human Genomic Sperm Library C Homo sapiens genomic clone Plate = CT 796 Col = 12 Row = G, genomic survey sequence. | *Homo sapiens* | 39,933 | Oct. 21, 1997 |
| rxa01023 | 1101 | GB_OV:AF035529 | 848 | AF035529 | *Xenopus laevis* Smad6 mRNA, partial cds. | *Xenopus laevis* | 37,203 | Jan. 1, 1998 |
| | | GB_HTG2:HSI435K13 | 151301 | AL109941 | *Homo sapiens* chromosome 6 clone RP3-435K13 map q14.1-16.1, *SEQUENCING IN PROGRESS*, in unordered pieces. | *Homo sapiens* | 34,405 | Dec. 3, 1999 |
| | | GB_HTG2:HSI435K13 | 151301 | AL109941 | *Homo sapiens* chromosome 6 clone RP3-435K13 map q14.1-16.1, *SEQUENCING IN PROGRESS*, in unordered pieces. | *Homo sapiens* | 34,405 | Dec. 3, 1999 |
| rxa01028 | 2172 | GB_BA1:RCU57682 | 86896 | U57682 | *Rhodobacter capsulatus* cosmids 143-147, complete sequence. | *Rhodobacter capsulatus* | 39,022 | Feb. 7, 1997 |
| | | GB_IN1:CBU55260 | 2518 | U55260 | *Caenorhabditis briggsae* beta tubulin (mec-7) gene, complete cds. | *Caenorhabditis briggsae* | 39,467 | Jun. 5, 1996 |
| | | GB_HTG1:CEY1A5 | 196643 | AL008872 | *Caenorhabditis elegans* chromosome III clone Y1A5, *SEQUENCING IN PROGRESS*, in *Caenorhabditis elegans* unordered pieces. | | 38,168 | Nov. 9, 1997 |
| | | GB_HTG1:CEY1A5 | 196643 | AL008872 | *Caenorhabditis elegans* chromosome III clone Y1A5, *SEQUENCING IN PROGRESS*, in *Caenorhabditis elegans* unordered pieces. | | 38,168 | Nov. 9, 1997 |
| rxa01029 | 612 | GB_PR3:HS466P17 | 149963 | AL023806 | Human DNA sequence from clone 466P17 on chromosome 6q24. Contains a putative novel gene, the 5' part of the EPM2A (Laforin) gene, ESTs, STSs, GSSs, genomic marker D6S1703 and D6S1443, a putative CpG island and a ca repeat polymorphism, complete sequence. | *Homo sapiens* | 38,330 | Nov. 23, 1999 |
| | | GB_PR3:HS466P17 | 149963 | AL023806 | Human DNA sequence from clone 466P17 on chromosome 6q24. Contains a putative novel gene, the 5' part of the EPM2A (Laforin) gene, ESTs, STSs, GSSs, genomic marker D6S1703 and D6S1443, a putative CpG island and a ca repeat polymorphism, complete sequence. | *Homo sapiens* | 39,262 | Nov. 23, 1999 |
| rxa01031 | 789 | GB_RO:D78344 | 59641 | D78344 | Mouse DNA for Ig gamma-chains, partial cds. | *Mus musculus* | 35,472 | Feb. 5, 1999 |
| | | GB_PR4:AC006948 | 168858 | AC006948 | *Homo sapiens* chromosome 17, clone hRPK.334_M_10, complete sequence. | *Homo sapiens* | 44,005 | Apr. 27, 1999 |
| | | GB_PL2:AC011665 | 101845 | AC011665 | *Arabidopsis thaliana* chromosome I BAC T6L1 genomic sequence, complete sequence. | *Arabidopsis thaliana* | 38,170 | Nov. 11, 1999 |
| | | GB_RO:MMU19724 | 5523 | U19724 | *Mus Musculus* MMTV integration locus, aromatase gene, 3' UTR. | *Mus musculus* | 35,256 | Feb. 17, 1996 |
| rxa01032 | 498 | GB_EST9:AA118349 | 576 | AA118349 | ml56b06.r1 Stratagene mouse testis (#937308) *Mus musculus* cDNA clone IMAGE:515987 5' similar to gb:L04852 Mouse (MOUSE); mRNA sequence. | *Mus musculus* | 43,056 | Nov. 19, 1996 |
| | | GB_EST9:AA118349 | 576 | AA118349 | ml56b06.r1 Stratagene mouse testis (#937308) *Mus musculus* cDNA clone IMAGE:515987 5' similar to gb:L04852 Mouse (MOUSE); mRNA sequence. | *Mus musculus* | 42,273 | Nov. 19, 1996 |
| rxa01033 | 459 | GB_GSS13:AQ434868 | 520 | AQ434868 | HS_5117_B1_D07_SP6F RPCI-11 Human Male BAC Library Homo sapiens genomic clone Plate = 693 Col = 13 Row = H, genomic survey sequence. | *Homo sapiens* | 38,608 | Mar. 31, 1999 |
| | | GB_HTG2:HSDJ794I6 | 137124 | AL109976 | *Homo sapiens* chromosome 20 clone RP4-794I6, *SEQUENCING IN PROGRESS*, in unordered pieces. | *Homo sapiens* | 28,929 | Nov. 27, 1999 |
| | | GB_HTG2:HSDJ794I6 | 137124 | AL109976 | *Homo sapiens* chromosome 20 clone RP4-794I6, *SEQUENCING IN PROGRESS*, in | *Homo sapiens* | 28,929 | Nov. 27, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01034 | 477 | GB_PL2:ATT29H11 | 87011 | AL049659 | unordered pieces. Arabidopsis thaliana DNA chromosome 3, BAC clone T29H11. | Arabidopsis thaliana | 32,495 | Jun. 9, 1999 |
| | | GB_PL2:ATT29H11 | 87011 | AL049659 | Arabidopsis thaliana DNA chromosome 3, BAC clone T29H11. | Arabidopsis thaliana | 40,042 | Jun. 9, 1999 |
| | | GB_EST25:AU045739 | 436 | AU045739 | AU045739 Mouse sixteen-cell-embryo cDNA Mus musculus cDNA clone J0940F02 3′, mRNA sequence. | Mus musculus | 35,435 | Dec. 9, 1998 |
| rxa01035 | 729 | GB_GSS1:CNS00QD8 | 526 | AL085658 | Arabidopsis thaliana genome survey sequence SP6 end of BAC F11C22 of IGF library from strain Columbia of Arabidopsis thaliana, genomic survey sequence. | Arabidopsis thaliana | 36,466 | Jun. 28, 1999 |
| | | GB_GSS13:AQ447948 | 515 | AQ447948 | mgxb0015A01r CUGI Rice Blast BAC Library Magnaporthe grisea genomic clone mgxb0015A01r, genomic survey sequence. | Magnaporthe grisea | 45,833 | Apr. 8, 1999 |
| | | GB_GSS1:CNS00QD8 | 526 | AL085658 | Arabidopsis thaliana genome survey sequence SP6 end of BAC F11C22 of IGF library from strain Columbia of Arabidopsis thaliana, genomic survey sequence. | Arabidopsis thaliana | 37,500 | Jun. 28, 1999 |
| rxa01036 | 576 | GB_HTG2:AC004846 | 143577 | AC004846 | Homo sapiens clone DJ0647C14, *SEQUENCING IN PROGRESS*, 21 unordered pieces. | Homo sapiens | 38,137 | Jun. 12, 1998 |
| | | GB_EST19:AA804532 | 427 | AA804532 | ns28c05.s1 NCI_CGAP_GCB1 Homo sapiens cDNA clone IMAGE:1184936 3′ similar to contains element MER40 repetitive element; mRNA sequence. | Homo sapiens | 33,582 | Feb. 18, 1998 |
| rxa01037 | 651 | GB_HTG2:AC006342 | 201618 | AC006342 | Homo sapiens clone DJ0054D12, *SEQUENCING IN PROGRESS*, 3 unordered pieces. | Homo sapiens | 38,137 | Jan. 11, 1999 |
| | | GB_PR4:AC004812 | 138532 | AC004812 | Homo sapiens PAC clone 267D11 from 12, complete sequence. | Homo sapiens | 39,750 | Dec. 5, 1998 |
| | | GB_HTG2:AC006342 | 201618 | AC006342 | Homo sapiens clone DJ0054D12, *SEQUENCING IN PROGRESS*, 3 unordered pieces. | Homo sapiens | 41,214 | Jan. 11, 1999 |
| | | GB_HTG2:AC004846 | 143577 | AC004846 | Homo sapiens clone DJ0647C14, *SEQUENCING IN PROGRESS*, 21 unordered pieces. | Homo sapiens | 41,214 | Jun. 12, 1998 |
| rxa01038 | | | | | | | | |
| rxa01039 | 699 | GB_PR4:HUAC004682 | 189134 | AC004682 | Homo sapiens Chromosome 16 BAC clone CIT987SK-A-259H10, complete sequence. | Homo sapiens | 36,192 | Nov. 23, 1999 |
| | | GB_HTG2:HS500L14 | 164856 | AL023583 | Homo sapiens chromosome 6 clone RP3-500L14 map p23-24.3, *SEQUENCING IN PROGRESS*, in unordered pieces. | Homo sapiens | 34,632 | Nov. 30, 1999 |
| rxa01040 | 1026 | GB_HTG2:HS500L14 | 164856 | AL023583 | Homo sapiens chromosome 6 clone RP3-500L14 map p23-24.3, *SEQUENCING IN PROGRESS*, in unordered pieces. | Homo sapiens | 34,632 | Nov. 30, 1999 |
| | | GB_EST24:AI193549 | 479 | AI193549 | qe70e06.x1 Soares_fetal_lung_NbHL19W Homo sapiens cDNA clone IMAGE:1744354 3′, mRNA sequence. | Homo sapiens | 40,126 | Oct. 29, 1998 |
| | | GB_PR2:HSU38545 | 3609 | U38545 | Human ARF-activated phosphatidylcholine-specific phospholipase D1a (hPLD1) mRNA, complete cds. | Homo sapiens | 38,652 | Mar. 10, 1997 |
| rxa01041 | 276 | GB_PR2:AC002481 | 28244 | AC002481 | Human cosmid clone LUCA12 from 3p21.3, complete sequence. | Homo sapiens | 39,643 | Aug. 21, 1997 |
| | | GB_HTG6:AC007957 | 212658 | AC007957 | Homo sapiens, *SEQUENCING IN PROGRESS*, 2 ordered pieces. | Homo sapiens | 40,809 | Nov. 26, 1999 |
| | | GB_PR2:AP000552 | 157086 | AP000552 | Homo sapiens genomic DNA, chromosome 22q11.2, BCRL2 region, clone KB1183D5. | Homo sapiens | 40,809 | Oct. 1, 1999 |
| | | GB_PR3:HS57A13 | 169693 | Z83848 | Human DNA sequence from PAC 57A13 between markers DXS6791 and DXS8038 on chromosome X contains glutamate receptor subunit GluRC, ESTs, STS and polymorphic CA repeat. | Homo sapiens | 37,647 | Nov. 23, 1999 |
| rxa01042 | 38970 | GB_BA1:MTCY10G2 | 38970 | Z92539 | Mycobacterium tuberculosis H37Rv complete genome; segment 47/162. | Mycobacterium tuberculosis | 36,023 | Jun. 17, 1998 |
| | | GB_BA1:MTCY10G2 | 38970 | Z92539 | Mycobacterium tuberculosis H37Rv complete genome; segment 47/162. | Mycobacterium tuberculosis | 37,010 | Jun. 17, 1998 |
| | | GB_EST29:AI551042 | 538 | AI551042 | vx33d11.x1 Stratagene mouse lung 937302 Mus musculus cDNA clone IMAGE:1277013 3′, mRNA sequence. | Mus musculus | 38,806 | Mar. 23, 1999 |
| rxa01043 | 696 | GB_BA1:AF006658 | 2500 | AF006658 | Bacteroides fragilis beta-glucosidase gene, complete cds. | Bacteroides fragilis | 39,156 | Jul. 12, 1997 |
| | | GB_BA1:MLB1790G | 37617 | Z14314 | M. leprae genes rplL, rpoB, rpoC, end, rpsL, rpsG, efg, tuf, rpsJ, rplC for ribosomal protein L7, RNA polymerase beta subunit, RNA polymerase beta′ subunit, endonuclease, ribosomal protein S7, ribosomal protein S12, elongation factor G, elongation factor Tu, ribosomal protein S10, ribosomal protein L3 and mkl gene. | Mycobacterium leprae | 39,970 | Feb. 11, 1993 |
| | | GB_BA1:AF006658 | 2500 | AF006658 | Bacteroides fragilis beta-glucosidase gene, complete cds. | Bacteroides fragilis | 36,472 | Jul. 12, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01044 | 1380 | GB_HTG6:AC010998 | 144338 | AC010998 | Homo sapiens clone RP11-95116, *SEQUENCING IN PROGRESS*, 17 unordered pieces. | Homo sapiens | 37,630 | Dec. 8, 1999 |
| | | GB_HTG6:AC010998 | 144338 | AC010998 | Homo sapiens clone RP11-95116, *SEQUENCING IN PROGRESS*, 17 unordered pieces. | Homo sapiens | 37,864 | Dec. 8, 1999 |
| | | GB_BA2:AE000939 | 10599 | AE000939 | Methanobacterium thermoautotrophicum from bases 1698671 to 1709269 (section 145 of 148) of the complete genome. | Methanobacterium thermoautotrophicum | 34,480 | Nov. 15, 1997 |
| rxa01045 | 1947 | GB_VI:FCVF6A | 8440 | M18247 | Feline leukemia virus, subgroup A (FeLV-FAIDS), complete nucleotide sequence. | Feline leukemia virus | 37,617 | Mar. 29, 1996 |
| | | GB_OM:CATFLVPOL | 3639 | L06140 | Felis catus endogenous FeLV proviral polyprotein (protease (PRO), reverse transcriptase (RT), integrase/endonuclease (INT)) and pol pseudogene, 3′ end. | Felis catus | 41,966 | Aug. 21, 1995 |
| | | GB_VI:CEAVCG | 9189 | M33677 | Caprine arthritis encephalitis virus, complete proviral genome. | Caprine arthritis-encephalitis virus | 36,297 | Mar. 4, 1996 |
| rxa01046 | 1902 | GB_HTG3:AC008423 | 177734 | AC008423 | Homo sapiens chromosome 5 clone CIT-HSPC_298N6, *SEQUENCING IN PROGRESS*, 56 unordered pieces. | Homo sapiens | 38,720 | Aug. 3, 1999 |
| | | GB_HTG3:AC008423 | 177734 | AC008423 | Homo sapiens chromosome 5 clone CIT-HSPC_298N6, *SEQUENCING IN PROGRESS*, 56 unordered pieces. | Homo sapiens | 38,720 | Aug. 3, 1999 |
| | | GB_HTG3:AC008423 | 177734 | AC008423 | Homo sapiens chromosome 5 clone CIT-HSPC_298N6, *SEQUENCING IN PROGRESS*, 56 unordered pieces. | Homo sapiens | 35,882 | Aug. 3, 1999 |
| rxa01047 | 597 | GB_EST20:AA842685 | 510 | AA842685 | MBAFC29C11T3 Brugia malayi adult female cDNA (SAW96MLW-BmAF) Brugia malayi cDNA clone AFC29C11 5′, mRNA sequence. | Brugia malayi | 37,965 | Mar. 2, 1998 |
| | | GB_EST20:AA842685 | 510 | AA842685 | MBAFC29C11T3 Brugia malayi adult female cDNA (SAW96MLW-BmAF) Brugia malayi cDNA clone AFC29C11 5′, mRNA sequence. | Brugia malayi | 41,697 | Mar. 2, 1998 |
| rxa01058 | 444 | GB_GSS9:AQ160800 | 745 | AQ160800 | nbxb0006C07t CUGI Rice BAC Library Oryza sativa genomic clone nbxb0006C07t, genomic survey sequence. | Oryza sativa | 38,242 | Sep. 12, 1998 |
| | | GB_GSS3:B10162 | 1102 | B10162 | F11B10-Sp6 IGF Arabidopsis thaliana genomic clone F11B10, genomic survey sequence. | Arabidopsis thaliana | 42,263 | May 14, 1997 |
| | | GB_BA1:AB032799 | 9077 | AB032799 | Chromobacterium violaceum violacein biosynthetic gene cluster (vioA, vio B, vio C, vio D), complete cds. | Chromobacterium violaceum | 34,475 | Oct. 2, 1999 |
| rxa01063 | 453 | GB_GSS4:AQ707752 | 510 | AQ707752 | HS_5560_A2_G07_T7A RPCI-11 Human Male BAC Library Homo sapiens genomic clone Plate = 1136 Col = 14 Row = M, genomic survey sequence. | Homo sapiens | 36,932 | Jul. 7, 1999 |
| | | GB_GSS4:AQ707752 | 510 | AQ707752 | HS_5560_A2_G07_T7A RPCI-11 Human Male BAC Library Homo sapiens genomic clone Plate = 1136 Col = 14 Row = M, genomic survey sequence. | Homo sapiens | 35,885 | Jul. 7, 1999 |
| rxa01066 | 849 | GB_BA2:U32709 | 10010 | U32709 | Haemophilus influenzae Rd section 24 of 163 of the complete genome. | Haemophilus influenzae Rd | 36,158 | May 29, 1998 |
| | | GB_RO:AB009615 | 1515 | AB009615 | Mus musculus mRNA for type II phosphatidylinositolphosphate kinase-alpha, complete cds. | Mus musculus | 37,861 | Feb. 13, 1999 |
| | | GB_RO:AB032899 | 1914 | AB032899 | Rattus norvegicus PIPK2 alpha mRNA for phosphatidylinositol 5-phosphate 4-kinase alpha, complete cds. | Rattus norvegicus | 38,480 | Oct. 7, 1999 |
| rxa01068 | 1194 | GB_HTG4:AC006091 | 176878 | AC006091 | Drosophila melanogaster chromosome 3 clone BACR48G05 (D475) RPCI-98 48.G.5 map 91F1–91F13 strain y; cn bw sp, *SEQUENCING IN PROGRESS*, 4 unordered pieces. | Drosophila melanogaster | 35,539 | Oct. 27, 1999 |
| | | GB_HTG4:AC006091 | 176878 | AC006091 | Drosophila melanogaster chromosome 3 clone BACR48G05 (D475) RPCI-98 48.G.5 map 91F1–91F13 strain y; cn bw sp, *SEQUENCING IN PROGRESS*, 4 unordered pieces. | Drosophila melanogaster | 35,539 | Oct. 27, 1999 |
| | | GB_HTG2:AC008141 | 100729 | AC008141 | Drosophila melanogaster chromosome 3 clone BACR17F04 (D988) RPCI-98 17.F.4 map 91F—91F strain y, cn bw sp, *SEQUENCING IN PROGRESS*, 69 unordered pieces. | Drosophila melanogaster | 34,415 | Aug. 2, 1999 |
| rxa01069 | 837 | GB_EST15:AA531901 | 524 | AA531901 | TgESTzz32g09.r1 TgME49 invivo Bradyzoite cDNA size selected Toxoplasma gondii cDNA clone tgzz32g09.r1 5′, mRNA sequence. | Toxoplasma gondii | 43,005 | Jul. 22, 1997 |
| | | GB_EST15:AA520183 | 527 | AA520183 | TgESTzz39d01.s1 TgME49 invivo Bradyzoite cDNA size selected Toxoplasma gondii cDNA clone tgzz39d01.s1 3′, mRNA sequence. | Toxoplasma gondii | 40,664 | Jul. 16, 1997 |
| | | GB_HTG6:AC010846 | 187611 | AC010846 | Drosophila melanogaster chromosome X clone BACR13G13 (D894) RPCI-98 13.G.13 map 14B–14C strain y; cn bw sp, *SEQUENCING IN PROGRESS*, 97 unordered pieces. | Drosophila melanogaster | 36,679 | Dec. 3, 1999 |
| rxa01071 | 2187 | GB_EST20:AA880319 | 450 | AA880319 | vx39h01.r1 Stratagene mouse lung 937302 Mus musculus cDNA clone IMAGE:1277617 5′, | Mus musculus | 40,724 | Mar. 26, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01074 | 828 | GB_GSS14:AQ558382 | 435 | AQ558382 | HS_2068_B1_F06_T7C CIT Approved Human Genomic Sperm Library D Homo sapiens genomic clone Plate = 2068 Col = 11 Row = L, genomic survey sequence. mRNA sequence. | Homo sapiens | 36,882 | May 29, 1999 |
|  |  | GB_GSS15:AQ600385 | 483 | AQ600385 | HS_5357_B2_C05_SP6E RPCI-11 Human Male BAC Library Homo sapiens genomic clone Plate = 933 Col = 10 Row = F, genomic survey sequence. | Homo sapiens | 40,476 | Jun. 10, 1999 |
|  |  | GB_BA1:PSEHEDDH | 3060 | M74256 | Pseudomonas aeruginosa 6-phosphogluconate dehydratase (edd) gene, and glyceraldehyde-3-phosphate dehydrogenase (gap) gene, complete cds. | Pseudomonas aeruginosa | 39,657 | Nov. 30, 1993 |
|  |  | GB_BA1:CGL007732 | 4460 | AJ007732 | Corynebacterium glutamicum 3' ppc gene, secG gene, amt gene, ocd gene and 5' soxA gene | Corynebacterium glutamicum | 39,168 | Jan. 7, 1999 |
| rxa01075 |  | GB_EST9:AA066016 | 406 | AA066016 | ml52f12.r1 Stratagene mouse testis (#937308) Mus musculus cDNA clone IMAGE:515663 5', mRNA sequence. | Mus musculus | 43,382 | Feb. 3, 1997 |
|  | 534 | GB_EST21:AA986543 | 445 | AA986543 | ue14f08.x1 Sugano mouse embryo mewa Mus musculus cDNA clone IMAGE:1480359 3', mRNA sequence. | Mus musculus | 31,236 | May 28, 1998 |
|  |  | GB_EST22:AI035794 | 509 | AI035794 | ue17d01.y1 Sugano mouse embryo mewa Mus musculus cDNA clone IMAGE:1480609 5', mRNA sequence. | Mus musculus | 42,264 | Jun. 26, 1998 |
|  |  | GB_EST22:AI006506 | 384 | AI006506 | ue14f08.y1 Sugano mouse embryo mewa Mus musculus cDNA clone IMAGE:1480359 5', mRNA sequence. | Mus musculus | 46,637 | Jun. 12, 1998 |
| rxa01076 | 1143 | GB_HTG2:AC007741 | 162450 | AC007741 | Homo sapiens clone NH0340F16, **SEQUENCING IN PROGRESS*, 3 unordered pieces. | Homo sapiens | 38,209 | Jun. 5, 1999 |
|  |  | GB_HTG2:AC007741 | 162450 | AC007741 | Homo sapiens clone NH0340F16, **SEQUENCING IN PROGRESS*, 3 unordered pieces. | Homo sapiens | 38,209 | Jun. 5, 1999 |
|  |  | GB_EST33:AV072325 | 317 | AV072325 | AV072325 Mus musculus stomach C57BL/6J adult Mus musculus cDNA clone 2200003E03, mRNA sequence. | Mus musculus | 48,485 | Jun. 24, 1999 |
| rxa01078 | 957 | GB_BA2:RCPHSYNG | 45959 | Z11165 | R. capsulatus complete photosynthesis gene cluster. | Rhodobacter capsulatus | 36,603 | Sep. 2, 1999 |
|  |  | GB_BA2:RCPHSYNG | 45959 | Z11165 | R. capsulatus complete photosynthesis gene cluster. | Rhodobacter capsulatus | 37,989 | Sep. 2, 1999 |
|  |  | GB_PR4:AF073931 | 7898 | AF073931 | Homo sapiens low-voltage activated calcium channel alpha 1H mRNA, complete cds. | Homo sapiens | 37,953 | Mar. 4, 1999 |
| rxa01083 | 399 | GB_BA2:AF112535 | 4363 | AF112535 | Corynebacterium glutamicum putative glutaredoxin NrdH (nrdH), NrdI (nrdI), and ribonucleotide reductase alpha-chain (nrdE) genes, complete cds. | Corynebacterium glutamicum | 99,499 | Aug. 5, 1999 |
|  |  | GB_PR3:HSH3D2 | 1789 | AF053138 | Homo sapiens histone deacetylase 3 gene, exons 11, 12, 13 and partial cds. | Homo sapiens | 33,512 | Mar. 28, 1998 |
|  |  | GB_PR4:AF059650 | 16015 | AF059650 | Homo sapiens histone deacetylase 3 (HDAC3) gene, complete cds. | Homo sapiens | 38,814 | Mar. 3, 1999 |
| rxa01085 | 902 | GB_EST4:H55032 | 951 | H55032 | HHU58a Sorghum bicolor cv. TX430 Sorghum bicolor cDNA clone HHU58 5' similar to transketolase, chloroplast (TKLC1), mRNA sequence. | Sorghum bicolor | 41,111 | Sep. 27, 1999 |
|  |  | GB_HTG2:HSBA27F12 | 123489 | AL109914 | Homo sapiens chromosome 6 clone RP11-27F12 map p22.3-24, **SEQUENCING IN PROGRESS*, in unordered pieces. | Homo sapiens | 35,156 | Nov. 30, 1999 |
|  |  | GB_HTG2:HSBA27F12 | 123489 | AL109914 | Homo sapiens chromosome 6 clone RP11-27F12 map p22.3-24, **SEQUENCING IN PROGRESS*, in unordered pieces. | Homo sapiens | 35,156 | Nov. 30, 1999 |
| rxa01088 | 1305 | GB_HTG5:AC010202 | 170004 | AC010202 | Homo sapiens chromosome 12q seeders clone RP11-210L7, **SEQUENCING IN PROGRESS*, 40 unordered pieces. | Homo sapiens | 37,313 | Nov. 6, 1999 |
|  |  | GB_HTG5:AC010202 | 170004 | AC010202 | Homo sapiens chromosome 12q seeders clone RP11-210L7, **SEQUENCING IN PROGRESS*, 40 unordered pieces. | Homo sapiens | 37,422 | Nov. 6, 1999 |
| rxa01091 | 664 | GB_PR1:HSIGFACI | 7260 | X57025 | Human IGF-1 mRNA for insulin-like growth factor I. | Homo sapiens | 38,043 | Feb. 17, 1992 |
|  |  | GB_BA1:ECORELA | 4034 | J04039 | E. coli relA gene encoding ATP:GTP 3'-pyrophosphotransferase, complete cds. | Escherichia coli | 54,711 | Nov. 16, 1993 |
|  |  | GB_BA2:ECU29580 | 13234 | U29580 | Escherichia coli K-12 genome; approximately 62 minute region. | Escherichia coli | 37,327 | Apr. 5, 1999 |
|  |  | GB_BA2:AE000362 | 12595 | AE000362 | Escherichia coli K-12 MG 1655 section 252 of 400 of the complete genome. | Escherichia coli | 37,327 | Nov. 12, 1998 |
| rxa01096 | 547 | GB_PL1:PCX24CRY | 357 | Z34459 | P. cryptogea X24 gene for cryptogein. | Phytophthora cryptogea | 43,310 | Sep. 19, 1996 |
|  |  | GB_EST24:AI244520 | 414 | AI244520 | qk14o08.x1 NCI_CGAP_Kid3 Homo sapiens cDNA clone IMAGE:1868942 3', mRNA sequence. | Homo sapiens | 33,528 | Jan. 28, 1999 |
|  |  | GB_RO:MM26SPROT | 1479 | Y13071 | Mus musculus mRNA for 26S proteasome non-ATPase subunit. | Mus musculus | 37,941 | Sep. 10, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01102 | 1368 | GB_HTG3:AC009219 | 127519 | AC009219 | *Drosophila melanogaster* chromosome 3 clone BACR32N16 (D973) RPCI-98 32.N.16 map 86C-*Drosophila melanogaster* 86C strain y; cn bw sp, **SEQUENCING IN PROGRESS*, 74 unordered pieces. | *Drosophila melanogaster* | 35,080 | Aug. 20, 1999 |
|  |  | GB_HTG3:AC009219 | 127519 | AC009219 | *Drosophila melanogaster* chromosome 3 clone BACR32N16 (D973) RPCI-98 32.N.16 map 86C-*Drosophila melanogaster* 86C strain y; cn bw sp, **SEQUENCING IN PROGRESS*, 74 unordered pieces. | *Drosophila melanogaster* | 35,080 | Aug. 20, 1999 |
|  |  | GB_PR4:AC006065 | 191134 | AC006065 | *Homo sapiens* 12q24.2 BAC RPCI11-407A16 (Roswell Park Cancer Institute Human BAC Library) complete sequence. | *Homo sapiens* | 37,453 | Feb. 27, 1999 |
| rxa01103 | 348 | GB_EST13:AA340958 | 338 | AA340958 | EST46332 Fetal kidney II *Homo sapiens* cDNA 5′ end, mRNA sequence. | *Homo sapiens* | 36,596 | Apr. 21, 1997 |
|  |  | GB_RO:MUSBCL22 | 5806 | L31532 | *Mus musculus* bcl-2 alpha gene, exon 2. | *Mus musculus* | 33,913 | Apr. 5, 1994 |
|  |  | GB_BA2:AE001165 | 13021 | AE001165 | *Borrelia burgdorferi* (section 51 of 70) of the complete genome. | *Borrelia burgdorferi* | 31,412 | Dec. 15, 1997 |
| rxa01107 | 1323 | GB_HTG1:HS1030M6 | 173804 | AL035089 | *Homo sapiens* chromosome 20 clone RP5-1030M6, **SEQUENCING IN PROGRESS*, in unordered pieces. | *Homo sapiens* | 34,935 | Nov. 23, 1999 |
|  |  | GB_HTG1:HS1030M6 | 173804 | AL035089 | *Homo sapiens* chromosome 20 clone RP5-1030M6, **SEQUENCING IN PROGRESS*, in unordered pieces. | *Homo sapiens* | 34,935 | Nov. 23, 1999 |
| rxa01108 | 774 | GB_HTG2:AC005057 | 99370 | AC005057 | *Homo sapiens* clone RG052H06, **SEQUENCING IN PROGRESS*, 11 unordered pieces. | *Homo sapiens* | 35,897 | Jun. 12, 1998 |
|  |  | GB_PR2:HSJ193N13 | 122961 | AL078600 | Human DNA sequence from clone RP1-193N13 on chromosome 6q21-22.31, complete sequence. | *Homo sapiens* | 37,115 | Nov. 22, 1999 |
|  |  | GB_EST34:AV139054 | 287 | AV139054 | AV139054 *Mus musculus* C57BL/6J 10-11 day embryo *Mus musculus* cDNA clone 2810048D09, mRNA sequence. | *Mus musculus* | 35,540 | Jul. 1, 1999 |
|  |  | GB_PL1:GTU21246 | 926 | U21246 | *Gracilariopsis tenuifrons* internal transcribed spacer region of the ribosomal repeat, ITS1, 5.8S rRNA gene and ITS2, complete sequence. | *Gracilariopsis tenuifrons* | 37,200 | Mar. 12, 1995 |
| rxa01109 | 765 | GB_BA1:AB003332 | 1424 | AB003332 | *Anabaena variabilis* rbpF gene for RNA binding protein, complete cds. | *Anabaena variabilis* | 35,958 | May 21, 1999 |
|  |  | GB_BA1:BPETOXOP | 9342 | L10720 | *Bordetella pertussis* toxin liberation operon. | *Bordetella pertussis* | 40,107 | Jul. 9, 1993 |
|  |  | GB_PAT:I50844 | 951 | I50844 | Sequence 12 from U.S. Pat. No. 5643747. | Unknown. | 39,973 | Oct. 7, 1997 |
| rxa01119 | 1053 | GB_GSS3:B36708 | 438 | B36708 | HS-1041-B1-C05-MF.abi CIT Human Genomic Sperm Library C *Homo sapiens* genomic clone Plate = CT 823 Col = 9 Row = F, genomic survey sequence. | *Homo sapiens* | 37,300 | Oct. 17, 1997 |
|  |  | GB_PL2:F11A17 | 102077 | AC007932 | *Arabidopsis thaliana* chromosome 1 BAC F11A17 sequence, complete sequence. | *Arabidopsis thaliana* | 37,488 | Aug. 16, 1999 |
|  |  | GB_EST22:AI043264 | 283 | AI043264 | TENU0904 *T. cruzi* epimastigote normalized cDNA Library *Trypanosoma cruzi* cDNA clone 2i14 3′, mRNA sequence. | *Trypanosoma cruzi* | 40,989 | Jul. 1, 1998 |
| rxa01121 | 1209 | GB_PAT:I78756 | 737 | I78756 | Sequence 12 from U.S. Pat. No. 5693781. | Unknown. | 40,975 | Apr. 3, 1998 |
|  |  | GB_PAT:I92045 | 737 | I92045 | Sequence 12 from U.S. Pat. No. 5726299. | Unknown. | 40,975 | Dec. 1, 1998 |
|  |  | GB_PL1:MTPACG | 100314 | X55026 | *P. anserina* complete mitochondrial genome. | Mitochondrion *Podospora anserina* | 34,477 | Dec. 8, 1997 |
| rxa01122 | 645 | GB_HTG4:AC010148 | 228794 | AC010148 | *Homo sapiens* chromosome unknown clone NH0367B19, WORKING DRAFT SEQUENCE, in unordered pieces. | *Homo sapiens* | 42,130 | Oct. 29, 1999 |
|  |  | GB_HTG4:AC010148 | 228794 | AC010148 | *Homo sapiens* chromosome unknown clone NH0367B19, WORKING DRAFT SEQUENCE, in unordered pieces. | *Homo sapiens* | 42,130 | Oct. 29, 1999 |
|  |  | GB_HTG4:AC010148 | 228794 | AC010148 | *Homo sapiens* chromosome unknown clone NH0367B19, WORKING DRAFT SEQUENCE, in unordered pieces. | *Homo sapiens* | 37,559 | Oct. 29, 1999 |
| rxa01123 | 570 | GB_EST33:AV090612 | 274 | AV090612 | AV090612 *Mus musculus* tongue C57BL/6J adult *Mus musculus* cDNA clone 2310051C21, mRNA sequence. | *Mus musculus* | 33,212 | Jun. 28, 1999 |
|  |  | GB_EST33:AV090612 | 274 | AV090612 | AV090612 *Mus musculus* tongue C57BL/6J adult *Mus musculus* cDNA clone 2310051C21, mRNA sequence. | *Mus musculus* | 34,529 | Jun. 28, 1999 |
| rxa01127 | 2042 | GB_BA1:CGLEUB | 2042 | Y09578 | *C. glutamicum* leuB gene. | *Corynebacterium glutamicum* | 99,913 | Mar. 2, 1999 |
|  |  | GB_BA1:MTV012 | 70287 | AL021287 | *Mycobacterium tuberculosis* H37Rv complete genome, segment 132/162. | *Mycobacterium tuberculosis* | 39,295 | Jun. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01128 | 1137 | GB_BA1:SC1C2 | 42210 | AL031124 | *Streptomyces coelicolor* cosmid 1C2. | *Streptomyces coelicolor* | 62,458 | Jan. 15, 1999 |
| | | GB_BA1:CGLEUB | 2042 | Y09578 | *C. glutamicum* leuB gene. | *Corynebacterium glutamicum* | 38,515 | Mar. 2, 1999 |
| | | GB_GSS8:AQ066341 | 241 | AQ066341 | HS_2243_B1_A02_MF CIT Approved Human Genomic Sperm Library D *Homo sapiens* genomic clone Plate = 2243 Col = 3 Row = B, genomic survey sequence. | *Homo sapiens* | 39,004 | Aug. 4, 1998 |
| | | GB_EST24:AI168493 | 459 | AI168493 | ou64g08.s1 NCI_CGAP_Br2 *Homo sapiens* cDNA clone IMAGE:1632638 3' similar to gb:D90209 DNA-BINDING PROTEIN TAXREB67 (HUMAN); mRNA sequence. | *Homo sapiens* | 42,117 | Oct. 23, 1998 |
| rxa01129 | 1989 | GB_BA1:MTCI28 | 36300 | Z97050 | *Mycobacterium tuberculosis* H37Rv complete genome; segment 10/162. | *Mycobacterium tuberculosis* | 38,159 | Jun. 23, 1998 |
| | | GB_HTG1:LMFL6852 | 37286 | AL034359 | *Leishmania major* chromosome 4 clone L6852 strain Freidlin, **SEQUENCING IN PROGRESS**, in unordered pieces. | *Leishmania major* | 38,485 | Apr. 29, 1999 |
| | | GB_HTG1:LMFL6852 | 37286 | AL034359 | *Leishmania major* chromosome 4 clone L6852 strain Freidlin, **SEQUENCING IN PROGRESS**, in unordered pieces. | *Leishmania major* | 38,485 | Apr. 29, 1999 |
| rxa01131 | 990 | GB_BA1:CGLEUB | 2042 | Y09578 | *C. glutamicum* leuB gene. | *Corynebacterium glutamicum* | 99,313 | Mar. 2, 1999 |
| | | GB_PR4:AC007253 | 225699 | AC007253 | *Homo sapiens* BAC clone NH0454P05 from 2, complete sequence. | *Homo sapiens* | 35,421 | Oct. 22, 1999 |
| | | GB_HTG3:AC011305 | 171067 | AC011305 | *Homo sapiens* clone NH0390E09, **SEQUENCING IN PROGRESS**, 1 unordered pieces. | *Homo sapiens* | 35,955 | Oct. 5, 1999 |
| rxa01134 | 871 | GB_HTG4:AC009375 | 137069 | AC009375 | *Drosophila melanogaster* chromosome 3L/75A1 clone RPCI98-44L18, **SEQUENCING IN PROGRESS**, 59 unordered pieces. | *Drosophila melanogaster* | 37,380 | Oct. 16, 1999 |
| | | GB_HTG4:AC009375 | 137069 | AC009375 | *Drosophila melanogaster* chromosome 3L/75A1 clone RPCI98-44L18, **SEQUENCING IN PROGRESS**, 59 unordered pieces. | *Drosophila melanogaster* | 37,380 | Oct. 16, 1999 |
| | | GB_HTG4:AC009375 | 137069 | AC009375 | *Drosophila melanogaster* chromosome 3L/75A1 clone RPCI98-44L18, **SEQUENCING IN PROGRESS**, 59 unordered pieces. | *Drosophila melanogaster* | 38,489 | Oct. 16, 1999 |
| rxa01137 | 483 | GB_IN2:AC005421 | 69992 | AC005421 | *Drosophila melanogaster*, chromosome 2L, region 22A1-22A1, P1 clone DS03601, complete sequence. | *Drosophila melanogaster* | 37,367 | Oct. 31, 1998 |
| | | GB_GSS1:CNS00KX9 | 1101 | AL078350 | *Drosophila melanogaster* genome survey sequence TET3 end of BAC:BACR23A23 of RPCI-98 library from *Drosophila melanogaster* (fruit fly), genomic survey sequence. | *Drosophila melanogaster* | 30,670 | Jun. 3, 1999 |
| | | GB_IN2:AC005421 | 69992 | AC005421 | *Drosophila melanogaster*, chromosome 2L, region 22A1-22A1, P1 clone DS03601, complete sequence. | *Drosophila melanogaster* | 33,333 | Oct. 31, 1998 |
| rxa01140 | 1056 | GB_PR4:AC007948 | 99904 | AC007948 | Genomic sequence of *Homo sapiens* clone R417F14A from chromosome 18, complete sequence. | *Homo sapiens* | 36,249 | Nov. 6, 1999 |
| | | GB_HTG3:AC006278 | 140290 | AC006278 | *Plasmodium falciparum* chromosome 12 clone 3D7, **SEQUENCING IN PROGRESS**, 18 unordered pieces. | *Plasmodium falciparum* | 36,592 | Sep. 23, 1999 |
| | | GB_HTG3:AC006278 | 140290 | AC006278 | *Plasmodium falciparum* chromosome 12 clone 3D7, **SEQUENCING IN PROGRESS**, 18 unordered pieces. | *Plasmodium falciparum* | 36,592 | Sep. 23, 1999 |
| rxa01148 | 723 | GB_BA1:MTCY261 | 27322 | Z97559 | *Mycobacterium tuberculosis* H37Rv complete genome; segment 95/162. | *Mycobacterium tuberculosis* | 50,139 | Jun. 17, 1998 |
| | | GB_EST15:AA501229 | 548 | AA501229 | vh62g12.r1 Knowles Solter mouse 11 5 day limb bud *Mus musculus* cDNA clone IMAGE:891622 5' similar to TR:G762951 G762951 PRPL-2 PROTEIN; mRNA sequence. | *Mus musculus* | 36,250 | Jul. 1, 1997 |
| | | GB_PR4:AF106062 | 1306 | AF106062 | *Homo sapiens* Wiskott-Aldrich syndrome protein interacting protein (WASPIP) mRNA, partial cds. | *Homo sapiens* | 43,205 | Jul. 31, 1999 |
| rxa01153 | 543 | GB_BA1:MTCY261 | 27322 | Z97559 | *Mycobacterium tuberculosis* H37Rv complete genome; segment 95/162. | *Mycobacterium tuberculosis* | 40,000 | Jun. 17, 1998 |
| | | GB_BA1:MLCB2533 | 40245 | AL035310 | *Mycobacterium leprae* cosmid B2533. | *Mycobacterium leprae* | 61,765 | Aug. 27, 1999 |
| | | GB_BA1:U00017 | 42157 | U00017 | *Mycobacterium leprae* cosmid B2126. | *Mycobacterium leprae* | 39,615 | Mar. 1, 1994 |
| rxa01154 | 677 | GB_BA1:MTCY49 | 39430 | Z73966 | *Mycobacterium tuberculosis* H37Rv complete genome, segment 93/162. | *Mycobacterium* | 37,615 | Jun. 24, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01155 | 1570 | GB_BA1:U00017 | 42157 | U00017 | *Mycobacterium leprae* cosmid B2126. | *Mycobacterium leprae* | 36,957 | Mar. 1, 1994 |
| | | GB_BA2:AF086832 | 10612 | AF086832 | *Streptomyces coelicolor* putative ferredoxin, ARC (arc), 20S proteasome beta-subunit precursor (prcB), 20S proteasome alpha-subunit (prcA), putative LacI family repressor, and putative transporter genes, complete cds; and unknown genes. | *Streptomyces coelicolor* | 53,354 | Jun. 30, 1999 |
| | | GB_BA1:MTCY49 | 39430 | Z73966 | *Mycobacterium tuberculosis* H37Rv complete genome; segment 93/162. | *Mycobacterium tuberculosis* | 37,025 | Jun. 24, 1999 |
| rxa01156 | 257 | GB_BA1:REZ82005 | 3301 | Z82005 | R. erythropolis DNA, 20S proteasome structural genes region (3301 bp). | *Rhodococcus erythropolis* | 54,128 | Nov. 8, 1997 |
| | | GB_BA2:RSU26422 | 3554 | U26422 | *Rhodococcus erythropolis* ORF6(2), ORF7(2), proteasome beta-type subunit 2 (prcB(2)), proteasome alpha-type subunit 2 (prcA(2)) genes, complete cds. | *Rhodococcus erythropolis* | 45,951 | Oct. 8, 1997 |
| | | GB_BA2:RSU26422 | 3554 | U26422 | *Rhodococcus erythropolis* ORF6(2), ORF7(2), proteasome beta-type subunit 2 (prcB(2)), and proteasome alpha-type subunit 2 (prcA(2)) genes, complete cds. | *Rhodococcus erythropolis* | 54,724 | Oct. 8, 1997 |
| | | GB_HTG2:AC009218 | 126649 | AC009218 | *Drosophila melanogaster* chromosome 2 clone BACR33D17 (D945) RPCI-98 33.D.17 map 57B—57B strain y; cn bw sp, **SEQUENCING IN PROGRESS*, 76 unordered pieces. | *Drosophila melanogaster* | 42,570 | Dec. 2, 1999 |
| rxa01158 | 1065 | GB_OV:QUINFLW | 7933 | D13223 | Japanese quail genomic DNA for neurofilament-L (NF-L). | *Coturnix coturnix* | 44,758 | Feb. 3, 1999 |
| | | GB_HTG3:AC011401 | 321277 | AC011401 | *Homo sapiens* chromosome 5 clone CIT978SKB_35K5, *SEQUENCING IN PROGRESS*, 65 unordered pieces. | *Homo sapiens* | 35,048 | Oct. 6, 1999 |
| | | GB_HTG3:AC011401 | 321277 | AC011401 | *Homo sapiens* chromosome 5 clone CIT978SKB_35K5, *SEQUENCING IN PROGRESS*, 65 unordered pieces. | *Homo sapiens* | 35,048 | Oct. 6, 1999 |
| rxa01159 | 438 | GB_PR3:AC004386 | 172657 | AC004386 | *Homo Sapiens* Chromosome X clone bWXD691, complete sequence. | *Homo sapiens* | 37,223 | Apr. 10, 1998 |
| | | GB_PAT:I92035 | 413 | I92035 | Sequence 2 from U.S. Pat. No. 5726299. | Unknown. | 78,169 | Dec. 1, 1998 |
| | | GB_PAT:I78746 | 413 | I78746 | Sequence 2 from U.S. Pat. No. 5693781. | Unknown. | 78,169 | Apr. 3, 1998 |
| | | GB_HTG3:AC009209 | 108370 | AC009209 | *Drosophila melanogaster* chromosome 2 clone BACR24G16 (D1051) RPCI-98 24.G.16 map 47D—47D strain y; cn bw sp. **SEQUENCING IN PROGRESS*. 93 unordered pieces. | *Drosophila melanogaster* | 43,590 | Aug. 20, 1999 |
| rxa01160 | 998 | GB_PAT:I78746 | 413 | I78746 | Sequence 2 from U.S. Pat. No. 5693781. | Unknown. | 96,032 | Apr. 3, 1998 |
| | | GB_PAT:I92035 | 413 | I92035 | Sequence 2 from U.S. Pat. No. 5726299. | Unknown. | 96,032 | Dec. 1, 1998 |
| | | GB_BA2:AF014804 | 6449 | AF014804 | *Neisseria meningitidis* PglB (pglB), PglC (pglC), PglD (pglD), and AvtA (avtA) genes, complete cds. | *Neisseria meningitidis* | 37,977 | Sep. 3, 1999 |
| rxa01165 | 696 | GB_HTG2:AC007851 | 128979 | AC007851 | *Drosophila melanogaster* chromosome 2 clone BACR06M19 (D615) RPCI-98 06.M.19 map 50C—50D strain y; cn bw sp, **SEQUENCING IN PROGRESS**, 86 unordered pieces. | *Drosophila melanogaster* | 37,900 | Aug. 2, 1999 |
| | | GB_HTG2:AC007851 | 128979 | AC007851 | *Drosophila melanogaster* chromosome 2 clone BACR06M19 (D615) RPCI-98 06.M.19 map 50C—50D strain y; cn bw sp, **SEQUENCING IN PROGRESS**, 86 unordered pieces. | *Drosophila melanogaster* | 37,900 | Aug. 2, 1999 |
| | | GB_HTG2:AC007851 | 128979 | AC007851 | *Drosophila melanogaster* chromosome 2 clone BACR06M19 (D615) RPCI-98 06.M.19 map 50C—50D strain y; cn bw sp, **SEQUENCING IN PROGRESS**, 86 unordered pieces. | *Drosophila melanogaster* | 34,114 | Aug. 2, 1999 |
| rxa01166 | 1428 | GB_BA1:LEUG6PD | 1957 | M64446 | *L. mesenteroides* glucose-6-phosphate dehydrogenase gene, complete cds. | *Leuconostoc mesenteroides* | 41,259 | Apr. 26, 1993 |
| | | GB_HTG3:AF188026 | 101456 | AF188026 | *Homo sapiens* chromosome 8 clone BAC 2379L20 map 8q24, *SEQUENCING IN PROGRESS*, in ordered pieces. | *Homo sapiens* | 35,535 | Oct. 8, 1999 |
| | | GB_HTG3:AF188026 | 101456 | AF188026 | *Homo sapiens* chromosome 8 clone BAC 2379L20 map 8q24, *SEQUENCING IN PROGRESS*, in ordered pieces. | *Homo sapiens* | 35,535 | Oct. 8, 1999 |
| rxa01167 | 519 | GB_PR2:HS1026E2 | 100418 | AL022143 | Human DNA sequence from clone 1q24.1-25.3 EST, CA repeat, STS, GSS, complete sequence. | *Homo sapiens* | 38,281 | Nov. 23, 1999 |
| | | GB_EST36:AI900015 | 496 | AI900015 | sb97ft05.y1 Gm-c1012 *Glycine max* cDNA clone GENOME SYSTEMS CLONE ID: Gm-c1012-634 5' similar to WP:T11G6.8 CE06432 RNA RECOGNITION MOTIF; mRNA sequence. | *Glycine max* | 42,045 | Dec. 6, 1999 |
| | | GB_PR2:HS1026E2 | 100418 | AL022143 | Human DNA sequence from clone 1026E2 on chromosome 1q24.1-25.3 EST, CA repeat, STS, GSS, complete sequence. | *Homo sapiens* | 40,990 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01169 | 1119 | GB_HTG2:AC005978 | 92586 | AC005978 | *Drosophila melanogaster* chromosome 2 clone DS00678 (D449) map 59D3–59D4 strain y; cn bw sp. **SEQUENCING IN PROGRESS*, 6 unordered pieces. | *Drosophila melanogaster* | 34,266 | Jul. 30, 1999 |
| | | GB_HTG2:AC005978 | 92586 | AC005978 | *Drosophila melanogaster* chromosome 2 clone DS00678 (D449) map 59D3–59D4 strain y; cn bw sp. **SEQUENCING IN PROGRESS*, 6 unordered pieces. | *Drosophila melanogaster* | 34,266 | Jul. 30, 1999 |
| | | GB_HTG3:AC008304 | 91552 | AC008304 | *Drosophila melanogaster* chromosome 2 clone BACR04G19 (D646) RPCI-98 04.G.19 map 59D2–59D3 strain y; cn bw sp. *SEQUENCING IN PROGRESS*, 90 unordered pieces. | *Drosophila melanogaster* | 31,278 | Sep. 20, 1999 |
| rxa01170 | 606 | GB_PR1:AB014524 | 6542 | AB014524 | *Homo sapiens* mRNA for KIAA0624 protein, partial cds. | *Homo sapiens* | 43,478 | Feb. 6, 1999 |
| | | GB_EST38:AW016078 | 496 | AW016078 | UI-H-BI0p-abf-h-01-0-UI.s1 NCI_CGAP_Sub2 *Homo sapiens* cDNA clone IMAGE:2711665 3'; mRNA sequence. | *Homo sapiens* | 36,667 | Sep. 10, 1999 |
| | | GB_EST24:AI193238 | 323 | AI193238 | qe56c06.x1 Soares_fetal_lung_NbHL19W *Homo sapiens* cDNA clone IMAGE:1742986 3'; mRNA sequence. | *Homo sapiens* | 37,427 | Oct. 29, 1998 |
| rxa01171 | 816 | GB_HTG2:AC007548 | 110249 | AC007548 | *Drosophila melanogaster* chromosome 2 clone BACR48M17 (D614) RPCI-98 48.M.17 map 41C–41D strain y; cn bw sp. *SEQUENCING IN PROGRESS*, 66 unordered pieces. | *Drosophila melanogaster* | 35,634 | Aug. 2, 1999 |
| | | GB_PR3:HS273F20 | 111253 | AL034371 | Human DNA sequence from clone 273F20 on chromosome 6q16.1-16.3 Contains ESTs, STSs and GSSs, complete sequence. | *Homo sapiens* | 34,582 | Nov. 23, 1999 |
| | | GB_HTG2:AC007548 | 110249 | AC007548 | *Drosophila melanogaster* chromosome 2 clone BACR48M17 (D614) RPCI-98 48.M.17 map 41C–41D strain y; cn bw sp. *SEQUENCING IN PROGRESS*, 66 unordered pieces. | *Drosophila melanogaster* | 35,634 | Aug. 2, 1999 |
| rxa01173 | 738 | GB_GSS8:B93272 | 338 | B93272 | CIT-HSP-2171E14.TF CIT-HSP *Homo sapiens* genomic clone 2171E14, genomic survey sequence. | *Homo sapiens* | 42,012 | Jun. 25, 1998 |
| | | GB_EST35:AV156265 | 282 | AV156265 | AV156265 *Mus musculus* head C57BL/6J 12-day embryo *Mus musculus* cDNA clone 300001103, mRNA sequence. | *Mus musculus* | 41,350 | Jul. 7, 1999 |
| rxa01174 | 873 | GB_RO:AF035777 | 2154 | AF035777 | *Mus musculus* somatostatin receptor subtype 5 (sst5) gene, complete cds. | *Mus musculus* | 38,928 | Dec. 5, 1997 |
| | | GB_HTG1:CEY51A2_3 | 110000 | Z99275 | *Caenorhabditis elegans* chromosome V clone Y51A2, *SEQUENCING IN PROGRESS*, in unordered pieces. | *Caenorhabditis elegans* | 38,045 | Dec. 3, 1998 |
| | | GB_IN1:CEY51A2D | 139259 | AL021497 | *Caenorhabditis elegans* cosmid Y51A2D, complete sequence. | *Caenorhabditis elegans* | 38,045 | Sep. 2, 1999 |
| | | GB_HTG1:CEY51A2_3 | 110000 | Z99275 | *Caenorhabditis elegans* chromosome V clone Y51A2, **SEQUENCING IN PROGRESS*, in unordered pieces. | *Caenorhabditis elegans* | 38,045 | Dec. 3, 1998 |
| rxa01176 | 627 | GB_BA1:MTV021 | 23400 | AL021957 | *Mycobacterium tuberculosis* H37Rv complete genome; segment 97/162. | *Mycobacterium tuberculosis* | 39,159 | Jun. 18, 1998 |
| | | GB_BA1:MSGB1551CS | 36548 | L78813 | *Mycobacterium leprae* cosmid B1551 DNA sequence. | *Mycobacterium leprae* | 53,215 | Jun. 15, 1996 |
| | | GB_BA1:MSGB1554CS | 36548 | L78814 | *Mycobacterium leprae* cosmid B1554 DNA sequence. | *Mycobacterium leprae* | 53,215 | Jun. 15, 1996 |
| rxa01177 | | | | | | | | |
| rxa01178 | 573 | GB_PR4:AC006126 | 46100 | AC006126 | *Homo sapiens* chromosome 19, cosmid F18718, complete sequence. | *Homo sapiens* | 36,832 | Dec. 17, 1998 |
| | | GB_PR4:AC006126 | 46100 | AC006126 | *Homo sapiens* chromosome 19, cosmid F18718, complete sequence. | *Homo sapiens* | 40,463 | Dec. 17, 1998 |
| | | GB_EST23:AI128078 | 443 | AI128078 | qc47d10.x1 Soares_pregnant_uterus_NbHPU *Homo sapiens* cDNA clone IMAGE:1712755 3' similar to SW:IF16_HUMAN Q16668 GAMMA-INTERFERON-INDUCIBLE PROTEIN IF1-16; mRNA sequence. | *Homo sapiens* | 38,318 | Oct. 27, 1998 |
| rxa01184 | 1596 | GB_HTG2:HSG248A21 | 96783 | AL118512 | *Homo sapiens* chromosome 1 clone GS1-248A21, *SEQUENCING IN PROGRESS*, in unordered pieces. | *Homo sapiens* | 36,994 | Nov. 30, 1999 |
| | | GB_HTG2:HSG248A21 | 96783 | AL118512 | *Homo sapiens* chromosome 1 clone GS1-248A21, *SEQUENCING IN PROGRESS*, in unordered pieces. | *Homo sapiens* | 36,994 | Nov. 30, 1999 |
| | | GB_PR3:AC004237 | 38715 | AC004237 | *Homo sapiens* chromosome 5, P1 clone 565a12 (LBNL H23), complete sequence. | *Homo sapiens* | 36,514 | Feb. 27, 1998 |
| rxa01186 | 1221 | GB_BA1:MTCY274 | 39991 | Z74024 | *Mycobacterium tuberculosis* H37Rv complete genome; segment 126/162. | *Mycobacterium tuberculosis* | 34,758 | Jun. 19, 1998 |
| | | GB_BA1:SC6A9 | 39461 | AL031035 | *Streptomyces coelicolor* cosmid 6A9. | *Streptomyces coelicolor* | 38,500 | Jul. 24, 1998 |
| | | GB_BA2:AE000689 | 14698 | AE000689 | *Aquifex aeolicus* section 21 of 109 of the complete genome. | *Aquifex aeolicus* | 45,379 | Mar. 25, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01187 | 573 | GB_EST5:H60943 | 361 | H60943 | yr14g08.r1 Soares fetal liver spleen 1NFLS Homo sapiens cDNA clone IMAGE:205310 5', mRNA sequence. | Homo sapiens | 39,205 | Oct. 6, 1995 |
| | | GB_GSS1:AG018858 | 570 | AG018858 | Homo sapiens genomic DNA, 21q region, clone: B125C11 SpN045(-21), genomic survey sequence. | Homo sapiens | 41,423 | Oct. 10, 1999 |
| | | GB_GSS13:AQ454839 | 505 | AQ454839 | HS_5218_A1_E03_T7A RPCI-11 Human Male BAC Library Homo sapiens genomic clone Plate = 794 Col = 5 Row = L, genomic survey sequence. | Homo sapiens | 34,599 | Apr. 21, 1999 |
| rxa01195 | 570 | GB_PR3:AF022813 | 1358 | AF022813 | Homo sapiens tetraspan (NAG-2) mRNA, complete cds. | Homo sapiens | 40,614 | Nov. 18, 1997 |
| | | GB_EST34:AI798721 | 765 | AI798721 | we91g10.x1 Soares_NFL_T_GBC_S1 Homo sapiens cDNA clone IMAGE:2348514 3' similar to SW:NAG2_HUMAN O14817 NOVEL ANTIGEN 2; mRNA sequence. | Homo sapiens | 35,256 | Jul. 6, 1999 |
| | | GB_EST34:AI808898 | 696 | AI808898 | wf66d02.x1 Soares_NFL_T_GBC_S1 Homo sapiens cDNA clone IMAGE:2360547 3' similar to SW:NAG2_HUMAN O14817 NOVEL ANTIGEN 2; mRNA sequence. | Homo sapiens | 35,354 | Jul. 7, 1999 |
| rxa01196 | 813 | GB_BA1:MSGY151 | 37036 | AD000018 | Mycobacterium tuberculosis sequence from clone y151. | Mycobacterium tuberculosis | 36,634 | Dec. 10, 1996 |
| | | GB_BA1:MTCY130 | 32514 | Z73902 | Mycobacterium tuberculosis H37Rv complete genome; segment 59/162. | Mycobacterium tuberculosis | 59,596 | Jun. 17, 1998 |
| | | GB_BA1:MSGY151 | 37036 | AD000018 | Mycobacterium tuberculosis sequence from clone y151. | Mycobacterium tuberculosis | 39,567 | Dec. 10, 1996 |
| rxa01197 | 576 | GB_EST18:AA676822 | 524 | AA676822 | zj65c11.s1 Soares_fetal_liver_spleen_1NFLS_S1 Homo sapiens cDNA clone IMAGE:455156 3', mRNA sequence. | Homo sapiens | 40,741 | Dec. 19, 1997 |
| | | GB_EST18:AA676822 | 524 | AA676822 | zj65c11.s1 Soares_fetal_liver_spleen_1NFLS_S1 Homo sapiens cDNA clone IMAGE:455156 3', mRNA sequence. | Homo sapiens | 40,331 | Dec. 19, 1997 |
| rxa01198 | 426 | GB_HTG4:AC010195 | 164935 | AC010195 | Homo sapiens chromosome 10 clone RPCI11-587C2, *SEQUENCING IN PROGRESS*, 61 unordered pieces. | Homo sapiens | 36,058 | Oct. 21, 1999 |
| | | GB_HTG4:AC010195 | 164935 | AC010195 | Homo sapiens chromosome 10 clone RPCI11-587C2, *SEQUENCING IN PROGRESS*, 61 unordered pieces. | Homo sapiens | 36,058 | Oct. 21, 1999 |
| | | GB_HTG1:CEY44A6 | 326074 | Z98863 | Caenorhabditis elegans chromosome V clone Y44A6, **SEQUENCING IN PROGRESS*, in unordered pieces. | Caenorhabditis elegans | 39,151 | Dec. 3, 1998 |
| rxa01206 | 400 | GB_HTG1:CER08A5 | 51920 | Z82281 | Caenorhabditis elegans chromosome V clone R08A5, **SEQUENCING IN PROGRESS*, in unordered pieces. | Caenorhabditis elegans | 43,557 | Oct. 14, 1998 |
| | | GB_HTG1:CER08A5 | 51920 | Z82281 | Caenorhabditis elegans chromosome V clone R08A5, **SEQUENCING IN PROGRESS*, in unordered pieces. | Caenorhabditis elegans | 43,557 | Oct. 14, 1998 |
| | | GB_HTG1:CER08A5 | 51920 | Z82281 | Caenorhabditis elegans chromosome V clone R08A5, **SEQUENCING IN PROGRESS*, in unordered pieces. | Caenorhabditis elegans | 34,987 | Oct. 14, 1998 |
| rxa01207 | 771 | GB_PL2:SPBC8D2 | 43757 | AL022072 | S. pombe chromosome II cosmid c8D2. | Schizosaccharomyces pombe | 36,566 | Nov. 24, 1999 |
| | | GB_PL1:AB004538 | 38911 | AB004538 | Schizosaccharomyces pombe 39 kb genomic DNA, clone c568. | Schizosaccharomyces pombe | 36,148 | Jul. 15, 1997 |
| rxa01210 | 954 | GB_HTG6:AC009220 | 110000 | AC009220 | Homo sapiens chromosome 7, **SEQUENCING IN PROGRESS*, 191 unordered pieces. | Homo sapiens | 33,940 | Sep. 15, 1999 |
| | | GB_GSS4:AQ694235 | 530 | AQ694235 | HS_5496_A1_D03_T7ARPCI-11 Human Male BAC Library Homo sapiens genomic clone Plate = 1072 Col = 5 Row = G, genomic survey sequence. | Homo sapiens | 37,259 | Jul. 6, 1999 |
| | | GB_GSS11:AQ322059 | 519 | AQ322059 | RPCI11-100G10.TV RPCI-11 Homo sapiens genomic clone RPCI-11-100G10, genomic survey sequence. | Homo sapiens | 37,229 | May 6, 1999 |
| rxa01213 | 1350 | GB_BA1:SCH24 | 41625 | AL049826 | Streptomyces coelicolor cosmid H24. | Streptomyces coelicolor | 38,126 | May 11, 1999 |
| | | GB_PR3:HS356B7 | 20733 | AL031714 | Human DNA sequence from clone 356B7 on chromosome 16. Contains the UBE2I gene for ubiquitin-conjugating enzyme E2I (homologous to yeast UBC9), and an RPS20 (40S Ribosomal protein S20) pseudogene. Contains ESTs, STSs, GSSs and a putative CpG island, complete | Homo sapiens | 36,684 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_PR3:HS356B7 | 20733 | AL031714 | sequence. Human DNA sequence from clone 356B7 on chromosome 16. Contains the UBE2I gene for ubiquitin-conjugating enzyme E2I (homologous to yeast UBC9), and an RPS20 (40S Ribosomal protein S20) pseudogene. Contains ESTs, STSs, GSSs and a putative CpG island, complete sequence. | Homo sapiens | 39,621 | Nov. 23, 1999 |
| rxa01218 | 552 | GB_PR1:HSEF1AL1 | 1815 | X16870 | Human DNA for elongation factor 1-alpha (clone lambda-1). | Homo sapiens | 37,462 | Jun. 12, 1990 |
| | | GB_PR3:HS257I9 | 90695 | AL031773 | Human DNA sequence from clone 257I9 on chromosome 6q25.1-26 Contains gene similar to Cytochrome B, CA repeat, GSS, complete sequence. | Homo sapiens | 35,897 | Nov. 23, 1999 |
| | | GB_PR3:HS287L14 | 112831 | Z95325 | Human DNA sequence from clone 287L14 on chromosome Xq21.1-21.33 Contains STSs and GSSs, complete sequence. | Homo sapiens | 37,778 | Nov. 23, 1999 |
| | | GB_EST8:AA035251 | 493 | AA035251 | zk23d09.s1 Soares_pregnant_uterus_NbHPU Homo sapiens cDNA clone IMAGE:471377 3', mRNA sequence. | Homo sapiens | 40,191 | May 10, 1997 |
| rxa01229 | 1401 | GB_PR4:HUAC002394 | 107910 | AC002394 | Human Chromosome 16 BAC clone CIT987SK-A-211C6, complete sequence. | Homo sapiens | 33,633 | Nov. 23, 1999 |
| | | GB_OV:AF138905 | 1678 | AF138905 | Gallus gallus NK class homeodomain transcription factor NKX3.2 mRNA, complete cds. | Gallus gallus | 30,556 | Sep. 4, 1999 |
| | | GB_PAT:AR031772 | 30001 | AR031772 | Sequence 1 from U.S. Pat. No. 5866410. | Unknown. | 34,304 | Sep. 29, 1999 |
| rxa01231 | 366 | GB_EST25:AI295169 | 507 | AI295169 | LP08720.3prime LP Drosophila melanogaster larval-early pupal pOT2 Drosophila melanogaster cDNA clone LP08720 3prime, mRNA sequence. | Drosophila melanogaster | 38,279 | Dec. 1, 1998 |
| | | GB_EST25:AI297653 | 512 | AI297653 | LP12002.3prime LP Drosophila melanogaster larval-early pupal pOT2 Drosophila melanogaster cDNA clone LP12002 3prime, mRNA sequence. | Drosophila melanogaster | 36,893 | Dec. 1, 1998 |
| | | GB_EST21:AA951454 | 677 | AA951454 | LD31920.5prime LD Drosophila melanogaster embryo pOT2 Drosophila melanogaster cDNA clone LD31920 5prime, mRNA sequence. | Drosophila melanogaster | 44,167 | Nov. 24, 1998 |
| rxa01234 | 507 | GB_GSS12:AQ365352 | 431 | AQ365352 | nbxb0063L_13f CUGI Rice BAC Library Oryza sativa genomic clone nbxb0063L13f, genomic survey sequence. | Oryza sativa | 34,577 | Feb. 3, 1999 |
| | | GB_PR4:AC007544 | 119034 | AC007544 | Homo sapiens Human 12p11-37.2-54.4 BAC RPCI1-12D15 (Roswell Park Cancer Institute Human BAC Library) complete sequence. | Homo sapiens | 34,350 | Oct. 29, 1999 |
| | | GB_PR4:AC007544 | 119034 | AC007544 | Homo sapiens Human 12p11-37.2-54.4 BAC RPCI1-12D15 (Roswell Park Cancer Institute Human BAC Library) complete sequence. | Homo sapiens | 37,988 | Oct. 29, 1999 |
| rxa01237 | 564 | GB_GSS1:AG009269 | 706 | AG009269 | Homo sapiens genomic DNA, 21q region, clone: 31C6X11, genomic survey sequence. | Homo sapiens | 36,328 | Apr. 14, 1999 |
| | | GB_GSS1:AG009269 | 706 | AG009269 | Homo sapiens genomic DNA, 21q region, clone: 31C6X11, genomic survey sequence. | Homo sapiens | 37,391 | Apr. 14, 1999 |
| rxa01246 | 630 | GB_HTG2:AC007646 | 180133 | AC007646 | Drosophila melanogaster chromosome 3 clone BACR03304 (D687) RPCI-98 03.J.4 map 87F—87F strain y; cn bw sp; *SEQUENCING IN PROGRESS*, 10 unordered pieces. | Drosophila melanogaster | 38,188 | Aug. 2, 1999 |
| | | GB_HTG2:AC007646 | 180133 | AC007646 | Drosophila melanogaster chromosome 3 clone BACR03304 (D687) RPCI-98 03.J.4 map 87F—87F strain y; cn bw sp; *SEQUENCING IN PROGRESS*, 10 unordered pieces. | Drosophila melanogaster | 38,188 | Aug. 2, 1999 |
| rxa01249 | 471 | GB_HTG4:AC009492 | 212394 | AC009492 | Homo sapiens clone NH0423F09, **SEQUENCING IN PROGRESS*, 2 unordered pieces. | Homo sapiens | 38,762 | Oct. 29, 1999 |
| | | GB_EST7:W84105 | 361 | W84105 | T2969 MVAT4 bloodstream form of serodeme WRATat1.1 Trypanosoma brucei rhodesiense cDNA 5', mRNA sequence. | Trypanosoma brucei rhodesiense | 38,261 | Aug. 12, 1996 |
| | | GB_EST7:W84105 | 361 | W84105 | T2969 MVAT4 bloodstream form of serodeme WRATat1.1 Trypanosoma brucei rhodesiense cDNA 5', mRNA sequence. | Trypanosoma brucei rhodesiense | 33,894 | Aug. 12, 1996 |
| rxa01251 | 432 | GB_RO:AC005240 | 41830 | AC005240 | Mus musculus clone UWGC: magap from 14D1-D2 (T-cell Receptor Alpha Locus), complete sequence. | Mus musculus | 41,463 | Jul. 8, 1998 |
| | | GB_RO:AC004101 | 39491 | AC004101 | Mouse Cosmid ma53a016 from 14D1-D2, complete sequence. | Mus musculus | 41,463 | Feb. 2, 1998 |
| | | GB_HTG3:AC009837 | 162287 | AC009837 | Homo sapiens chromosome 17 clone 550_K_23 map 17, *SEQUENCING IN PROGRESS*, 13 unordered pieces. | Homo sapiens | 36,131 | Sep. 2, 1999 |
| rxa01263 | 1035 | GB_PR4:AC005919 | 156300 | AC005919 | Homo sapiens chromosome 17, clone hRPK.142_H_19, complete sequence. | Homo sapiens | 39,822 | Nov. 18, 1998 |
| | | GB_PR4:AC005919 | 156300 | AC005919 | Homo sapiens chromosome 17, clone hRPK.142_H_19, complete sequence. | Homo sapiens | 38,319 | Nov. 18, 1998 |
| | | GB_HTG1:CEY71A12_3 | 110000 | AL021390 | Caenorhabditis elegans chromosome I clone Y71A12, *SEQUENCING IN PROGRESS*, | Caenorhabditis elegans | 36,884 | Sep. 15, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01266 | 1158 | GB_HTG4:AC010775 | 165565 | AC010775 | *Homo sapiens* clone 2_G_17, *SEQUENCING IN PROGRESS*, 14 unordered pieces. | *Homo sapiens* | 38,670 | Oct. 20, 1999 |
| | | GB_HTG4:AC010775 | 165565 | AC010775 | *Homo sapiens* clone 2_G_17, *SEQUENCING IN PROGRESS*, 14 unordered pieces. | *Homo sapiens* | 38,670 | Oct. 20, 1999 |
| | | GB_HTG4:AC010775 | 165565 | AC010775 | *Homo sapiens* clone 2_G_17, *SEQUENCING IN PROGRESS*, 14 unordered pieces. | *Homo sapiens* | 36,131 | Oct. 20, 1999 |
| rxa01267 | 1437 | GB_PR3:AF070717 | 100793 | AF070717 | *Homo sapiens* BAC clone 393j22 from 8q21, complete sequence. | *Homo sapiens* | 38,826 | Jul. 2, 1998 |
| | | GB_BA2:MPU34931 | 2571 | U34931 | *Mycoplasma pulmonis* FtsZ (ftsZ) gene, complete cds, methionyl-tRNA synthetase (metG) gene, partial cds. | *Mycoplasma pulmonis* | 37,092 | May 30, 1996 |
| | | GB_EST25:AI322057 | 638 | AI322057 | SWOv3MCAM09A04SK *Onchocerca volvulus* molting L3 larva cDNA (SL96M1W-OvmL3) *Onchocerca volvulus* cDNA clone SWOv3MCAM09A04 5', mRNA sequence. | *Onchocerca volvulus* | 40,566 | Dec. 22, 1998 |
| rxa01268 | 963 | GB_HTG3:AC010878 | 288945 | AC010878 | *Homo sapiens* clone NH0230E20, *SEQUENCING IN PROGRESS*, 65 unordered pieces. | *Homo sapiens* | 36,498 | Sep. 25, 1999 |
| | | GB_HTG3:AC010878 | 288945 | AC010878 | *Homo sapiens* clone NH0230E20, *SEQUENCING IN PROGRESS*, 65 unordered pieces. | *Homo sapiens* | 36,498 | Sep. 25, 1999 |
| | | GB_HTG3:AC010878 | 288945 | AC010878 | *Homo sapiens* clone NH0230E20, *SEQUENCING IN PROGRESS*, 65 unordered pieces. | *Homo sapiens* | 36,354 | Sep. 25, 1999 |
| rxa01271 | 1935 | GB_BA2:U67549 | 14561 | U67549 | *Methanococcus jannaschii* section 91 of 150 of the complete genome. | *Methanococcus jannaschii* | 37,841 | Jan. 28, 1998 |
| | | GB_PR2:HSJ836N17 | 111694 | AL049539 | Human DNA sequence from clone RP5-836N17 on chromosome 20q11.1-11.21, complete sequence. | *Homo sapiens* | 34,872 | Nov. 22, 1999 |
| rxa01273 | 1557 | GB_OV:AF089743 | 30676 | AF089743 | *Morone saxatilis* homeodomain protein Hox-A10 (Hoxa10), homeodomain protein Hox-A9 (Hoxa9), homeodomain protein Hox-A7 (Hoxa7), homeodomain protein Hox-A5 (Hoxa5), and homeodomain protein Hox-A4 (Hoxa4) genes, complete cds. | *Morone saxatilis* | 36,738 | Aug. 2, 1999 |
| | | GB_PR2:AC004070 | 110192 | AC004070 | Human Chromosome X, complete sequence. | *Homo sapiens* | 37,679 | Jan. 29, 1998 |
| | | GB_PR2:AC002410 | 96217 | AC002410 | Human BAC clone RG264L19 from 7p15-p21, complete sequence. | *Homo sapiens* | 38,587 | Aug. 11, 1997 |
| | | GB_PR2:AC002410 | 96217 | AC002410 | Human BAC clone RG264L19 from 7p15-p21, complete sequence. | *Homo sapiens* | 37,035 | Aug. 11, 1997 |
| rxa01275 | 1041 | GB_EST8:C03322 | 357 | C03322 | C03322 Human heart cDNA (YNakamura) *Homo sapiens* cDNA clone 3NHC1263, mRNA sequence. | *Homo sapiens* | 35,393 | Jul. 30, 1996 |
| | | GB_EST4:R92079 | 410 | R92079 | yp96g02.r1 Soares fetal liver spleen 1NFLS *Homo sapiens* cDNA clone IMAGE:195314 5', mRNA sequence. | *Homo sapiens* | 37,010 | Aug. 25, 1995 |
| | | GB_EST4:H57724 | 461 | H57724 | yr21a12.r1 Soares fetal liver spleen 1NFLS *Homo sapiens* cDNA clone IMAGE:205918 5', mRNA sequence. | *Homo sapiens* | 37,281 | Oct. 5, 1995 |
| rxa01276 | 567 | GB_OM:OCMYLC1 | 962 | X54041 | Rabbit mRNA for myosin light chain 1. | *Oryctolagus cuniculus* | 40,503 | Nov. 26, 1990 |
| | | GB_PR3:AC005383 | 123110 | AC005383 | *Homo sapiens* chromosome 10 clone CIT987SK-1144G6 map 10q25.1, complete sequence. | *Homo sapiens* | 38,930 | Oct. 31, 1998 |
| | | GB_RO:RATPTPECA | 2155 | D78610 | Rat mRNA for protein tyrosine phosphatase epsilon C, partial cds. | *Rattus norvegicus* | 37,770 | Feb. 5, 1999 |
| rxa01281 | 885 | GB_HTG4:AC009366 | 199607 | AC009366 | *Drosophila melanogaster* chromosome 3L/79D4 clone RPCI98-48E10, *SEQUENCING IN PROGRESS*, 31 unordered pieces. | *Drosophila melanogaster* | 34,025 | Oct. 16, 1999 |
| | | GB_HTG4:AC009366 | 199607 | AC009366 | *Drosophila melanogaster* chromosome 3L/79D4 clone RPCI98-48E10, *SEQUENCING IN PROGRESS*, 31 unordered pieces. | *Drosophila melanogaster* | 34,025 | Oct. 16, 1999 |
| | | GB_HTG4:AC009366 | 199607 | AC009366 | *Drosophila melanogaster* chromosome 3L/79D4 clone RPCI98-48E10, *SEQUENCING IN PROGRESS*, 31 unordered pieces. | *Drosophila melanogaster* | 34,386 | Oct. 16, 1999 |
| rxa01282 | 903 | GB_GSS11:AQ263970 | 363 | AQ263970 | CITBI-E1-2503H24.TF CITBI-E1 *Homo sapiens* genomic clone 2503H24, genomic survey sequence. | *Homo sapiens* | 40,361 | Oct. 27, 1998 |
| | | GB_GSS1:FR0025959 | 603 | AL018794 | *F. rubripes* GSS sequence, clone 165E10aE1, genomic survey sequence. | *Fugu rubripes* | 34,824 | Dec. 10, 1997 |
| | | GB_GSS9:AQ102435 | 334 | AQ102435 | HS_3038_B2_D09_MF CIT Approved Human Genomic Sperm Library D *Homo sapiens* genomic clone Plate = 3038 Col = 18 Row = H, genomic survey sequence. | *Homo sapiens* | 37,624 | Aug. 27, 1998 |
| rxa01294 | 789 | GB_PL2:AC007258 | 144422 | AC007258 | *Arabidopsis thaliana* chromosome I BAC F23H11 genomic sequence, complete sequence. | *Arabidopsis thaliana* | 39,453 | Jun. 16, 1999 |
| | | GB_EST17:T04634 | 491 | T04634 | 681 Lambda-PRL1 *Arabidopsis thaliana* cDNA clone SBD1T7P, mRNA sequence. | *Arabidopsis thaliana* | 38,693 | Nov. 6, 1997 |
| | | GB_PL2:AC007258 | 144422 | AC007258 | *Arabidopsis thaliana* chromosome I BAC F23H11 genomic sequence, complete sequence. | *Arabidopsis thaliana* | 36,170 | Jun. 16, 1999 |
| rxa01295 | 1098 | GB_HTG3:AC009803 | 235360 | AC009803 | *Homo sapiens* clone RPCI11-1028N23, *SEQUENCING IN PROGRESS*, 47 unordered pieces. | *Homo sapiens* | 38,662 | Sep. 24, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01296 | | GB_HTG3:AC009803 | 235360 | AC009803 | *Homo sapiens* clone RPCI11-1028N23, **SEQUENCING IN PROGRESS*, 47 unordered pieces. | *Homo sapiens* | 38,662 | Sep. 24, 1999 |
| | 1206 | GB_IN2:AC004333 | 63178 | AC004333 | *Drosophila melanogaster* DNA sequence (P1 DS05969 (D229)), complete sequence. | *Drosophila melanogaster* | 39,252 | Jun. 20, 1998 |
| | | GB_PR4:AC004961 | 68130 | AC004961 | *Homo sapiens* clone DJ1098J04, complete sequence. | *Homo sapiens* | 39,409 | Jun. 5, 1999 |
| | | GB_GSS14:AQ525299 | 447 | AQ525299 | HS_5227_B2_H03_.SP6E RPCI-11 Human Male BAC Library *Homo sapiens* genomic clone Plate = 803 Col = 6 Row = P, genomic survey sequence. | *Homo sapiens* | 37,330 | May 11, 1999 |
| rxa01301 | | GB_BA2:BFU78108 | 1900 | U78108 | *Bacteroides fragilis* NAD(H) glutamate dehydrogenase (gdhB) gene, complete cds. | *Bacteroides fragilis* | 40,509 | Jul. 15, 1998 |
| | 648 | GB_PR4:AC007051 | 167810 | AC007051 | *Homo sapiens* chromosome 3, clone hRPK.44_A_1, complete sequence. | *Homo sapiens* | 38,498 | Jun. 11, 1999 |
| | | GB_PR4:AC007919 | 184989 | AC007919 | *Homo sapiens* 3q26.2-27 BAC RPCI1-408H1 (Roswell Park Cancer Institute Human BAC Library) complete sequence. | *Homo sapiens* | 35,139 | Oct. 9, 1999 |
| | | GB_EST11:AA252547 | 454 | AA252547 | zp87g09.r1 Stratagene HeLa cell s3 937216 *Homo sapiens* cDNA clone IMAGE:627232 5' similar to gb:D13748 EUKARYOTIC INITIATION FACTOR 4A-1 (HUMAN); mRNA sequence. | *Homo sapiens* | 38,538 | Mar. 12, 1997 |
| rxa01304 | | GB_HTG2:AC006779 | 119562 | AC006779 | *Caenorhabditis elegans* clone Y47D7, **SEQUENCING IN PROGRESS*, 32 unordered pieces. | *Caenorhabditis elegans* | 32,888 | Feb. 25, 1999 |
| | 609 | GB_HTG2:AC006779 | 119562 | AC006779 | *Caenorhabditis elegans* clone Y47D7, **SEQUENCING IN PROGRESS*, 32 unordered pieces. | *Caenorhabditis elegans* | 32,888 | Feb. 25, 1999 |
| rxa01306 | | GB_VI:BHT1UL | 37000 | Z78205 | Bovine herpesvirus type 1 UL22-35 genes. | Bovine herpesvirus 1 | 38,047 | Aug. 14, 1996 |
| | 1131 | GB_GSS8:AQ047475 | 420 | AQ047475 | cLM-1c5-t cLM *Giardia intestinalis* genomic, genomic survey sequence. | *Giardia intestinalis* | 38,902 | Jul. 14, 1998 |
| | | GB_PL1:CR1433P | 1464 | X79445 | *C. reinhardtii* mRNA for 14-3-3 protein. | *Chlamydomonas reinhardtii* | 39,640 | Oct. 6, 1995 |
| rxa01310 | | GB_PR3:HSI878I13 | 122400 | AL049591 | Human DNA sequence from clone 87BI13 on chromosome Xq23-25 Contains a pseudogene similar to alpha tubulin, ESTs, STSs, GSSs, complete sequence. | *Homo sapiens* | 35,624 | Nov. 23, 1999 |
| | 450 | GB_HTG3:AC010530 | 274508 | AC010530 | *Homo sapiens* chromosome 16 clone RPCI-11_167P11, **SEQUENCING IN PROGRESS*, 19 unordered pieces. | *Homo sapiens* | 38,462 | Sep. 15, 1999 |
| | | GB_HTG3:AC010530 | 274508 | AC010530 | *Homo sapiens* chromosome 16 clone RPCI-11_167P11, **SEQUENCING IN PROGRESS*, 19 unordered pieces. | *Homo sapiens* | 38,462 | Sep. 15, 1999 |
| | | GB_HTG3:AC010530 | 274508 | AC010530 | *Homo sapiens* chromosome 16 clone RPCI-11_167P11, **SEQUENCING IN PROGRESS*, 19 unordered pieces. | *Homo sapiens* | 32,063 | Sep. 15, 1999 |
| rxa01313 | | | | | | | | |
| rxa01315 | | GB_BA2:AF031037 | 1472 | AF031037 | *Neisseria meningitidis* chloramphenicol acetyltransferase gene, complete cds. | *Neisseria meningitidis* | 35,638 | Apr. 21, 1998 |
| | 774 | GB_GSS11:AQ326599 | 662 | AQ326599 | nbxb0037P01r CUGI Rice BAC Library *Oryza sativa* genomic clone nbxb0037P01r, genomic survey sequence. | *Oryza sativa* | 34,817 | Jan. 8, 1999 |
| | | GB_HTG1:PFMAL13PA | 80518 | AL109815 | *Plasmodium falciparum* chromosome 13 strain 3D7, **SEQUENCING IN PROGRESS*, in unordered pieces. | *Plasmodium falciparum* | 34,935 | Aug. 19, 1999 |
| rxa01316 | 426 | GB_HTG3:AC010133 | 154773 | AC010133 | *Homo sapiens* clone NH0118E09, **SEQUENCING IN PROGRESS*, 5 unordered pieces. | *Homo sapiens* | 33,414 | Sep. 13, 1999 |
| | | GB_HTG3:AC010133 | 154773 | AC010133 | *Homo sapiens* clone NH0118E09, **SEQUENCING IN PROGRESS*, 5 unordered pieces. | *Homo sapiens* | 33,414 | Sep. 13, 1999 |
| | | GB_HTG3:AC010133 | 154773 | AC010133 | *Homo sapiens* clone NH0118E09, **SEQUENCING IN PROGRESS*, 5 unordered pieces. | *Homo sapiens* | 38,186 | Sep. 13, 1999 |
| rxa01317 | 543 | GB_BA2:U67560 | 12215 | U67560 | *Methanococcus jannaschii* section 102 of 150 of the complete genome. | *Methanococcus jannaschii* | 38,476 | Jan. 28, 1998 |
| | | GB_BA2:U67560 | 12215 | U67560 | *Methanococcus jannaschii* section 102 of 150 of the complete genome. | *Methanococcus jannaschii* | 35,867 | Jan. 28, 1998 |
| rxa01318 | 1425 | GB_BA1:MTV038 | 16094 | U21933 | *Mycobacterium tuberculosis* H37Rv complete genome; segment 24/162. | *Mycobacterium tuberculosis* | 51,266 | Jun. 17, 1998 |
| | | GB_IN1:CELC41A3 | 37149 | U41541 | *Caenorhabditis elegans* cosmid C41A3. | *Caenorhabditis elegans* | 36,887 | Dec. 8, 1995 |
| | | GB_HTG3:AC011298 | 205637 | AC011298 | *Homo sapiens* clone NH0118M12, **SEQUENCING IN PROGRESS*, 19 unordered pieces. | *Homo sapiens* | 35,760 | Oct. 5, 1999 |
| rxa01326 | 489 | GB_BA1:PAL249201 | 3390 | AJ249201 | *Prevotella albensis* ftsQ (partial), ftsA and ftsZ genes and ORF-fts (partial). | *Prevotella albensis* | 37,708 | Aug. 27, 1999 |
| | | GB_BA1:PAL249201 | 3390 | AJ249201 | *Prevotella albensis* ftsQ (partial), ftsA and ftsZ genes and ORF-fts (partial). | *Prevotella albensis* | 37,474 | Aug. 27, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01330 | | | | | | | | |
| rxa01331 | 2520 | GB_HTG1:HSAJ02553 | 142807 | AJ002553 | *Homo sapiens* chromosome 11 clone 118i22 map q13, *SEQUENCING IN PROGRESS*, in unordered pieces. | *Homo sapiens* | 26,237 | Nov. 14, 1997 |
| | | GB_HTG1:HSAJ02553 | 142807 | AJ002553 | *Homo sapiens* chromosome 11 clone 118i22 map q13, *SEQUENCING IN PROGRESS*, in unordered pieces. | *Homo sapiens* | 26,237 | Nov. 14, 1997 |
| rxa01333 | 1126 | GB_PR3:AC005304 | 164017 | AC005304 | *Homo sapiens* chromosome 17, clone hRPK.131_K_5, complete sequence. | *Homo sapiens* | 35,318 | Jul. 25, 1998 |
| | | GB_BA1:CGU43536 | 3464 | U43536 | *Corynebacterium glutamicum* heat shock, ATP-binding protein (clpB) gene, complete cds. | *Corynebacterium glutamicum* | 38,075 | Mar. 13, 1997 |
| | | GB_OM:BTPRLP | 924 | X15975 | Bovine mRNA for prolactin (PRL) related protein. | *Bos taurus* | 40,901 | Dec. 22, 1994 |
| | | GB_OM:BTPRLP | 924 | X15975 | Bovine mRNA for prolactin (PRL) related protein. | *Bos taurus* | 39,580 | Dec. 22, 1994 |
| rxa01336 | 726 | GB_BA1:AP000064 | 247695 | AP000064 | *Aeropyrum pernix* genomic DNA, section 7/7. | *Aeropyrum pernix* | 37,881 | Jun. 22, 1999 |
| | | GB_BA1:AP000064 | 247695 | AP000064 | *Aeropyrum pernix* genomic DNA, section 7/7. | *Aeropyrum pernix* | 36,161 | Jun. 22, 1999 |
| | | GB_EST1:T05458 | 363 | T05458 | EST03347 Fetal brain, Stratagene (cat#936206) *Homo sapiens* cDNA clone HFBCY86, mRNA sequence. | *Homo sapiens* | 43,798 | Jun. 30, 1993 |
| rxa01337 | 1536 | GB_PR2:AP000215 | 100000 | AP000215 | *Homo sapiens* genomic DNA, chromosome 21q22.3-ter, Ter region, clone f27E1-T1136, segment 1/4, complete sequence. | *Homo sapiens* | 36,438 | Nov. 20, 1999 |
| | | GB_PR2:AP000215 | 100000 | AP000215 | *Homo sapiens* genomic DNA, chromosome 21q22.3-ter, Ter region, clone f27E1-T1136, segment 1/4, complete sequence. | *Homo sapiens* | 35,827 | Nov. 20, 1999 |
| | | GB_PR2:AP000337 | 53553 | AP000337 | *Homo sapiens* genomic DNA, chromosome 21q22.3-ter, Ter region, clone:T1957, complete sequence. | *Homo sapiens* | 36,043 | Nov. 20, 1999 |
| rxa01342 | 626 | GB_EST35:AI814229 | 544 | AI814229 | wj70e01.x1 NCI_CGAP_Lu19 *Homo sapiens* cDNA clone IMAGE:2408184 3', mRNA sequence. | *Homo sapiens* | 36,803 | Aug. 24, 1999 |
| | | GB_EST35:AI814229 | 544 | AI814229 | wj70e01.x1 NCI_CGAP_Lu19 *Homo sapiens* cDNA clone IMAGE:2408184 3', mRNA sequence. | *Homo sapiens* | 36,688 | Aug. 24, 1999 |
| rxa01348 | 615 | GB_HTG3:AC011246 | 210407 | AC011246 | *Homo sapiens* clone NH0498O20, *SEQUENCING IN PROGRESS*, 29 unordered pieces. | *Homo sapiens* | 39,101 | Oct. 4, 1999 |
| | | GB_HTG3:AC011246 | 210407 | AC011246 | *Homo sapiens* clone NH0498O20, *SEQUENCING IN PROGRESS*, 29 unordered pieces. | *Homo sapiens* | 39,101 | Oct. 4, 1999 |
| | | GB_PL1:ZMB32120 | 3093 | X54212 | Z. mays mRNA for b-32 protein, putative regulatory factor of zein expression (clone b-32.120). | *Zea mays* | 35,902 | Jan. 18, 1993 |
| rxa01349 | 900 | GB_IN1:CELK10G6 | 33588 | AF016669 | *Caenorhabditis elegans* cosmid K10G6. | *Caenorhabditis elegans* | 40,251 | Aug. 8, 1997 |
| | | GB_IN1:CELK10G6 | 33588 | AF016669 | *Caenorhabditis elegans* cosmid K10G6. | *Caenorhabditis elegans* | 36,842 | Aug. 8, 1997 |
| rxa01357 | 426 | GB_BA1:MTCY274 | 39991 | Z74024 | *Mycobacterium tuberculosis* H37Rv complete genome; segment 126/162. | *Mycobacterium tuberculosis* | 36,058 | Jun. 19, 1998 |
| | | GB_BA2:MLCB250 | 40603 | Z97369 | *Mycobacterium leprae* cosmid B250. | *Mycobacterium leprae* | 59,294 | Aug. 27, 1999 |
| | | GB_BA2:SKZ86111 | 7860 | Z86111 | *Streptomyces lividans* rpsP, trmD, rplS, sipW, sipX, sipY, sipZ, mutT genes and 4 open reading frames. | *Streptomyces lividans* | 57,882 | Oct. 27, 1999 |
| rxa01359 | 1305 | GB_BA1:D87820 | 7217 | D87820 | *Vibrio cholerae* non-O1 gene for N-acetylglucosamine 6-phosphate deacetylase, NagC, NagE, complete cds. | *Vibrio cholerae* non-O1 | 38,152 | Oct. 17, 1997 |
| | | GB_PR3:AC004540 | 131757 | AC004540 | *Homo sapiens* PAC clone DJ1066K24 from 7p15, complete sequence. | *Homo sapiens* | 35,714 | Apr. 9, 1998 |
| | | GB_PR2:HSU44119 | 450 | U44119 | Human der(9) chromosome breakpoint region: alpha 1(V) collagen chain (COL5A1) gene, partial intron 24, and imperfect LINE-1 element of Xp21.2. | *Homo sapiens* | 38,085 | Jan. 14, 1997 |
| rxa01362 | 3677 | GB_EST30:AI665031 | 602 | AI665031 | 605005H05.x1 605 - Endosperm cDNA library from Schmidt lab *Zea mays* cDNA, mRNA sequence. | *Zea mays* | 42,308 | May 11, 1999 |
| | | GB_EST34:AI795319 | 661 | AI795319 | 605005H05.y2 605 - Endosperm cDNA library from Schmidt lab *Zea mays* cDNA, mRNA sequence. | *Zea mays* | 38,729 | Jul. 2, 1999 |
| | | GB_HTG3:AC008387 | 151804 | AC008387 | *Homo sapiens* chromosome 5 clone CIT-HSPC_229P9, *SEQUENCING IN PROGRESS*, 74 unordered pieces. | *Homo sapiens* | 38,023 | Aug. 3, 1999 |
| rxa01366 | 513 | GB_IN1:AF007166 | 1392 | AF007166 | *Anopheles gambiae* serine protease 14D mRNA, complete cds. | *Anopheles gambiae* | 41,379 | Jul. 14, 1997 |
| | | GB_GSS13:AQ475498 | 476 | AQ475498 | CITBI-E1-2589F13.TR CITBI-E1 *Homo sapiens* genomic clone 2589F13, genomic survey | *Homo sapiens* | 40,511 | Apr. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01367 | 525 | GB_IN1:AF007166 | 1392 | AF007166 | sequence. Anopheles gambiae serine protease 14D mRNA, complete cds. | Anopheles gambiae | 40,000 | Jul. 14, 1997 |
| | | GB_EST28:AI489958 | 591 | AI489958 | EST248297 tomato ovary, TAMU Lycopersicon esculentum cDNA clone cLED14O8, mRNA sequence. | Lycopersicon esculentum | 38,186 | Jun. 29, 1999 |
| | | GB_GSS13:AQ475498 | 476 | AQ475498 | CITBI-E1-2589F13.TR CITBI-E1 Homo sapiens genomic clone 2589F13, genomic survey sequence. | Homo sapiens | 37,405 | Apr. 23, 1999 |
| | | GB_EST28:AI489958 | 591 | AI489958 | EST248297 tomato ovary, TAMU Lycopersicon esculentum cDNA clone cLED14O8, mRNA sequence. | Lycopersicon esculentum | 35,882 | Jun. 29, 1999 |
| rxa01370 | | | | | | | | |
| rxa01372 | 614 | GB_HTG5:AC011644 | 164746 | AC011644 | Homo sapiens clone 14_K_21, **SEQUENCING IN PROGRESS*, 8 unordered pieces. | Homo sapiens | 33,715 | Nov. 5, 1999 |
| | | GB_HTG5:AC011644 | 164746 | AC011644 | Homo sapiens clone 14_K_21, **SEQUENCING IN PROGRESS*, 8 unordered pieces. | Homo sapiens | 35,821 | Nov. 5, 1999 |
| rxa01378 | 1878 | GB_IN1:DMBR41I17 | 155168 | AL121806 | Drosophila melanogaster clone BACR42I17. | Drosophila melanogaster | 36,373 | Oct. 10, 1999 |
| | | GB_IN2:AC005714 | 177740 | AC005714 | Drosophila melanogaster, chromosome 2R, region 58D4-58E2, BAC clone BACR48M13, complete sequence. | Drosophila melanogaster | 36,234 | May 1, 1999 |
| | | GB_IN2:AC005639 | 188288 | AC005639 | Drosophila melanogaster, chromosome 2R, region 59E3-59F4, BAC clone BACR48M01, complete sequence. | Drosophila melanogaster | 36,275 | Jan. 6, 1999 |
| rxa01379 | 1042 | GB_HTG4:AC010031 | 132106 | AC010031 | Drosophila melanogaster chromosome 3L/70C1 clone RPCI98-2M20, **SEQUENCING IN PROGRESS*, 69 unordered pieces. | Drosophila melanogaster | 35,368 | Oct. 16, 1999 |
| | | GB_HTG4:AC010031 | 132106 | AC010031 | Drosophila melanogaster chromosome 3L/70C1 clone RPCI98-2M20, **SEQUENCING IN PROGRESS*, 69 unordered pieces. | Drosophila melanogaster | 35,368 | Oct. 16, 1999 |
| rxa01380 | 2322 | GB_HTG3:AC009932 | 68745 | AC009932 | Homo sapiens clone 114_O_12, LOW-PASS SEQUENCE SAMPLING | Homo sapiens | 36,337 | Oct. 5, 1999 |
| | | GB_BA1:SC5F2A | 40105 | AL049587 | Streptomyces coelicolor cosmid 5F2A. | Streptomyces coelicolor | 39,699 | May 24, 1999 |
| | | GB_BA1:BPTEX | 2701 | X95386 | B. pertussis tex gene. | Bordetella pertussis | 59,687 | Jul. 31, 1996 |
| | | GB_BA1:SC5F2A | 40105 | AL049587 | Streptomyces coelicolor cosmid 5F2A. | Streptomyces coelicolor | 41,024 | May 24, 1999 |
| rxa01384 | 1839 | GB_GSS15:AQ613816 | 598 | AQ613816 | HS_5118_B1_F06_T7A RPCI-11 Human Male BAC Library Homo sapiens genomic clone Plate = 694 Col = 11 Row = L, genomic survey sequence. | Homo sapiens | 39,300 | Jun. 15, 1999 |
| | | GB_GSS15:AQ613816 | 598 | AQ613816 | HS_5118_B1_F06_T7A RPCI-11 Human Male BAC Library Homo sapiens genomic clone Plate = 694 Col = 11 Row = L, genomic survey sequence. | Homo sapiens | 36,455 | Jun. 15, 1999 |
| rxa01390 | 780 | GB_BA2:CGL012293 | 2952 | AJ012293 | Corynebacterium glutamicum ilvD gene. | Corynebacterium glutamicum | 40,413 | Oct. 1, 1999 |
| rxa01391 | 813 | GB_PR4:AC006213 | 160754 | AC006213 | Homo sapiens, clone hRPK.15_A_1, complete sequence. | Homo sapiens | 35,724 | Jan. 16, 1999 |
| | | GB_PL2:ATF24G24 | 99856 | AL049488 | Arabidopsis thaliana DNA chromosome 4, BAC clone F24G24 (ESSA project). | Arabidopsis thaliana | 35,925 | Aug. 27, 1999 |
| | | GB_HTG2:AC006171 | 44733 | AC006171 | Homo sapiens chromosome 10 clone LA10NC01_15_E_11 map 10q26.3, **SEQUENCING IN PROGRESS*, 3 unordered pieces. | Homo sapiens | 35,031 | Dec. 9, 1998 |
| | | GB_HTG2:AC006171 | 44733 | AC006171 | Homo sapiens chromosome 10 clone LA10NC01_15_E_11 map 10q26.3, **SEQUENCING IN PROGRESS*, 3 unordered pieces. | Homo sapiens | 35,031 | Dec. 9, 1998 |
| | | GB_HTG2:AC006171 | 44733 | AC006171 | Homo sapiens chromosome 10 clone LA10NC01_15_E_11 map 10q26.3, **SEQUENCING IN PROGRESS*, 3 unordered pieces. | Homo sapiens | 38,035 | Dec. 9, 1998 |
| rxa01396 | 381 | GB_BA2:AE000775 | 14358 | AE000775 | Aquifex aeolicus section 107 of 109 of the complete genome. | Aquifex aeolicus | 43,085 | Mar. 25, 1998 |
| | | GB_EST26:AI329024 | 471 | AI329024 | a9e02ne.f1 Neurospora crassa evening cDNA library Neurospora crassa cDNA clone a9e02ne 5', mRNA sequence. | Neurospora crassa | 39,286 | Dec. 28, 1998 |
| | | GB_EST26:AI329043 | 401 | AI329043 | a9d06ne.f1 Neurospora crassa evening cDNA library Neurospora crassa cDNA clone a9d06ne 5', mRNA sequence. | Neurospora crassa | 44,484 | Dec. 28, 1998 |
| rxa01397 | 543 | GB_BA2:AE000775 | 14358 | AE000775 | Aquifex aeolicus section 107 of 109 of the complete genome. | Aquifex aeolicus | 41,121 | Mar. 25, 1998 |
| | | GB_BA1:BSTMSPRS | 3211 | X16518 | B. subtilis prs, tms, and ctc (partial) genes for PRPP synthetase and two undefined gene products. | Bacillus subtilis | 41,255 | Sep. 30, 1993 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_EST4:H21691 | 382 | H21691 | yl29b01.r1 Soares breast 3NbHBst *Homo sapiens* cDNA clone IMAGE:159625 5' similar to SP:XPEC_CERAE P33194 POSSIBLE DNA-REPAIR PROTEIN XP-E; mRNA sequence. | *Homo sapiens* | 35,407 | Jul. 6, 1995 |
| rxa01400 | 1623 | GB_GSS11:AQ264714 | 353 | AQ264714 | CITBI-E1-2502C17.TR CITBI-E1 *Homo sapiens* genomic clone 2502C17, genomic survey sequence. | *Homo sapiens* | 40,227 | Oct. 27, 1998 |
| | | GB_BA1:TFENTRA | 2803 | M58480 | *Thiobacillus ferrooxidans* nitrogen metabolism regulator (ntrA) gene, complete cds. | *Thiobacillus ferrooxidans* | 39,960 | Apr. 26, 1993 |
| | | GB_BA1:NPSDHCDBA | 5596 | Y07709 | N. pharaonis sdhC, sdhD, sdhB and sdhA genes. | *Natronomonas pharaonis* | 38,003 | Sep. 2, 1996 |
| rxa01401 | 384 | GB_HTG4:AC006583 | 110000 | AC006583 | *Homo sapiens* chromosome 3p21.3 clone RPCI11-491D6, *SEQUENCING IN PROGRESS*, 90 unordered pieces. | *Homo sapiens* | 32,718 | Oct. 21, 1999 |
| | | GB_HTG4:AC006583 | 110000 | AC006583 | *Homo sapiens* chromosome 3p21.3 clone RPCI11-491D6, *SEQUENCING IN PROGRESS*, 90 unordered pieces. | *Homo sapiens* | 32,718 | Oct. 21, 1999 |
| | | GB_HTG4:AC011291 | 173585 | AC011291 | *Homo sapiens* chromosome unknown clone NH0067G07, WORKING DRAFT SEQUENCE, in unordered pieces. | *Homo sapiens* | 33,596 | Oct. 29, 1999 |
| rxa01402 | 597 | GB_BA1:CAJ10319 | 5368 | AJ010319 | *Corynebacterium glutamicum* amtP, glnB, glnD genes and partial ftsY and srp genes. | *Corynebacterium glutamicum* | 39,389 | May 14, 1999 |
| | | GB_HTG4:AC010066 | 187240 | AC010066 | *Drosophila melanogaster* chromosome 3L/72A4 clone RPCI98-25O1, *SEQUENCING IN PROGRESS*, 70 unordered pieces. | *Drosophila melanogaster* | 33,681 | Oct. 16, 1999 |
| | | GB_HTG4:AC010066 | 187240 | AC010066 | *Drosophila melanogaster* chromosome 3L/72A4 clone RPCI98-25O1, *SEQUENCING IN PROGRESS*, 70 unordered pieces. | *Drosophila melanogaster* | 33,681 | Oct. 16, 1999 |
| rxa01403 | 771 | GB_BA1:SC6E10 | 23990 | AL109661 | *Streptomyces coelicolor* cosmid 6E10. | *Streptomyces coelicolor* A3(2) | 39,136 | Aug. 5, 1999 |
| | | GB_GSS12:AQ396728 | 608 | AQ396728 | mgxb0002E02f CUGI Rice Blast BAC Library *Magnaporthe grisea* genomic clone mgxb0002E02f, genomic survey sequence. | *Magnaporthe grisea* | 36,626 | Mar. 6, 1999 |
| | | GB_BA1:SC6E10 | 23990 | AL109661 | *Streptomyces coelicolor* cosmid 6E10. | *Streptomyces coelicolor* A3(2) | 41,403 | Aug. 5, 1999 |
| rxa01405 | 579 | GB_PL2:AF111709 | 52684 | AF111709 | *Oryza sativa* subsp. *indica* Retrosat 1 retrotransposon and Ty3-Gypsy type Retrosat 2 retrotransposon, complete sequences; and unknown genes. | *Oryza sativa* subsp. *indica* | 34,888 | Apr. 26, 1999 |
| | | GB_GSS3:B88760 | 696 | B88760 | RPCI1-24L19.TPC RPCI-11 *Homo sapiens* genomic clone RPCI1-11-24L19, genomic survey sequence. | *Homo sapiens* | 37,204 | Apr. 9, 1999 |
| | | GB_STS:G52436 | 696 | G52436 | SHGC-85004 Human *Homo sapiens* STS genomic, sequence tagged site. | *Homo sapiens* | 37,204 | Jun. 25, 1999 |
| rxa01409 | 845 | GB_HTG5:AC008019 | 190459 | AC008019 | *Mus musculus*, *SEQUENCING IN PROGRESS*, 16 unordered pieces. | *Mus musculus* | 39,924 | Nov. 16, 1999 |
| | | GB_PR4:AC006236 | 127593 | AC006236 | *Homo sapiens* chromosome 17, clone hCIT.162_E_12, complete sequence. | *Homo sapiens* | 33,907 | Dec. 29, 1998 |
| | | GB_HTG5:AC008019 | 190459 | AC008019 | *Mus musculus*, *SEQUENCING IN PROGRESS*, 16 unordered pieces. | *Mus musculus* | 40,819 | Nov. 16, 1999 |
| rxa01413 | 723 | GB_OV:AF038947 | 1617 | AF038947 | *Ambystoma tigrinum* red cone visual pigment mRNA, complete cds. | *Ambystoma tigrinum* | 35,846 | Dec. 16, 1998 |
| | | GB_BA1:MSGB577COS | 37770 | L01263 | M. leprae genomic dna sequence, cosmid b577. | *Mycobacterium leprae* | 38,042 | Jun. 14, 1996 |
| | | GB_PR3:AC002558 | 102064 | AC002558 | *Homo sapiens* chromosome 17, clone hRPC867C24, complete sequence. | *Homo sapiens* | 36,820 | Oct. 31, 1997 |
| rxa01414 | 630 | GB_PL1:SC5610 | 37730 | Z38060 | *S. cerevisiae* chromosome IX sequence derived from lambda clones 5610-5004. | *Saccharomyces cerevisiae* | 38,782 | Aug. 20, 1997 |
| | | GB_PL1:YSCDIN1 | 2969 | M58012 | *S. cerevisiae* ribonucleotide reductase DNA damage-inducible regulatory subunit (DIN1) gene, 5' end. | *Saccharomyces cerevisiae* | 35,877 | Apr. 27, 1993 |
| | | GB_EST18:AA689161 | 624 | AA689161 | ET2100 *Trypanosoma brucei rhodesiense* ZAP II library *Trypanosoma brucei rhodesiense* cDNA 5', mRNA sequence. | *Trypanosoma brucei rhodesiense* | 37,150 | Dec. 15, 1997 |
| rxa01417 | 720 | GB_PL1:SC8419 | 30507 | Z49701 | *S. cerevisiae* chromosome IV cosmid 8419. | *Saccharomyces cerevisiae* | 36,248 | Aug. 11, 1997 |
| | | GB_PL1:SCPRP28G | 2452 | X56934 | *S. cerevisiae* PRP28 gene. | *Saccharomyces cerevisiae* | 45,036 | Feb. 9, 1995 |
| | | GB_BA1:BACPEPFA | 4654 | M29035 | *B. subtilis* bacillopeptidase F (bpr) gene, complete cds. | *Bacillus subtilis* | 37,324 | Mar. 6, 1995 |
| rxa01421 rxa01422 | 1095 | GB_EST24:AU033392 | 344 | AU033392 | AU033392 *Dictyostelium discoideum* SL (H. Urushihara) *Dictyostelium discoideum* cDNA clone SLA715, mRNA sequence. | *Dictyostelium discoideum* | 38,953 | Apr. 28, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_EST14:AA399243 | 301 | AA399243 | zt57d02.s1 Soares_testis_NHT Homo sapiens cDNA clone IMAGE:726435 3' similar to SW:NIDO_HUMAN P14543 NIDOGEN PRECURSOR; mRNA sequence. | Homo sapiens | 45,183 | Aug. 12, 1997 |
| rxa01425 | 1008 | GB_PR2:AC002037 | 53897 | AC002037 | Human Chromosome 11 Overlapping Cosmids cSRL72g7 and cSRL140b8, complete sequence. | Homo sapiens | 37,500 | Aug. 6, 1997 |
| | | GB_PR4:AC005908 | 196501 | AC005908 | Homo sapiens 12p13.3 BAC RPCI11-476M19 (Roswell Park Cancer Institute Human BAC Library) complete sequence. | Homo sapiens | 34,410 | Jan. 20, 1999 |
| | | GB_PR4:AF111169 | 183916 | AF111169 | Homo sapiens chromosome 14 BAC containing gene for KIAA0759 and other possible new transcripts, complete sequence. | Homo sapiens | 40,635 | Jul. 19, 1999 |
| | | GB_HTG2:AC008284 | 146797 | AC008284 | Drosophila melanogaster chromosome 3 clone BACR03M22 (D1000) RPCI-98 03.M.22 map 96C–96D strain y; cn bw sp, **SEQUENCING IN PROGRESS**, 137 unordered pieces. | Drosophila melanogaster | 35,822 | Aug. 2, 1999 |
| rxa01429 | 741 | GB_EST25:AI300084 | 635 | AI300084 | qn59t02.x1 NCL_CGAP_Kid5 Homo sapiens cDNA clone IMAGE:1902555 3', mRNA sequence. | Homo sapiens | 37,753 | Feb. 1, 1999 |
| | | GB_EST18:AA706612 | 949 | AA706612 | ah26c02.s1 Soares_parathyroid_tumor_NbHPA Homo sapiens cDNA clone 1239938 3', mRNA sequence. | Homo sapiens | 37,361 | Jan. 12, 1999 |
| | | GB_EST35:AI817084 | 598 | AI817084 | wj76g07.x1 NCL_CGAP_Lu19 Homo sapiens cDNA clone IMAGE:2408796 3', mRNA sequence. | Homo sapiens | 38,627 | Aug. 24, 1999 |
| rxa01434 | 3075 | GB_PL1:CAC49C10 | 37825 | AL033497 | C. albicans cosmid Ca49C10. | Candida albicans | 34,724 | Nov. 10, 1998 |
| | | GB_GSS3:B10423 | 1217 | B10423 | F19F22-T7 IGF Arabidopsis thaliana genomic clone F19F22, genomic survey sequence. | Arabidopsis thaliana | 36,003 | May 14, 1997 |
| | | GB_PL1:CAC49C10 | 37825 | AL033497 | C. albicans cosmid Ca49C10. | Candida albicans | 33,794 | Nov. 10, 1998 |
| rxa01439 | 669 | GB_BA2:AF049897 | 9196 | AF049897 | Corynebacterium glutamicum N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds | Corynebacterium glutamicum | 41,564 | Jul. 1, 1998 |
| | | GB_BA1:CGARGCJBD | 4355 | X86157 | C. glutamicum argC, argJ, argB, argD, and argF genes. | Corynebacterium glutamicum | 41,584 | Jul. 25, 1996 |
| | | GB_BA2:AF049897 | 9196 | AF049897 | Corynebacterium glutamicum N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | Corynebacterium glutamicum | 39,486 | Jul. 1, 1998 |
| rxa01440 | 1131 | GB_PAT:E16763 | 2517 | E16763 | gDNA encoding aspartate transferase (AAT). | Corynebacterium glutamicum | 42,188 | Jul. 28, 1999 |
| rxa01441 | 1152 | GB_EST20:AA870569 | 423 | AA870569 | vq23c09.r1 Barstead stromal cell line MPLRB8 Mus musculus cDNA clone IMAGE:1095088 5' similar to TR:Q14468 Q14468 KIAA0047; mRNA sequence. | Mus musculus | 42,066 | Mar. 16, 1998 |
| | | GB_EST18:AA726390 | 436 | AA726390 | vu40b04.r1 Barstead mouse myotubes MPLRB5 Mus musculus cDNA clone IMAGE:1193839 5', mRNA sequence. | Mus musculus | 41,228 | Jan. 2, 1998 |
| rxa01442 | 1152 | GB_EST32:AV053763 | 252 | AV053763 | AV053763 Mus musculus pancreas C57BL/6J adult Mus musculus cDNA clone 1810028E06, mRNA sequence. | Mus musculus | 45,238 | Jun. 23, 1999 |
| | | GB_EST20:AA870569 | 423 | AA870569 | vq23c09.r1 Barstead stromal cell line MPLRB8 Mus musculus cDNA clone IMAGE:1095088 5' similar to TR:Q14468 Q14468 KIAA0047; mRNA sequence. | Mus musculus | 39,643 | Mar. 16, 1998 |
| | | GB_EST18:AA726390 | 436 | AA726390 | vu40b04.r1 Barstead mouse myotubes MPLRB5 Mus musculus cDNA clone IMAGE:1193839 5', mRNA sequence. | Mus musculus | 39,953 | Jan. 2, 1998 |
| rxa01445 | 1116 | GB_PR4:AC007786 | 229061 | AC007786 | Homo sapiens chromosome 19, BAC 41855 (CIT-B-32o4), complete sequence. | Homo sapiens | 39,545 | Jun. 11, 1999 |
| | | GB_PR3:AC003957 | 126581 | AC003957 | Homo sapiens chromosome 17, clone hCIT.457_1_16, complete sequence. | Homo sapiens | 36,579 | May 9, 1998 |
| | | GB_OV:AF108420 | 46626 | AF108420 | Fugu rubripes prohormone convertase PACE4 (PACE4) gene, partial cds; and 1-aminocyclopropane-carboxilate synthase (ACC), recombination-activating protein 1 (RAG1), and recombination-activating protein 2 (RAG2) genes, complete cds. | Fugu rubripes | 39,187 | Mar. 17, 1999 |
| rxa01447 | 972 | GB_PL2:AF049112 | 1436 | AF049112 | Zea mays retrotransposon Cinful prpol mRNA, partial cds. | Zea mays | 38,268 | Feb. 1, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01448 | 1290 | GB_EST36:AV190070 | 360 | AV190070 | AV190070 Yuji Kohara unpublished cDNA:Strain N2 hermaphrodite embryo Caenorhabditis elegans cDNA clone yk566e10 5′, mRNA sequence. | Caenorhabditis elegans | 40,390 | Jul. 22, 1999 |
| | | GB_EST9:AA103228 | 477 | AA103228 | mo22h07.r1 Life Tech mouse embryo 13 5dpc 10666014 Mus musculus cDNA clone IMAGE:554365 5′ similar to gb:J00068 ACTIN, ALPHA SKELETAL MUSCLE (HUMAN); gb:M12866 Mouse skeletal muscle actin mRNA, complete cds (MOUSE); mRNA sequence. | Mus musculus | 40,411 | Oct. 29, 1996 |
| rxa01452 | 402 | GB_BA1:CGFDA | 3371 | X17313 | Corynebacterium glutamicum fda gene for fructose-bisphosphate aldolase (EC 4.1.2.13). | Corynebacterium glutamicum | 100,000 | Sep. 12, 1993 |
| | | GB_PL2:ENU75428 | 4443 | U75428 | Emericella nidulans acid trehalase precursor (treA) gene, complete cds. | Emericella nidulans | 36,271 | May 15, 1997 |
| | | GB_BA1:CGFDA | 3371 | X17313 | Corynebacterium glutamicum fda gene for fructose-bisphosphate aldolase (EC 4.1.2.13). | Corynebacterium glutamicum | 37,872 | Sep. 12, 1993 |
| | | GB_BA1:MTV017 | 67200 | AL021897 | Mycobacterium tuberculosis H37Rv complete genome; segment 48/162. | Mycobacterium tuberculosis | 57,246 | Jun. 24, 1999 |
| rxa01456 | 645 | GB_BA1:MLCB1222 | 34714 | AL049491 | Mycobacterium leprae cosmid B1222. | Mycobacterium leprae | 34,872 | Aug. 27, 1999 |
| | | GB_BA2:S71532 | 914 | S71532 | che = cholesterol esterase [Streptomyces lavendulae, H646-SY2, Genomic, 914 nt]. | Streptomyces lavendulae | 38,701 | Nov. 8, 1994 |
| | | GB_GSS3:BI6150 | 663 | BI6150 | 347A15.TP CIT978SKA1 Homo sapiens genomic clone A-347A15, genomic survey sequence. | Homo sapiens | 34,394 | Jun. 4, 1998 |
| | | GB_HTG3:AC004157 | 132090 | AC004157 | Plasmodium falciparum chromosome 12 clone 3D7, *SEQUENCING IN PROGRESS*, 9 unordered pieces. | Plasmodium falciparum | 34,165 | Sep. 23, 1999 |
| | | GB_HTG3:AC004157 | 132090 | AC004157 | Plasmodium falciparum chromosome 12 clone 3D7, *SEQUENCING IN PROGRESS*, 9 unordered pieces. | Plasmodium falciparum | 34,165 | Sep. 23, 1999 |
| rxa01457 | 798 | GB_HTG3:AC011009 | 158335 | AC011009 | Homo sapiens clone 2_1_22, LOW-PASS SEQUENCE SAMPLING. | Homo sapiens | 39,490 | Sep. 29, 1999 |
| | | GB_HTG3:AC011009 | 158335 | AC011009 | Homo sapiens clone 2_1_22, LOW-PASS SEQUENCE SAMPLING. | Homo sapiens | 39,490 | Sep. 29, 1999 |
| | | GB_HTG3:AC011009 | 158335 | AC011009 | Homo sapiens clone 2_1_22, LOW-PASS SEQUENCE SAMPLING. | Homo sapiens | 39,125 | Sep. 29, 1999 |
| rxa01459 | 933 | GB_HTG3:AC008670 | 113564 | AC008670 | Homo sapiens chromosome 5 clone CIT978SKB_36O1, *SEQUENCING IN PROGRESS*, 43 unordered pieces. | Homo sapiens | 39,022 | Aug. 3, 1999 |
| | | GB_HTG3:AC008670 | 113564 | AC008670 | Homo sapiens chromosome 5 clone CIT978SKB_36O1, *SEQUENCING IN PROGRESS*, 43 unordered pieces. | Homo sapiens | 39,022 | Aug. 3, 1999 |
| | | GB_IN2:CELT05A8 | 33896 | AF040652 | Caenorhabditis elegans cosmid T05A8. | Caenorhabditis elegans | 35,699 | Jun. 16, 1999 |
| rxa01460 | 417 | GB_HTG3:AC009186 | 48600 | AC009186 | Homo sapiens chromosome 5 clone CIT978SKB_148I14, *SEQUENCING IN PROGRESS*, 3 ordered pieces. | Homo sapiens | 41,278 | Oct. 7, 1999 |
| | | GB_HTG3:AC009186 | 48600 | AC009186 | Homo sapiens chromosome 5 clone CIT978SKB_148I14, *SEQUENCING IN PROGRESS*, 3 ordered pieces. | Homo sapiens | 41,278 | Oct. 7, 1999 |
| | | GB_HTG3:AC009186 | 48600 | AC009186 | Homo sapiens chromosome 5 clone CIT978SKB_148I14, *SEQUENCING IN PROGRESS*, 3 ordered pieces. | Homo sapiens | 35,162 | Oct. 7, 1999 |
| rxa01463 | 1287 | GB_PR3:HS326L13 | 127247 | Z82170 | Human DNA sequence from PAC 326L13 containing brain-4 mRNA ESTs and polymorphic CA repeat. | Homo sapiens | 37,956 | Nov. 23, 1999 |
| | | GB_HTG1:HS439A6 | 49379 | AL031723 | Homo sapiens chromosome 16 clone LA16-439A6, *SEQUENCING IN PROGRESS*, in unordered pieces. | Homo sapiens | 38,035 | Nov. 23, 1999 |
| | | GB_HTG1:HS439A6 | 49379 | AL031723 | Homo sapiens chromosome 16 clone LA16-439A6, *SEQUENCING IN PROGRESS*, in unordered pieces. | Homo sapiens | 38,035 | Nov. 23, 1999 |
| rxa01469 | 1155 | GB_EST31:AI701691 | 349 | AI701691 | we81c04.x1 Soares_NFL_T_GBC_S1 Homo sapiens cDNA clone IMAGE:2347494 3′ similar to gb:L19686_ma1 MACROPHAGE MIGRATION INHIBITORY FACTOR (HUMAN); mRNA sequence. | Homo sapiens | 39,806 | Jun. 3, 1999 |
| | | GB_EST15:AA480256 | 389 | AA480256 | ne31f04.s1 NCI_CGAP_Co3 Homo sapiens cDNA clone IMAGE:898975 3′ similar to gb:L19686_ma1 MACROPHAGE MIGRATION INHIBITORY FACTOR (HUMAN); mRNA sequence. | Homo sapiens | 42,705 | Aug. 14, 1997 |
| | | GB_IN2:AF153269 | 1308 | AF153269 | Tetrahymena thermophila dynein heavy chain (DYH10) gene, partial cds. | Tetrahymena thermophila | 32,489 | Jun. 10, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01470 | 549 | GB_PL2:ATF3L17 | 94319 | AL080283 | Arabidopsis thaliana DNA chromosome 4, BAC clone F3L17 (ESSA project). | Arabidopsis thaliana | 37,615 | Jun. 24, 1999 |
| | | GB_PL2:ATF3L17 | 94319 | AL080283 | Arabidopsis thaliana DNA chromosome 4, BAC clone F3L17 (ESSA project). | Arabidopsis thaliana | 35,946 | Jun. 24, 1999 |
| rxa01471 | 930 | GB_EST11:AA233898 | 460 | AA233898 | zr49b12.s1 Soares_NhHMPu_S1 Homo sapiens cDNA clone IMAGE:666719 3', mRNA sequence. | Homo sapiens | 40,570 | Aug. 6, 1997 |
| | | GB_EST11:AA234033 | 428 | AA234033 | zr49b12.r1 Soares_NhHMPu_S1 Homo sapiens cDNA clone IMAGE:666719 5' similar to contains Alu repetitive element; mRNA sequence. | Homo sapiens | 36,277 | Aug. 6, 1997 |
| rxa01472 | | GB_PL2:AF084971 | 1874 | AF084971 | Catharanthus roseus G-box binding protein 1 (GBF1) mRNA, complete cds. | Catharanthus roseus | 36,821 | Jul. 7, 1999 |
| rxa01473 | 888 | GB_PL2:AC002329 | 76170 | AC002329 | DNA sequence of Arabidopsis thaliana BAC F5I6 from chromosome IV, complete sequence. | Arabidopsis thaliana | 35,780 | Nov. 18, 1997 |
| | | GB_HTG3:AC009485 | 190706 | AC009485 | Homo sapiens clone NH0324G03, *SEQUENCING IN PROGRESS*, 6 unordered pieces. | Homo sapiens | 39,649 | Oct. 4, 1999 |
| | | GB_HTG3:AC009485 | 190706 | AC009485 | Homo sapiens clone NH0324G03, *SEQUENCING IN PROGRESS*, 6 unordered pieces. | Homo sapiens | 39,649 | Oct. 4, 1999 |
| rxa01474 | 669 | GB_PR2:HSP373C6 | 85654 | AL022393 | Homo sapiens DNA sequence from P1 p373c6 on chromosome 6p21.31-21.33. Contains zinc finger proteins, pseudogenes, ESTs and STS. | Homo sapiens | 33,934 | Nov. 22, 1999 |
| | | GB_EST4:H30893 | 485 | H30893 | yp43e11.r1 Soares retina N2b5HR Homo sapiens cDNA clone IMAGE:190220 5' similar to contains Alu repetitive element; mRNA sequence. | Homo sapiens | 37,866 | Aug. 16, 1995 |
| rxa01475 | 549 | GB_PL2:ATAC005398 | 80238 | AC005398 | Arabidopsis thaliana chromosome II BAC T6B13 genomic sequence, complete sequence. | Arabidopsis thaliana | 38,640 | Oct. 30, 1998 |
| | | GB_PL1:AB024028 | 70952 | AB024028 | Arabidopsis thaliana genomic DNA, chromosome 3, TAC clone: K1G2, complete sequence. | Arabidopsis thaliana | 40,520 | Nov. 20, 1999 |
| | | GB_HTG2:AC007940 | 159279 | AC007940 | Homo sapiens clone 44_C_14, *SEQUENCING IN PROGRESS*, 12 unordered pieces. | Homo sapiens | 36,044 | Jul. 1, 1999 |
| | | GB_HTG2:AC007940 | 159279 | AC007940 | Homo sapiens clone 44_C_14, *SEQUENCING IN PROGRESS*, 12 unordered pieces. | Homo sapiens | 36,044 | Jul. 1, 1999 |
| rxa01476 | 465 | GB_PL1:AB009087 | 1074 | AB009087 | Chlamydomonas sp. mRNA for alternative oxidase, partial cds. | Chlamydomonas sp. | 38,596 | Dec. 5, 1997 |
| | | GB_PL1:AB009087 | 1074 | AB009087 | Chlamydomonas sp. mRNA for alternative oxidase, partial cds. | Chlamydomonas sp. | 39,519 | Dec. 5, 1997 |
| rxa01479 | 363 | GB_HTG1:HSJ136J15 | 148579 | AL118496 | Homo sapiens chromosome X clone RP1-136J15, *SEQUENCING IN PROGRESS*, in unordered pieces. | Homo sapiens | 39,886 | Nov. 23, 1999 |
| | | GB_HTG1:HSJ136J15 | 148579 | AL118496 | Homo sapiens chromosome X clone RP1-136J15, *SEQUENCING IN PROGRESS*, in unordered pieces. | Homo sapiens | 39,886 | Nov. 23, 1999 |
| | | GB_HTG2:AC007579 | 134344 | AC007579 | Drosophila melanogaster chromosome 2 clone BACR07M03 (D607) RPCL-98 07.M.3 map 53A-53B strain y; cn bw sp; *SEQUENCING IN PROGRESS*, 108 unordered pieces. | Drosophila melanogaster | 39,266 | Aug. 2, 1999 |
| rxa01484 | 689 | GB_PR3:AF064858 | 193387 | AF064858 | Homo sapiens chromosome 21q22.3 BAC 28F9, complete sequence. | Homo sapiens | 38,281 | Jun. 2, 1998 |
| | | GB_GSS10:AQ207755 | 496 | AQ207755 | HS_3026_B1_G04_T7 CIT Approved Human Genomic Sperm Library D Homo sapiens genomic clone Plate = 3026 Col = 7 Row = N, genomic survey sequence | Homo sapiens | 37,150 | Sep. 18, 1998 |
| rxa01485 | 2175 | GB_PR3:AF064858 | 193387 | AF064858 | Homo sapiens chromosome 21q22.3 BAC 28F9, complete sequence. | Homo sapiens | 38,379 | Jun. 2, 1998 |
| | | GB_IN1:CEY50E8A | 61864 | AL117200 | Caenorhabditis elegans cosmid Y50E8A, complete sequence. | Caenorhabditis elegans | 39,617 | Nov. 19, 1999 |
| | | GB_IN1:CEY50E8A | 61864 | AL117200 | Caenorhabditis elegans cosmid Y50E8A, complete sequence. | Caenorhabditis elegans | 34,349 | Nov. 19, 1999 |
| | | GB_PL1:AB028606 | 61510 | AB028606 | Arabidopsis thaliana genomic DNA, chromosome 5, BAC clone:F16F17, complete sequence. | Arabidopsis thaliana | 34,858 | Nov. 20, 1999 |
| rxa01488 | 1071 | GB_BA1:CGPROMF10 | 60 | X90358 | C. glutamicum DNA for promoter fragment F10. | Corynebacterium glutamicum | 65,000 | Nov. 4, 1996 |
| | | GB_EST10:AA183656 | 465 | AA183656 | mt20t08.r1 Soares mouse 3NbMS Mus musculus cDNA clone IMAGE:621639 5' similar to WP:T02C12.2 CE01062; mRNA sequence. | Mus musculus | 35,333 | Feb. 17, 1997 |
| | | GB_EST9:AA110912 | 309 | AA110912 | mm02c01.r1 Stratagene mouse kidney (#937315) Mus musculus cDNA clone IMAGE:520320 5' similar to WP:T02C12.2 CE01062; mRNA sequence. | Mus musculus | 37,662 | Feb. 4, 1997 |
| rxa01492 | 927 | GB_EST16:AA589576 | 567 | AA589576 | vi49b06.s1 Stratagene mouse skin (#937313) Mus musculus cDNA clone IMAGE:975539 3' similar to gb:M63488 REPLICATION PROTEIN A 70 KD DNA-BINDING SUBUNIT (HUMAN); mRNA sequence. | Mus musculus | 34,104 | Sep. 16, 1997 |
| | | GB_EST28:AU051490 | 865 | AU051490 | AU051490 Sugano mouse brain mncb Mus musculus cDNA clone MNCb-2105 5', mRNA sequence. | Mus musculus | 29,837 | Mar. 18, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01494 | 1119 | GB_EST32:AI738234 | 609 | AI738234 | 606044C01.x2 606 - Ear tissue cDNA library from Schmidt tab *Zea mays* cDNA, mRNA sequence. | *Zea mays* | 38,291 | Jun. 16, 1999 |
| | | GB_PR4:AC007106 | 172188 | AC007106 | *Homo sapiens* chromosome 4 clone C0383J20 map 4p16, complete sequence. | *Homo sapiens* | 35,108 | Jun. 2, 1999 |
| | | GB_BA2:AE001093 | 14097 | AE001093 | *Archaeoglobus fulgidus* section 14 of 172 of the complete genome. | *Archaeoglobus fulgidus* | 38,113 | Dec. 15, 1997 |
| | | GB_PR4:AC007106 | 172188 | AC007106 | *Homo sapiens* chromosome 4 clone C0383J20 map 4p16, complete sequence. | *Homo sapiens* | 34,657 | Jun. 2, 1999 |
| rxa01497 | 1041 | GB_BA2:SC1 | 36925 | AL109962 | *Streptomyces coelicolor* cosmid J1. | *Streptomyces coelicolor* A3(2) | 50,722 | Sep. 24, 1999 |
| | | GB_BA1:MTY20B11 | 36330 | Z95121 | *Mycobacterium tuberculosis* H37Rv complete genome; segment 139/162. | *Mycobacterium tuberculosis* | 40,238 | Jun. 17, 1998 |
| | | GB_BA1:PAU12891 | 4062 | U12891 | *Pseudomonas aeruginosa* PAO substrain OT684 pyoverdine gene transcriptional regulator PvdS (pvdS) gene, complete cds. | *Pseudomonas aeruginosa* | 39,856 | Oct. 3, 1996 |
| rxa01501 | 411 | GB_PAT:I78757 | 2203 | I78757 | Sequence 13 from U.S. Pat. No. 5693781. | Unknown. | 61,364 | Apr. 3, 1998 |
| | | GB_PAT:I92046 | 2203 | I92046 | Sequence 13 from U.S. Pat. No. 5726299. | Unknown. | 61,364 | Dec. 1, 1998 |
| | | GB_PR4:AC002427 | 101098 | AC002427 | *Homo sapiens* BAC clone GS011E15 from 5q31, complete sequence. | *Homo sapiens* | 42,250 | Dec. 2, 1998 |
| rxa01504 | 732 | GB_HTG3:AC008954 | 23046 | AC008954 | *Homo sapiens* chromosome 5 clone CITB-H1_2340N2, **SEQUENCING IN PROGRESS**, 51 unordered pieces. | *Homo sapiens* | 37,830 | Aug. 3, 1999 |
| | | GB_HTG3:AC008954 | 23046 | AC008954 | *Homo sapiens* chromosome 5 clone CITB-H1_2340N2, **SEQUENCING IN PROGRESS**, 51 unordered pieces. | *Homo sapiens* | 37,830 | Aug. 3, 1999 |
| rxa01505 | 621 | GB_BA1:QPHQSOP | 4068 | L28041 | Plasmid QpH1 (from *Coxiella burnetii*) qsopA and qsopB genes, promoter region. | Plasmid QpH1 | 37,517 | Jul. 14, 1995 |
| | | GB_SY:SYNM13GAL | 66 | M10216 | Bacteriophage M13gt102 N-terminal beta-galactosidase gene (lac+ phenotype). | unidentified cloning vector | 62,121 | Apr. 27, 1993 |
| | | GB_SY:SYNM13GAL | 66 | M10216 | Bacteriophage M13gt102 N-terminal beta-galactosidase gene (lac+ phenotype). | unidentified cloning vector | 62,121 | Apr. 27, 1993 |
| | | GB_BA2:BJU56817 | 2892 | U56817 | *Bradyrhizobium japonicum* aconitase (acnA) gene, complete cds. | *Bradyrhizobium japonicum* | 40,214 | Nov. 13, 1996 |
| rxa01506 | 534 | GB_BA1:MTCY98 | 31225 | Z83860 | *Mycobacterium tuberculosis* H37Rv complete genome; segment 103/162. | *Mycobacterium tuberculosis* | 38,274 | Jun. 17, 1998 |
| | | GB_BA1:MTCY98 | 31225 | Z83860 | *Mycobacterium tuberculosis* H37Rv complete genome; segment 103/162. | *Mycobacterium tuberculosis* | 33,710 | Jun. 17, 1998 |
| rxa01507 | 546 | GB_RO:D89731 | 1815 | D89731 | *Rattus norvegicus* mRNA for AIM-1, complete cds. | *Rattus norvegicus* | 38,125 | Feb. 7, 1999 |
| | | GB_RO:D89731 | 1815 | D89731 | *Rattus norvegicus* mRNA for AIM-1, complete cds. | *Rattus norvegicus* | 34,600 | Feb. 7, 1999 |
| rxa01518 | | | | | | | | |
| rxa01519 | 870 | GB_HTG2:AC007929 | 123885 | AC007929 | *Drosophila melanogaster* chromosome 3 clone BACR05C11 (D759) RPCI-98 05.C.11 map 95A–95C strain y; cn bw sp, **SEQUENCING IN PROGRESS**, 85 unordered pieces. | *Drosophila melanogaster* | 34,075 | Aug. 2, 1999 |
| | | GB_HTG2:AC007929 | 123885 | AC007929 | *Drosophila melanogaster* chromosome 3 clone BACR05C11 (D759) RPCI-98 05.C.11 map 95A–95C strain y; cn bw sp, **SEQUENCING IN PROGRESS**, 85 unordered pieces. | *Drosophila melanogaster* | 34,075 | Aug. 2, 1999 |
| rxa01520 | | GB_PL2:AC011437 | 95310 | AC011437 | *Arabidopsis thaliana* chromosome III BAC F7O18 genomic sequence, complete sequence. | *Arabidopsis thaliana* | 37,280 | Nov. 2, 1999 |
| rxa01523 | 1074 | GB_GSS11:AQ270206 | 389 | AQ270206 | HS_2037_A1_G10_T7 CIT Approved Human Genomic Sperm Library D *Homo sapiens* genomic clone Plate = 2037 Col = 19 Row = M, genomic survey sequence. | *Homo sapiens* | 38,046 | Nov. 3, 1998 |
| | | GB_GSS14:AQ588624 | 480 | AQ588624 | CITBI-E1-2643C9.TF CITBI-E1 *Homo sapiens* genomic clone 2643C9, genomic survey sequence. | *Homo sapiens* | 36,875 | Jun. 7, 1999 |
| | | GB_HTG1:CEY80D3 | 245017 | AL020988 | *Caenorhabditis elegans* chromosome V clone Y80D3, **SEQUENCING IN PROGRESS**, in unordered pieces. | *Caenorhabditis elegans* | 35,846 | Sep. 6, 1999 |
| rxa01525 | 1645 | GB_PR3:HS560B9 | 99074 | Z98751 | Human DNA sequence from PAC 560B9 on chromosome 1q24-1q25. Contains profilin-like pseudogene, 60S ribosomal protein L4 pseudogene RNA binding protein, ESTs, GSS. | *Homo sapiens* | 37,981 | Nov. 23, 1999 |
| | | GB_PR3:HS560B9 | 99074 | Z98751 | Human DNA sequence from PAC 560B9 on chromosome 1q24-1q25. Contains profilin-like pseudogene, 60S ribosomal protein L4 pseudogene RNA binding protein, ESTs, GSS. | *Homo sapiens* | 37,982 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01527 | | | | | | | | |
| rxa01536 | 1365 | GB_HTG3:AC010745 | 193862 | AC010745 | Homo sapiens clone NH0549D18, **SEQUENCING IN PROGRESS**, 30 unordered pieces. | Homo sapiens | 35,277 | Sep. 21, 1999 |
| | | GB_HTG3:AC010745 | 193862 | AC010745 | Homo sapiens clone NH0549D18, **SEQUENCING IN PROGRESS**, 30 unordered pieces. | Homo sapiens | 35,277 | Sep. 21, 1999 |
| | | GB_HTG3:AC010745 | 193862 | AC010745 | Homo sapiens clone NH0549D18, **SEQUENCING IN PROGRESS**, 30 unordered pieces. | Homo sapiens | 35,958 | Sep. 21, 1999 |
| rxa01539 | 2289 | GB_BA1:CGPROMF10 | 60 | X90358 | C. glutamicum DNA for promoter fragment F10. | Corynebacterium glutamicum | 61,667 | Nov. 4, 1996 |
| | | GB_HTG3:AC011577 | 151996 | AC011577 | Homo sapiens clone 12_P_19, LOW-PASS SEQUENCE SAMPLING. | Homo sapiens | 35,554 | Oct. 7, 1999 |
| | | GB_HTG3:AC011577 | 151996 | AC011577 | Homo sapiens clone 12_P_19, LOW-PASS SEQUENCE SAMPLING. | Homo sapiens | 35,554 | Oct. 7, 1999 |
| rxa01540 | 825 | GB_EST10:AA152819 | 491 | AA152819 | mq67e04.r1 Soares 2NbMT Mus musculus cDNA clone IMAGE:583806 5', mRNA sequence. | Mus musculus | 39,040 | Feb. 18, 1997 |
| | | GB_EST29:AI616027 | 481 | AI616027 | mq67e04.y1 Soares 2NbMT Mus musculus cDNA clone IMAGE:583806 5', mRNA sequence. | Mus musculus | 36,688 | Apr. 21, 1999 |
| | | GB_GSS6:AQ843942 | 468 | AQ843942 | LMAJFV1_lm03d08.x2 Leishmania major FV1 random genomic library Leishmania major genomic clone LMAJFV1_lm03d08 3', genomic survey sequence. | Leishmania major | 40,899 | Oct. 4, 1999 |
| rxa01543 | 2889 | GB_BA2:ECOUW67_0 | 110000 | U18997 | Escherichia coli K-12 chromosomal region from 67.4 to 76.0 minutes. | Escherichia coli | 36,618 | Sep. 15, 1999 |
| | | GB_BA2:ECOUW67_0 | 110000 | U18997 | Escherichia coli K-12 chromosomal region from 67.4 to 76.0 minutes. | Escherichia coli | 38,415 | Sep. 15, 1999 |
| | | GB_BA2:AE000397 | 14820 | AE000397 | Escherichia coli K-12 MG1655 section 287 of 400 of the complete genome | Escherichia coli | 37,594 | Nov. 12, 1998 |
| rxa01544 | 723 | GB_EST37:AI977486 | 479 | AI977486 | EST272080 Schistosoma mansoni male, Phil LoVerde/Joe Merrick Schistosoma mansoni cDNA clone SMMAM80 5' end, mRNA sequence. | Schistosoma mansoni | 44,156 | Aug. 27, 1999 |
| | | GB_VI:AF056119 | 564 | AF056119 | HIV-1 isolate z560 from Zimbabwe, envelope glycoprotein V3-V5 region (env) gene, partial cds. | Human immunodeficiency virus type 1 | 35,874 | Sep. 26, 1998 |
| | | GB_VI:AF056119 | 564 | AF056119 | HIV-1 isolate z560 from Zimbabwe, envelope glycoprotein V3-V5 region (env) gene, partial cds. | Human immunodeficiency virus type 1 | 37,229 | Sep. 26, 1998 |
| rxa01545 | 1374 | GB_HTG1:CEY53C10_1 | 110000 | Z93340 | Caenorhabditis elegans chromosome I clone Y53C10, **SEQUENCING IN PROGRESS**, in unordered pieces. | Caenorhabditis elegans | 36,885 | Nov. 4, 1998 |
| | | GB_HTG1:CEY53C10_1 | 110000 | Z93340 | Caenorhabditis elegans chromosome I clone Y53C10, **SEQUENCING IN PROGRESS**, in unordered pieces. | Caenorhabditis elegans | 36,885 | Nov. 4, 1998 |
| | | GB_HTG1:CEY47H9_1 | 110000 | Z92853 | Caenorhabditis elegans chromosome I clone Y47H9, **SEQUENCING IN PROGRESS**, in unordered pieces. | Caenorhabditis elegans | 30,285 | Sep. 4, 1998 |
| rxa01546 | 819 | GB_GSS3:B58207 | 420 | B58207 | CIT-HSP-2012C11.TR CIT-HSP Homo sapiens genomic clone 2012C11, genomic survey sequence. | Homo sapiens | 45,228 | Jun. 20, 1998 |
| | | GB_IN1:HAU02678 | 623 | U02678 | Helicoverpa armigera mitochondrion D-loop, partial 12S rRNA gene, and partial tRNA-Met gene. | Mitochondrion Helicoverpa armigera | 37,500 | Oct. 27, 1993 |
| | | GB_EST19:AA769027 | 473 | AA769027 | oa78g01.s1 NCI_CGAP_GCB1 Homo sapiens cDNA clone IMAGE:1318416 3' similar to TR:Q92617 Q92617 MYELOBLAST KIAA0220; mRNA sequence. | Homo sapiens | 39,583 | Jan. 28, 1998 |
| rxa01547 | 786 | GB_EST26:AU002373 | 837 | AU002373 | AU002373 Bombyx mori p50 (Daizo) Bombyx mori cDNA clone mg0832, mRNA sequence. | Bombyx mori | 37,698 | Jan. 15, 1999 |
| | | GB_EST30:AV025617 | 494 | AV025617 | AV025617 Mus musculus adult C57BL/6J lung Mus musculus cDNA clone 1200014J18, mRNA sequence. | Mus musculus | 38,316 | Aug. 31, 1999 |
| rxa01548 | 1131 | GB_EST26:AU002373 | 837 | AU002373 | AU002373 Bombyx mori p50 (Daizo) Bombyx mori cDNA clone mg0832, mRNA sequence. | Bombyx mori | 36,767 | Jan. 15, 1999 |
| | | GB_IN1:PFARBPCA | 8841 | M88097 | Plasmodium vivax retyculocyte binding protein 1 gene, complete cds. | Plasmodium vivax | 37,077 | Apr. 26, 1993 |
| | | GB_PAT:I55034 | 1985 | I55034 | Sequence 2 from U.S. Pat. No. 5646247. | Unknown. | 38,250 | Oct. 7, 1997 |
| | | GB_OV:GGNEUROMP | 1112 | Y09597 | G. gallus mRNA for NeuroM protein. | Gallus gallus | 37,104 | Oct. 15, 1997 |
| rxa01549 | 1727 | GB_PR4:HSLONPG01 | 2443 | AF059296 | Homo sapiens LON protease (LON) gene, nuclear gene encoding mitochondrial protein, exon 1. | Homo sapiens | 39,401 | Apr. 11, 1999 |
| | | GB_EST33:AI770254 | 555 | AI770254 | SAL2.F12 Black Tiger Shrimp Whole Cephalothorax UniZap library Penaeus monodon cDNA clone SAL2.F12 5' similar to muscle myosin heavy chain, mRNA sequence. | Penaeus monodon | 40,325 | Jun. 28, 1999 |
| | | GB_PR1:HSU02389 | 3179 | U02389 | Human hLON ATP-dependent protease mRNA, nuclear gene encoding mitochondrial protein, | Homo sapiens | 38,868 | Jan. 27, 1995 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01552 | 1101 | GB_HTG4:AC011192 | 144277 | AC011192 | complete cds. Homo sapiens clone hRPK.53_A_1, **SEQUENCING IN PROGRESS**, 9 unordered pieces. | Homo sapiens | 36,296 | Oct. 19, 1999 |
| | | GB_HTG4:AC011192 | 144277 | AC011192 | Homo sapiens clone hRPK.53_A_1, **SEQUENCING IN PROGRESS**, 9 unordered pieces. | Homo sapiens | 36,296 | Oct. 19, 1999 |
| | | GB_HTG3:AC011203 | 70518 | AC011203 | Homo sapiens chromosome 3 clone 78_O_24 map 3, LOW-PASS SEQUENCE SAMPLING. | Homo sapiens | 36,440 | Oct. 3, 1999 |
| rxa01554 | 2265 | GB_EST27:AA957437 | 340 | AA957437 | UI-R-E1-fy-g-02-0-UI.s1 UI-R-E1 Rattus norvegicus cDNA clone UI-R-E1-fy-g-02-0-UI 3', mRNA sequence. | Rattus norvegicus | 39,039 | Jul. 4, 1999 |
| | | GB_PL2:SPBC19G7 | 37727 | AL021839 | S. pombe chromosome II cosmid c19G7. | Schizosaccharomyces pombe | 36,991 | Nov. 17, 1999 |
| rxa01557 | 939 | GB_PL1:HVPROTZ | 703 | X05902 | Barley mRNA fragment for protein Z. | Hordeum vulgare | 36,390 | Jul. 13, 1995 |
| | | GB_EST24:AI167051 | 429 | AI167051 | xylem.est.822 Poplar xylem Lambda ZAPII library Populus balsamifera subsp. trichocarpa cDNA 5', mRNA sequence. | Populus balsamifera subsp. trichocarpa | 40,326 | Dec. 3, 1998 |
| rxa01560 | | GB_PL2:AC007259 | 97146 | AC007259 | Arabidopsis thaliana chromosome I BAC T28P6 genomic sequence, complete sequence. | Arabidopsis thaliana | 34,442 | Aug. 17, 1999 |
| | | GB_PL2:AC007259 | 97146 | AC007259 | Arabidopsis thaliana chromosome I BAC T28P6 genomic sequence, complete sequence. | Arabidopsis thaliana | 34,967 | Aug. 17, 1999 |
| rxa01574 | 1158 | GB_PR3:AC005242 | 160262 | AC005242 | Homo sapiens chromosome 17, clone hRPK.118_F_13, complete sequence. | Homo sapiens | 35,727 | Jul. 22, 1998 |
| | | GB_PR3:AC005242 | 160262 | AC005242 | Homo sapiens chromosome 17, clone hRPK.118_F_13, complete sequence. | Homo sapiens | 33,969 | Jul. 22, 1998 |
| | | GB_HTG2:AC007604 | 167373 | AC007604 | Homo sapiens chromosome 16 clone 344L6, **SEQUENCING IN PROGRESS**, 85 unordered pieces. | Homo sapiens | 36,028 | May 20, 1999 |
| rxa01575 | 1143 | GB_PR4:AC004738 | 147404 | AC004738 | Homo sapiens Chromosome 15q11-q13 PAC clone pDJ351h23 from the Prader-Will/Angelman Syndrome region, complete sequence. | Homo sapiens | 37,312 | Nov. 25, 1998 |
| | | GB_PR3:AC005250 | 94336 | AC005250 | Homo sapiens BAC clone RG318M05 from 7q22-q31.1, complete sequence. | Homo sapiens | 38,201 | Jul. 3, 1998 |
| | | GB_GSS11:AQ300376 | 487 | AQ300376 | HS_2206_A2_D05_MR CIT Approved Human Genomic Sperm Library D Homo sapiens genomic clone Plate = 2206 Col = 10 Row = G, genomic survey sequence. | Homo sapiens | 35,345 | Dec. 16, 1998 |
| rxa01577 | 498 | GB_BA1:MTY15C10 | 33050 | Z95436 | Mycobacterium tuberculosis H37Rv complete genome; segment 154/162. | Mycobacterium tuberculosis | 58,385 | Jun. 17, 1998 |
| | | GB_BA2:AF030975 | 2511 | AF030975 | Aeromonas salmonicida chaperonin GroES and chaperonin GroEL genes, complete cds. | Aeromonas salmonicida | 41,322 | Apr. 2, 1998 |
| | | GB_EST7:W33355 | 488 | W33355 | mb97g01.r1 Soares mouse p3NMF 19.5 Mus musculus cDNA clone IMAGE:337392 5' similar to gb:X58196_cds1 M. musculus H19 mRNA (MOUSE); mRNA sequence. | Mus musculus | 40,230 | Sep. 11, 1996 |
| rxa01579 | 507 | GB_GSS1:GGA300114 | 662 | AJ231964 | Gallus gallus anonymous sequence from Cosmid mapping to chicken chromosome 3 (Cosmid 30-Contig 14), genomic survey sequence. | Gallus gallus | 38,023 | Aug. 25, 1998 |
| | | GB_GSS1:GGA300114 | 662 | AJ231964 | Gallus gallus anonymous sequence from Cosmid mapping to chicken chromosome 3 (Cosmid 30-Contig 14), genomic survey sequence. | Gallus gallus | 38,608 | Aug. 25, 1998 |
| rxa01585 | 750 | GB_PR4:AC004815 | 120538 | AC004815 | Homo sapiens clone 82F9, complete sequence. | Homo sapiens | 35,383 | Sep. 8, 1999 |
| | | GB_PR2:AP000151 | 100000 | AP000151 | Homo sapiens genomic DNA, chromosome 21q22.2, DSCR region, clone D47-S479, segment 3/16, complete sequence. | Homo sapiens | 39,722 | Nov. 20, 1999 |
| | | GB_PR2:AP000151 | 100000 | AP000151 | Homo sapiens genomic DNA, chromosome 21q22.2, DSCR region, clone D47-S479, segment 3/16, complete sequence. | Homo sapiens | 34,683 | Nov. 20, 1999 |
| rxa01586 | 392 | GB_GSS5:AQ791385 | 522 | AQ791385 | HS_5268_A2_C05_T7A RPCI-11 Human Male BAC Library Homo sapiens genomic clone Plate = 844 Col = 10 Row = E, genomic survey sequence. | Homo sapiens | 43,235 | Aug. 3, 1999 |
| | | GB_EST15:AA463774 | 255 | AA463774 | aa09f10.r1 Soares_NhHMPu_S1 Homo sapiens cDNA clone IMAGE:812779 5' similar to gb:X07868_mal PUTATIVE INSULIN-LIKE GROWTH FACTOR II ASSOCIATED (HUMAN); contains element PTR7 repetitive element; mRNA sequence. | Homo sapiens | 42,045 | Jun. 10, 1997 |
| rxa01590 | | GB_PR1:AP000010 | 100000 | AP000010 | Homo sapiens genomic DNA of 21q22.2 Down Syndrome region, segment 3/13. | Homo sapiens | 38,684 | Apr. 24, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01592 | 1425 | GB_HTG2:AC008163 | 135300 | AC008163 | *Homo sapiens* clone NH0005B09, **SEQUENCING IN PROGRESS**, 1 unordered pieces. | *Homo sapiens* | 34,141 | Jul. 31, 1999 |
| | | GB_HTG2:AC008163 | 135300 | AC008163 | *Homo sapiens* clone NH0005B09, **SEQUENCING IN PROGRESS**, 1 unordered pieces. | *Homo sapiens* | 34,141 | Jul. 31, 1999 |
| | | GB_HTG3:AC009231 | 181006 | AC009231 | *Homo sapiens* clone NH0350I24, **SEQUENCING IN PROGRESS**, 2 unordered pieces. | *Homo sapiens* | 36,767 | Aug. 6, 1999 |
| rxa01595 | 1083 | GB_BA1:MTCI125 | 37432 | Z98268 | *Mycobacterium tuberculosis* H37Rv complete genome; segment 76/162. | *Mycobacterium tuberculosis* | 57,955 | Jun. 17, 1998 |
| | | GB_BA1:MTHYPROT | 2544 | X98295 | *M. tuberculosis* TlyA gene. | *Mycobacterium tuberculosis* | 57,955 | Jun. 2, 1998 |
| | | GB_BA1:U00021 | 39193 | U00021 | *Mycobacterium leprae* cosmid L247. | *Mycobacterium leprae* | 35,261 | Sep. 29, 1994 |
| rxa01597 | 1305 | GB_HTG3:AC009462 | 103046 | AC009462 | *Drosophila melanogaster* chromosome 3 clone BACR27G04 (D985) RPCI-98 27.G.4 map 90E—90E strain y; cn bw sp, *SEQUENCING IN PROGRESS*, 88 unordered pieces. | *Drosophila melanogaster* | 38,898 | Aug. 30, 1999 |
| | | GB_HTG3:AC009462 | 103046 | AC009462 | *Drosophila melanogaster* chromosome 3 clone BACR27G04 (D985) RPCI-98 27.G.4 map 90E—90E strain y; cn bw sp, **SEQUENCING IN PROGRESS**, 88 unordered pieces. | *Drosophila melanogaster* | 38,898 | Aug. 30, 1999 |
| | | GB_HTG2:AC006889 | 267118 | AC006889 | *Caenorhabditis elegans* clone Y65B4, **SEQUENCING IN PROGRESS**, 6 unordered pieces. | *Caenorhabditis elegans* | 36,236 | Feb. 26, 1999 |
| rxa01598 | 1086 | GB_EST2:R02663 | 397 | R02663 | ye80a04.r1 Soares fetal liver spleen 1NFLS *Homo sapiens* cDNA clone IMAGE:124014 5′, mRNA sequence. | *Homo sapiens* | 36,272 | Mar. 31, 1995 |
| | | GB_EST6:W03663 | 346 | W03663 | za65b08.r1 Soares fetal liver spleen 1NFLS *Homo sapiens* cDNA clone IMAGE:297399 5′, mRNA sequence. | *Homo sapiens* | 42,775 | Apr. 19, 1996 |
| | | GB_IN2:AC007765 | 163403 | AC007765 | *Drosophila melanogaster*, chromosome 2L, region 23C1-23C5, P1 clones DS02190 and DS00906, complete sequence. | *Drosophila melanogaster* | 38,351 | Jun. 9, 1999 |
| rxa01600 | 792 | GB_STS:G39530 | 822 | G39530 | Z22942 Zebrafish AB *Danio rerio* STS genomic, sequence tagged site. | *Danio rerio* | 41,242 | Jul. 31, 1998 |
| | | GB_STS:G39530 | 822 | G39530 | Z22942 Zebrafish AB *Danio rerio* STS genomic, sequence tagged site. | *Danio rerio* | 41,242 | Jul. 31, 1998 |
| | | GB_PR3:HSDI991C6 | 128995 | AL078599 | Human DNA sequence from clone 991C6 on chromosome 6q14.1-15, complete sequence. | *Homo sapiens* | 35,188 | Nov. 23, 1999 |
| rxa01602 | 1653 | GB_EST38:AW033000 | 685 | AW033000 | EST276559 tomato callus, TAMU *Lycopersicon esculentum* cDNA clone cLEC19N6, mRNA sequence. | *Lycopersicon esculentum* | 44,706 | Sep. 15, 1999 |
| | | GB_PL2:SPAC3C7 | 35052 | Z99568 | *S. pombe* chromosome I cosmid c3C7. | *Schizosaccharomyces pombe* | 38,158 | Nov. 29, 1999 |
| | | GB_PL2:SPAC3C7 | 35052 | Z99568 | *S. pombe* chromosome I cosmid c3C7. | *Schizosaccharomyces pombe* | 37,888 | Nov. 29, 1999 |
| rxa01605 | 1638 | GB_HTG3:AC008689 | 145122 | AC008689 | *Homo sapiens* chromosome 5 clone CIT978SKB_61G23, **SEQUENCING IN PROGRESS**, 44 unordered pieces. | *Homo sapiens* | 35,448 | Aug. 3, 1999 |
| | | GB_HTG3:AC008689 | 145122 | AC008689 | *Homo sapiens* chromosome 5 clone CIT978SKB_61G23, **SEQUENCING IN PROGRESS**, 44 unordered pieces. | *Homo sapiens* | 35,448 | Aug. 3, 1999 |
| | | GB_HTG3:AC009175 | 233932 | AC009175 | *Homo sapiens* chromosome 5 clone RPCI-PAC_241C15, **SEQUENCING IN PROGRESS**, 94 unordered pieces. | *Homo sapiens* | 37,423 | Aug. 3, 1999 |
| rxa01610 | 852 | GB_BA1:ECU82664 | 139818 | U82664 | *Escherichia coli* minutes 9 to 11 genomic sequence. | *Escherichia coli* | 34,198 | Jan. 11, 1997 |
| | | GB_BA1:ECU82664 | 139818 | U82664 | *Escherichia coli* minutes 9 to 11 genomic sequence. | *Escherichia coli* | 36,949 | Jan. 11, 1997 |
| | | GB_BA1:D90845 | 19366 | D90845 | *E. coli* genomic DNA, Kohara clone #356 (46.1-46.5 min.). | *Escherichia coli* | 39,808 | Mar. 21, 1997 |
| rxa01611 | 480 | GB_PR3:AC005581 | 39601 | AC005581 | *Homo sapiens* chromosome 19, cosmid R31237, complete sequence. | *Homo sapiens* | 38,901 | Sep. 1, 1998 |
| | | GB_EST35:AI809560 | 443 | AI809560 | wf30h09.x1 Soares_NFL_T_GBC_S1 *Homo sapiens* cDNA clone IMAGE:2357153 3′, mRNA sequence. | *Homo sapiens* | 35,989 | Jul. 7, 1999 |
| | | GB_EST25:AI279953 | 416 | AI279953 | qh90b02.x1 Soares_NFL_T_GBC_S1 *Homo sapiens* cDNA clone IMAGE:1854219 3′, mRNA sequence. | *Homo sapiens* | 35,276 | Jan. 27, 1999 |
| rxa01612 | | | | | | | | |
| rxa01618 | 507 | GB_GSS14:AQ506815 | 616 | AQ506815 | RPCI-11-316B19.TV RPCI-11 *Homo sapiens* genomic clone RPCI-11-316B19, genomic survey sequence. | *Homo sapiens* | 41,901 | Apr. 29, 1999 |

TABLE 4-continued

ALIGNMENT RESULTS

| ID # | length (NT) | Genbank Hit | Accession | Length | Name of Genbank Hit | Source of Genbank Hit | % homology (GAP) | Date of Deposit |
|---|---|---|---|---|---|---|---|---|
| rxa01619 | 1098 | GB_HTG2:AC007512 | AC007512 | 168140 | *Homo sapiens* clone hRPK.96_A_1, *SEQUENCING IN PROGRESS*, 14 unordered pieces. | *Homo sapiens* | 39,549 | May 7, 1999 |
| | | GB_HTG2:AC007512 | AC007512 | 168140 | *Homo sapiens* clone hRPK.96_A_1, *SEQUENCING IN PROGRESS*, 14 unordered pieces. | *Homo sapiens* | 39,549 | May 7, 1999 |
| | | GB_BA1:ECOUW93 | U14003 | 338534 | *Escherichia coli* K-12 chromosomal region from 92.8 to 00.1 minutes. | *Escherichia coli* | 39,459 | Apr. 17, 1996 |
| | | GB_BA2:AE000497 | AE000497 | 10334 | *Escherichia coli* K-12 MG1655 section 387 of 400 of the complete genome. | *Escherichia coli* | 39,459 | Nov. 12, 1998 |
| | | GB_BA1:ECOLEUX | M96355 | 2147 | *Escherichia coli* leucine tRNA gene and ORF1 gene, complete cds. | *Escherichia coli* | 41,434 | Jul. 26, 1995 |
| rxa01622 | 726 | GB_PR4:AC007664 | AC007664 | 162470 | *Homo sapiens*, complete sequence. | *Homo sapiens* | 37,006 | Sep. 18, 1999 |
| | | GB_PR4:AC002472 | AC002472 | 147100 | *Homo sapiens* Chromosome 22q11.2 PAC Clone p_n5 in BCRL2-GGT Region, complete sequence. | *Homo sapiens* | 33,058 | Sep. 13, 1999 |
| rxa01623 | 834 | GB_BA1:SYCSLRG | D64005 | 135638 | *Synechocystis* sp. PCC6803 complete genome, 24/27, 3002966-3138603. | *Synechocystis* sp. | 38,755 | Feb. 13, 1999 |
| | | GB_HTG4:AC007422 | AC007422 | 156484 | *Homo sapiens* clone hRPK.68_A_1, *SEQUENCING IN PROGRESS*, 3 unordered pieces. | *Homo sapiens* | 36,759 | Oct. 23, 1999 |
| | | GB_HTG4:AC007422 | AC007422 | 156484 | *Homo sapiens* clone hRPK.68_A_1, *SEQUENCING IN PROGRESS*, 3 unordered pieces. | *Homo sapiens* | 38,759 | Oct. 23, 1999 |
| | | GB_HTG4:AC007422 | AC007422 | 156484 | *Homo sapiens* clone hRPK.68_A_1, *SEQUENCING IN PROGRESS*, 3 unordered pieces. | *Homo sapiens* | 33,495 | Oct. 23, 1999 |
| rxa01624 | 468 | GB_BA2:AE001816 | AE001816 | 10007 | *Thermotoga maritima* section 128 of 136 of the complete genome. | *Thermotoga maritima* | 38,852 | Jun. 2, 1999 |
| | | GB_RO:CCPH20 | X56332 | 2152 | *Cavia cobaya* mRNA for PH-20 protein. | *Cavia porcellus* | 38,293 | Feb. 20, 1991 |
| | | GB_PAT:I89388 | I89388 | 2152 | Sequence 1 from U.S. Pat. No. 5721348. | Unknown. | 38,293 | Aug. 10, 1998 |
| rxa01628 | 1137 | GB_BA1:CGPROPGEN | Y12537 | 2936 | *C. glutamicum* proP gene. | *Corynebacterium glutamicum* | 37,882 | Nov. 17, 1998 |
| | | GB_IN1:CET06E6 | Z81117 | 33238 | *Caenorhabditis elegans* cosmid T06E6, complete sequence. | *Caenorhabditis elegans* | 38,330 | Sep. 8, 1999 |
| | | GB_HTG2:AC006916 | AC006916 | 157093 | *Caenorhabditis elegans* clone Y9C9, *SEQUENCING IN PROGRESS*, 3 unordered pieces. | *Caenorhabditis elegans* | 36,519 | Feb. 24, 1999 |
| rxa01630 | 1200 | GB_PR3:AC004945 | AC004945 | 167372 | *Homo sapiens* PAC clone DJ0997N05 from 7q11.23-q21.1, complete sequence. | *Homo sapiens* | 34,996 | Sep. 26, 1998 |
| | | GB_PR4:AC006385 | AC006385 | 173508 | *Homo sapiens* clone NH0559J05, complete sequence. | *Homo sapiens* | 32,525 | May 5, 1999 |
| | | GB_PR3:AC004945 | AC004945 | 167372 | *Homo sapiens* PAC clone DJ0997N05 from 7q11.23-q21.1, complete sequence. | *Homo sapiens* | 37,972 | Sep. 26, 1998 |
| rxa01634 | 675 | GB_PR4:AC005901 | AC005901 | 156763 | *Homo sapiens* chromosome 17, clone hRPK.15_K_2, complete sequence. | *Homo sapiens* | 35,736 | Jan. 20, 1999 |
| | | GB_PR4:AC005901 | AC005901 | 156763 | *Homo sapiens* chromosome 17, clone hRPK.15_K_2, complete sequence. | *Homo sapiens* | 35,549 | Jan. 20, 1999 |
| rxa01635 | 864 | GB_HTG3:AC008590 | AC008590 | 268470 | *Homo sapiens* chromosome 5 clone CIT-HSPC_575D19, *SEQUENCING IN PROGRESS*, 235 unordered pieces. | *Homo sapiens* | 35,370 | Aug. 3, 1999 |
| | | GB_HTG3:AC008590 | AC008590 | 268470 | *Homo sapiens* chromosome 5 clone CIT-HSPC_575D19, *SEQUENCING IN PROGRESS*, 235 unordered pieces. | *Homo sapiens* | 35,370 | Aug. 3, 1999 |
| | | GB_HTG3:AC008590 | AC008590 | 268470 | *Homo sapiens* chromosome 5 clone CIT-HSPC_575D19, *SEQUENCING IN PROGRESS*, 235 unordered pieces. | *Homo sapiens* | 38,571 | Aug. 3, 1999 |
| rxa01638 | 1023 | GB_HTG3:AC008261 | AC008261 | 93735 | *Arabidopsis thaliana* chromosome III clone TAMU-T4P13, *SEQUENCING IN PROGRESS*, 1 ordered pieces. | *Arabidopsis thaliana* | 37,200 | Aug. 10, 1999 |
| | | GB_HTG3:AC008261 | AC008261 | 93735 | *Arabidopsis thaliana* chromosome III clone TAMU-T4P13, *SEQUENCING IN PROGRESS*, 1 ordered pieces. | *Arabidopsis thaliana* | 37,200 | Aug. 10, 1999 |
| | | GB_HTG3:AC008261 | AC008261 | 93735 | *Arabidopsis thaliana* chromosome III clone TAMU-T4P13, *SEQUENCING IN PROGRESS*, 1 ordered pieces. | *Arabidopsis thaliana* | 32,637 | Aug. 10, 1999 |
| rxa01641 | 1494 | GB_PR3:HS681N20 | AL031670 | 130263 | Human DNA sequence from clone 681N20 on chromosome 20p12.1-13 Contains FTL1 (ferritin, light polypeptide-like 1), a gene similar to Zinc finger, C3HC4 type (RING finger), weakly similar to SW:GOL1_DROME Q06003 GOLIATH PROTEIN, ESTs, STS, GSS, CA repeat (D20S889), CpG islands, complete sequence. | *Homo sapiens* | 34,676 | Nov. 23, 1999 |
| | | GB_HTG4:AC011177 | AC011177 | 168660 | *Homo sapiens* clone 11_L_8, *SEQUENCING IN PROGRESS*, 7 unordered pieces. | *Homo sapiens* | 36,234 | Oct. 29, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01642 | 1365 | GB_HTG4:AC01177 | 168660 | AC011177 | Homo sapiens clone 11_L_8, *SEQUENCING IN PROGRESS*, 7 unordered pieces. | Homo sapiens | 36,234 | Oct. 29, 1999 |
| | | GB_BA1:MTY15F10 | 38204 | Z94121 | Mycobacterium tuberculosis H37Rv complete genome; segment 161/162. | Mycobacterium tuberculosis | 37,723 | Jun. 17, 1998 |
| rxa01643 | 549 | GB_BA1:SC3C3 | 31382 | AL031231 | Streptomyces coelicolor cosmid 3C3. | Streptomyces coelicolor | 39,602 | Aug. 10, 1998 |
| | | GB_BA1:SCU33176 | 1238 | U33176 | Streptomyces coelicolor serine protease gene, complete cds. | Streptomyces coelicolor | 41,467 | Jan. 9, 1996 |
| | | GB_IN1:CEZC101 | 26147 | Z93395 | Caenorhabditis elegans cosmid ZC101, complete sequence. | Caenorhabditis elegans | 36,280 | Jul. 23, 1999 |
| | | GB_EST16:C47058 | 360 | C47058 | C47058 Yuji Kohara unpublished cDNA:Strain N2 hermaphrodite embryo Caenorhabditis elegans cDNA clone yk432e11 5', mRNA sequence. | Caenorhabditis elegans | 39,944 | Oct. 18, 1999 |
| | | GB_HTG1:CEY54E2_1 | 110000 | Z92861 | Caenorhabditis elegans chromosome II clone Y54E2, *SEQUENCING IN PROGRESS*, in unordered pieces. | Caenorhabditis elegans | 36,280 | Jul. 29, 1998 |
| rxa01645 | 729 | GB_BA1:MTV025 | 121125 | AL022121 | Mycobacterium tuberculosis H37Rv complete genome; segment 155/162. | Mycobacterium tuberculosis | 60,310 | Jun. 24, 1999 |
| rxa01646 | 942 | GB_BA1:MLCB2407 | 35615 | AL023596 | Mycobacterium leprae cosmid B2407. | Mycobacterium leprae | 37,378 | Aug. 27, 1999 |
| | | GB_BA1:MSGB577COS | 37770 | L01263 | M. leprae genomic dna sequence, cosmid b577. | Mycobacterium leprae | 57,829 | Jun. 14, 1996 |
| | | GB_BA1:MSGB577COS | 37770 | L01263 | M. leprae genomic dna sequence, cosmid b577. | Mycobacterium leprae | 53,781 | Jun. 14, 1996 |
| | | GB_BA1:MLCB2407 | 35615 | AL023596 | Mycobacterium leprae cosmid B2407. | Mycobacterium leprae | 39,348 | Aug. 27, 1999 |
| | | GB_BA1:MTV025 | 121125 | AL022121 | Mycobacterium tuberculosis H37Rv complete genome; segment 155/162. | Mycobacterium tuberculosis | 53,503 | Jun. 24, 1999 |
| rxa01647 | 1293 | GB_GSS1:CNS010VB | 837 | AL099473 | Drosophila melanogaster genome survey sequence T7 end of BAC BACN05B20 of DrosBAC library from Drosophila melanogaster (fruit fly), genomic survey sequence. | Drosophila melanogaster | 39,412 | Jul. 26, 1999 |
| | | GB_EST1:T55021 | 429 | T55021 | yb42e09.r1 Stratagene fetal spleen (#937205) Homo sapiens cDNA clone IMAGE:73864 5', mRNA sequence. | Homo sapiens | 39,730 | Feb. 6, 1995 |
| | | GB_EST38:AL120803 | 505 | AL120803 | DKFZp762E202_r1 762 (synonym: hmel2) Homo sapiens cDNA clone DKFZp762E202 5', mRNA sequence. | Homo sapiens | 40,476 | Sep. 27, 1999 |
| rxa01656 | 1020 | GB_BA1:MTCY1A10 | 25949 | Z95387 | Mycobacterium tuberculosis H37Rv complete genome; segment 117/162. | Mycobacterium tuberculosis | 37,771 | Jun. 17, 1998 |
| | | GB_BA1:MLCL581 | 36225 | Z96801 | Mycobacterium leprae cosmid L581. | Mycobacterium leprae | 40,041 | Jun. 24, 1997 |
| | | GB_PL2:ATAC003028 | 106448 | AC003028 | Arabidopsis thaliana chromosome II BAC F16M14 genomic sequence, complete sequence. | Arabidopsis thaliana | 57,692 | Jul. 22, 1998 |
| rxa01658 | 1856 | GB_BA1:MTV014 | 58280 | AL021646 | Mycobacterium tuberculosis H37Rv complete genome; segment 137/162. | Mycobacterium tuberculosis | 38,877 | Jun. 18, 1998 |
| | | GB_BA1:MTV030 | 29256 | AL021428 | Mycobacterium tuberculosis H37Rv complete genome; segment 4/162. | Mycobacterium tuberculosis | 57,048 | Jun. 17, 1998 |
| | | GB_BA1:MTV014 | 58280 | AL021646 | Mycobacterium tuberculosis H37Rv complete genome; segment 137/162. | Mycobacterium tuberculosis | 40,511 | Jun. 18, 1998 |
| rxa01659 | 669 | GB_HTG3:AC008604 | 136016 | AC008604 | Homo sapiens chromosome 5 clone CIT978SKB_109F8, *SEQUENCING IN PROGRESS*, 79 unordered pieces. | Homo sapiens | 35,106 | Aug. 3, 1999 |
| | | GB_HTG3:AC008604 | 136016 | AC008604 | Homo sapiens chromosome 5 clone CIT978SKB_109F8, *SEQUENCING IN PROGRESS*, 79 unordered pieces. | Homo sapiens | 35,106 | Aug. 3, 1999 |
| | | GB_HTG3:AC011403 | 124903 | AC011403 | Homo sapiens chromosome 5 clone CIT978SKB_3P13, *SEQUENCING IN PROGRESS*, 7 ordered pieces. | Homo sapiens | 33,997 | Oct. 6, 1999 |
| rxa01663 | 981 | GB_HTG2:AC006799 | 278007 | AC006799 | Caenorhabditis elegans clone Y51H7, *SEQUENCING IN PROGRESS*, 7 unordered pieces. | Caenorhabditis elegans | 34,787 | Feb. 23, 1999 |
| | | GB_HTG2:AC006799 | 278007 | AC006799 | Caenorhabditis elegans clone Y51H7, *SEQUENCING IN PROGRESS*, 7 unordered pieces. | Caenorhabditis elegans | 34,787 | Feb. 23, 1999 |
| | | GB_HTG2:AC006799 | 278007 | AC006799 | Caenorhabditis elegans clone Y51H7, *SEQUENCING IN PROGRESS*, 7 unordered pieces. | Caenorhabditis elegans | 39,148 | Feb. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01665 | 843 | GB_BA1:CGU43535 | 2531 | U43535 | *Corynebacterium glutamicum* multidrug resistance protein (cmr) gene, complete cds. | *Corynebacterium glutamicum* | 37,353 | Apr. 9, 1997 |
|  |  | GB_IN2:AF062971 | 359 | AF062971 | *Anoplodactylus portus* 28S ribosomal RNA gene, partial sequence. | *Anoplodactylus portus* | 42,462 | Apr. 20, 1999 |
|  |  | GB_EST31:AU062109 | 544 | AU062109 | AU062109 *Dictyostelium discoideum* SL (H. Urushihara) *Dictyostelium discoideum* cDNA clone SLH629, mRNA sequence. | *Dictyostelium discoideum* | 34,810 | May 20, 1999 |
| rxa01669 | 1038 | GB_BA2:CGU89648 | 1105 | U89648 | *Corynebacterium glutamicum* unidentified sequence involved in histidine biosynthesis, partial sequence. | *Corynebacterium glutamicum* | 65,152 | Mar. 30, 1999 |
|  |  | GB_IN1:DMC86E4 | 29352 | AL021086 | *Drosophila melanogaster* cosmid clone 86E4. | *Drosophila melanogaster* | 39,289 | Apr. 27, 1999 |
|  |  | GB_PL1:ENY13759 | 3141 | Y13759 | *Emericella nidulans* abfB gene. | *Emericella nidulans* | 38,552 | Mar. 5, 1999 |
| rxa01671 | 1272 | GB_PH:MPU46938 | 15664 | U46938 | *Mycobacterium phage* DS6A, Spe1/NheI G fragment sequence. | *Mycobacterium phage* DS6A | 60,751 | Jun. 29, 1996 |
|  |  | GB_PAT:I31047 | 15664 | I31047 | Sequence 3 from U.S. Pat. No. 5582969. | Unknown. | 60,751 | Feb. 6, 1997 |
|  |  | GB_PAT:I36863 | 15664 | I36863 | Sequence 3 from U.S. Pat. No. 5612182. | Unknown. | 60,751 | May 13, 1997 |
| rxa01672 | 465 | GB_GSS13:AQ512046 | 462 | AQ512046 | HS_5113_B1_B10_SP6F RPCI-11 Human Male BAC Library *Homo sapiens* genomic clone Plate = 689 Col = 19 Row = D, genomic survey sequence. | *Homo sapiens* | 40,882 | May 5, 1999 |
|  |  | GB_GSS13:AQ475012 | 253 | AQ475012 | CITBI-E1-2592A3.TR CITBI-E1 *Homo sapiens* genomic clone 2592A3, genomic survey sequence. | *Homo sapiens* | 35,417 | Apr. 23, 1999 |
|  |  | GB_GSS14:AQ512046 | 462 | AQ512046 | HS_5113_B1_B10_SP6F RPCI-11 Human Male BAC Library *Homo sapiens* genomic clone Plate = 689 Col = 19 Row = D, genomic survey sequence. | *Homo sapiens* | 35,106 | May 5, 1999 |
| rxa01673 | 1158 | GB_HTG5:AC010988 | 176452 | AC010988 | *Homo sapiens* clone NH0570F04, WORKING DRAFT SEQUENCE, 1 unordered pieces. | *Homo sapiens* | 37,489 | Nov. 11, 1999 |
|  |  | GB_HTG5:AC010988 | 176452 | AC010988 | *Homo sapiens* clone NH0570F04, WORKING DRAFT SEQUENCE, 1 unordered pieces. | *Homo sapiens* | 35,492 | Nov. 11, 1999 |
| rxa01675 | 534 | GB_EST19:AA797620 | 497 | AA797620 | vw26o03.r1 Soares mouse mammary gland NbMMG *Mus musculus* cDNA clone IMAGE:1244909 5', mRNA sequence. | *Mus musculus* | 44,318 | Feb. 10, 1998 |
|  |  | GB_IN2:AF076597 | 846 | AF076597 | *Dictyostelium discoideum* ubiquitin-conjugating enzyme protein UbcC (ubcC) mRNA, complete cds. | *Dictyostelium discoideum* | 37,149 | Jul. 30, 1998 |
|  |  | GB_EST22:C94466 | 698 | C94466 | C94466 *Dictyostelium discoideum* SS (H. Urushihara) *Dictyostelium discoideum* cDNA clone SSL136, mRNA sequence. | *Dictyostelium discoideum* | 33,647 | Jun. 15, 1998 |
| rxa01676 | 879 | GB_IN1:CELR03H10 | 35080 | U29382 | *Caenorhabditis elegans* cosmid R03H10. | *Caenorhabditis elegans* | 40,951 | Jun. 22, 1995 |
|  |  | GB_EST37:AI998397 | 584 | AI998397 | 701545552 A. thaliana, Columbia Col-0, rosette-2 *Arabidopsis thaliana* cDNA clone 701545552, mRNA sequence. | *Arabidopsis thaliana* | 37,333 | Sep. 8, 1999 |
|  |  | GB_GSS14:AQ551731 | 577 | AQ551731 | RPCI-11-383J4.TJ RPCI-11 *Homo sapiens* genomic clone RPCI-11-383J4, genomic survey sequence. | *Homo sapiens* | 39,321 | May 28, 1999 |
| rxa01677 | 867 | GB_PL2:ATF6I18 | 122322 | AL022198 | *Arabidopsis thaliana* DNA chromosome 4, BAC clone F6I18 (ESSA project). | *Arabidopsis thaliana* | 34,335 | Aug. 27, 1999 |
|  |  | GB_PL2:ATF6I18 | 122322 | AL022198 | *Arabidopsis thaliana* DNA chromosome 4, BAC clone F6I18 (ESSA project). | *Arabidopsis thaliana* | 34,895 | Aug. 27, 1999 |
|  |  | GB_OV:XLSDK2 | 2306 | Y10350 | X. laevis mRNA for nuclear protein SDK2. | *Xenopus laevis* | 36,538 | Apr. 2, 1998 |
| rxa01681 | 756 | GB_HTG3:AC010798 | 172575 | AC010798 | *Homo sapiens* chromosome 18 clone 470_B_24 map 18, *SEQUENCING IN PROGRESS*, 7 unordered pieces. | *Homo sapiens* | 37,116 | Sep. 23, 1999 |
|  |  | GB_HTG3:AC010798 | 172575 | AC010798 | *Homo sapiens* chromosome 18 clone 470_B_24 map 18, *SEQUENCING IN PROGRESS*, 7 unordered pieces. | *Homo sapiens* | 37,116 | Sep. 23, 1999 |
| rxa01685 | 702 | GB_PL2:AF085231 | 3158 | AF085231 | *Arabidopsis thaliana* phytochelatin synthase 1 (AtPCS1) gene, complete cds. | *Arabidopsis thaliana* | 42,149 | Jun. 3, 1999 |
|  |  | GB_HTG1:CEY48A6 | 296699 | Z92854 | *Caenorhabditis elegans* chromosome III clone Y48A6, *SEQUENCING IN PROGRESS*, in unordered pieces. | *Caenorhabditis elegans* | 37,393 | Jul. 31, 1998 |
|  |  | GB_HTG1:CEY48A6 | 296699 | Z92854 | *Caenorhabditis elegans* chromosome III clone Y48A6, *SEQUENCING IN PROGRESS*, in unordered pieces. | *Caenorhabditis elegans* | 37,393 | Jul. 31, 1998 |
|  |  | GB_HTG1:CEY48A6 | 296699 | Z92854 | *Caenorhabditis elegans* chromosome III clone Y48A6, *SEQUENCING IN PROGRESS*, in unordered pieces. | *Caenorhabditis elegans* | 32,946 | Jul. 31, 1998 |

US 6,962,989 B1

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01686 | 564 | GB_EST35:AV156415 | 240 | AV156415 | AV156415 Mus musculus head C57BL/6J 12-day embryo Mus musculus cDNA clone 3000002G04, mRNA sequence. | Mus musculus | 40,417 | Jul. 7, 1999 |
| | | GB_GSS15:AQ611518 | 597 | AQ611518 | HS_5084_B2_H01_T7A RPCI-11 Human Male BAC Library Homo sapiens genomic clone Plate = 660 Col = 2 Row = P, genomic survey sequence. | Homo sapiens | 41,848 | Jun. 15, 1999 |
| rxa01693 | 1545 | GB_BA1:PDIORAB | 5487 | Z48918 | P. diminuta iorA and iorB genes for isoquinoline 1-oxidoreductase. | Brevundimonas diminuta | 36,709 | Aug. 15, 1995 |
| | | GB_IN1:CEF46B6 | 36616 | Z70780 | Caenorhabditis elegans cosmid F46B6, complete sequence. | Caenorhabditis elegans | 36,856 | Dec. 4, 1998 |
| | | GB_EST5:L44364 | 362 | L44364 | HUMEST1G5 Human thymus NSTH II Homo sapiens cDNA, mRNA sequence. | Homo sapiens | 38,136 | Jan. 17, 1996 |
| | | GB_PR2:AF009282 | 414 | AF009282 | Homo sapiens clone FBF3 Crl-du-chat region mRNA. | Homo sapiens | 46,809 | Aug. 17, 1997 |
| rxa01694 | 1023 | GB_BA1:CGA224946 | 2408 | AJ224946 | Corynebacterium glutamicum DNA for L-Malate.quinone oxidoreductase. | Corynebacterium glutamicum | 100,000 | Aug. 11, 1998 |
| | | GB_EST7:W22650 | 715 | W22650 | 71B2 Human retina cDNA Isp509I-cleaved sublibrary Homo sapiens cDNA not directional, mRNA sequence. | Homo sapiens | 37,538 | May 6, 1996 |
| | | GB_PR4:AC005343 | 137213 | AC005343 | Homo sapiens Chromosome 12p13.3 BAC RPCI11-21K20 (Roswell Park Cancer Institute Human BAC Library) complete sequence. | Homo sapiens | 38,048 | Apr. 2, 1999 |
| rxa01696 | 1302 | GB_BA1:MSGB1529CS | 36985 | L78824 | Mycobacterium leprae cosmid B1529 DNA sequence. | Mycobacterium leprae | 67,442 | Jun. 15, 1996 |
| | | GB_BA1:SC6A5 | 43632 | AL049485 | Streptomyces coelicolor cosmid 6A5. | Streptomyces coelicolor | 66,821 | Mar. 24, 1999 |
| | | GB_BA1:MTV003 | 13246 | AL008883 | Mycobacterium tuberculosis H37Rv complete genome; segment 125/162. | Mycobacterium tuberculosis | 38,802 | Jun. 17, 1998 |
| rxa01697 | 1080 | GB_PL2:HNNHAHR | 2559 | L76588 | Helianthus annuus homeodomain protein 1 mRNA, complete cds. | Helianthus annuus | 38,257 | Oct. 2, 1997 |
| | | GB_PL2:HNNHAHR | 2559 | L76588 | Helianthus annuus homeodomain protein 1 mRNA, complete cds. | Helianthus annuus | 37,196 | Oct. 2, 1997 |
| rxa01701 | 472 | GB_BA2:AF069748 | 2103 | AF069748 | Pseudomonas chloroaphis polyurethanase esterase A (pueA) gene, complete cds. | Pseudomonas chlororaphis | 39,130 | Apr. 4, 1999 |
| | | GB_BA2:AF069748 | 2103 | AF069748 | Pseudomonas chloroaphis polyurethanase esterase A (pueA) gene, complete cds. | Pseudomonas chlororaphis | 40,271 | Apr. 4, 1999 |
| rxa01703 | 1236 | GB_BA1:CGFDA | 3371 | X17313 | Corynebacterium glutamicum fda gene for fructose-bisphosphate aldolase (EC 4.1.2.13). | Corynebacterium glutamicum | 100,000 | Sep. 12, 1993 |
| | | GB_EST18:AA728419 | 340 | AA728419 | 33598 CD4-6 Arabidopsis thaliana cDNA clone K2C9RP, mRNA sequence. | Arabidopsis thaliana | 36,176 | Jan. 5, 1998 |
| | | GB_PL2:ATU90439 | 93639 | U90439 | Arabidopsis thaliana chromosome II BAC T06D20 genomic sequence, complete sequence. | Arabidopsis thaliana | 35,381 | Jul. 21, 1997 |
| rxa01709 | 555 | GB_OV:AF033670 | 2353 | AF033670 | Gallus gallus T-Box protein 4 (TBX4) mRNA, complete cds. | Gallus gallus | 37,917 | Jun. 9, 1998 |
| | | GB_EST5:H85635 | 533 | H85635 | ys88c04.r1 Soares retina N2b5HR Homo sapiens cDNA clone IMAGE:221862 5′, mRNA sequence. | Homo sapiens | 36,735 | Nov. 14, 1995 |
| | | GB_EST35:AI829867 | 427 | AI829867 | wj58e05.x1 NCI_CGAP_Lu19 Homo sapiens cDNA clone IMAGE:2407016 3′, mRNA sequence. | Homo sapiens | 40,299 | Aug. 26, 1999 |
| rxa01711 | 1281 | GB_GSS10:AQ217798 | 441 | AQ217798 | HS_2007_A1_A04_MR CIT Approved Human Genomic Sperm Library D Homo sapiens genomic clone Plate = 2007 Col = 7 Row = A, genomic survey sequence. | Homo sapiens | 38,292 | Sep. 19, 1998 |
| | | GB_PAT:E05055 | 2053 | E05055 | DNA encoding D-threonine aldolase (DTA). | Xanthomonas oryzae | 36,475 | Sep. 29, 1997 |
| | | GB_PR3:HSJ1570L12 | 143508 | AL049589 | Human DNA sequence from clone 570L12 on chromosome Xq13.1-21.1. Contains the PGK1 gene for phosphoglycerate kinase 1, the gene for a novel protein similar to TAF2G (TATA box binding protein (TBP)-associated factor, RNA polymerase II, G, 32 kD) (TAFII31)), ESTs, STSs, GSSs and a putative CpG island, complete sequence. | Homo sapiens | 36,262 | Nov. 23, 1999 |
| rxa01714 | | | | | | | | |
| rxa01715 | 819 | GB_BA1:MTCY441 | 35187 | Z80225 | Mycobacterium tuberculosis H37Rv complete genome; segment 118/162. | Mycobacterium tuberculosis | 36,216 | Jun. 18, 1998 |
| | | GB_BA1:SC185 | 14866 | AL023517 | Streptomyces coelicolor cosmid 1B5. | Streptomyces coelicolor | 56,807 | May 11, 1998 |
| | | GB_BA1:MSGB1912CS | 38503 | L01536 | M. leprae genomic dna sequence, cosmid b1912. | Mycobacterium leprae | 55,651 | Jun. 14, 1996 |
| rxa01729 | 642 | GB_BA2:CORCSLYS | 2821 | M89931 | Corynebacterium glutamicum beta C-S lyase (aecD) and branched-chain amino acid uptake | Corynebacterium | 41,993 | Jun. 4, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | | | | carrier (bmQ) genes, complete cds, and hypothetical protein Yhbw (yhbw) gene, partial cds. | glutamicum | | |
| rxa01731 | 822 | GB_HTG4:AC011037 | 166249 | AC011037 | Drosophila melanogaster chromosome 3L/66B6 clone RPCI98-6E4, *SEQUENCING IN PROGRESS*, 52 unordered pieces. | Drosophila melanogaster | 34,951 | Oct. 16, 1999 |
| | | GB_HTG4:AC011037 | 166249 | AC011037 | Drosophila melanogaster chromosome 3L/66B6 clone RPCI98-6E4, *SEQUENCING IN PROGRESS*, 52 unordered pieces. | Drosophila melanogaster | 34,951 | Oct. 16, 1999 |
| | | GB_GSS3:B83621 | 616 | B83621 | RPCI11-16H17.TPB RPCI-11 Homo sapiens genomic clone RPCI-11-16H17, genomic survey sequence. | Homo sapiens | 40,899 | Apr. 9, 1999 |
| | | GB_GSS3:B82563 | 586 | B82563 | RPCI11-16N17.TP RPCI-11 Homo sapiens genomic clone RPCI-11-16N17, genomic survey sequence. | Homo sapiens | 40,235 | Apr. 9, 1999 |
| | | GB_HTG3:AC009074 | 45999 | AC009074 | Homo sapiens chromosome 16 clone RPCI-11_323C21, *SEQUENCING IN PROGRESS*, 27 unordered pieces. | Homo sapiens | 36,783 | Aug. 3, 1999 |
| rxa01734 | 657 | GB_GSS14:AQ545618 | 327 | AQ545618 | CITBI-E1-2636O13.TR CITBI-E1 Homo sapiens genomic clone 2636O13, genomic survey sequence. | Homo sapiens | 38,154 | May 28, 1999 |
| | | GB_HTG2:AC006629 | 27659 | AC006629 | Caenorhabditis elegans clone F12E12, *SEQUENCING IN PROGRESS*, 1 unordered pieces. | Caenorhabditis elegans | 35,658 | Feb. 23, 1999 |
| | | GB_HTG2:AC006629 | 27659 | AC006629 | Caenorhabditis elegans clone F12E12, *SEQUENCING IN PROGRESS*, 1 unordered pieces. | Caenorhabditis elegans | 35,714 | Feb. 23, 1999 |
| rxa01738 | 837 | GB_HTG1:CNS01DSB | 222193 | AL121768 | Homo sapiens chromosome 14 clone R-976B16, **SEQUENCING IN PROGRESS*, in ordered pieces. | Homo sapiens | 36,978 | Oct. 5, 1999 |
| | | GB_HTG1:CNS01DSB | 222193 | AL121768 | Homo sapiens chromosome 14 clone R-976B16, **SEQUENCING IN PROGRESS*, in ordered pieces. | Homo sapiens | 36,978 | Oct. 5, 1999 |
| | | GB_HTG5:AC011170 | 171788 | AC011170 | Homo sapiens clone 10_L_13, **SEQUENCING IN PROGRESS*, 14 unordered pieces. | Homo sapiens | 35,259 | Nov. 5, 1999 |
| rxa01741 | 921 | GB_IN1:CEK04G11 | 34190 | Z78544 | Caenorhabditis elegans cosmid K04G11, complete sequence. | Caenorhabditis elegans | 35,055 | Sep. 6, 1999 |
| | | GB_HTG2:AC005995 | 170023 | AC005995 | Homo sapiens clone DJ0042M02, **SEQUENCING IN PROGRESS*, 13 unordered pieces. | Homo sapiens | 33,624 | Apr. 23, 1999 |
| | | GB_HTG2:AC005995 | 170023 | AC005995 | Homo sapiens clone DJ0042M02, **SEQUENCING IN PROGRESS*, 13 unordered pieces. | Homo sapiens | 33,624 | Apr. 23, 1999 |
| rxa01742 | 627 | GB_EST30:AI658116 | 497 | AI658116 | fc22e07.y1 Zebrafish WashU MPIMG EST Danio rerio cDNA 5' similar to TR:Q15883 Q15883 X104; mRNA sequence. | Danio rerio | 35,604 | May 6, 1999 |
| | | GB_HTG1:CEY60A9 | 275370 | AL022281 | Caenorhabditis elegans chromosome X clone Y60A9, **SEQUENCING IN PROGRESS*, in unordered pieces. | Caenorhabditis elegans | 35,610 | Sep. 2, 1999 |
| | | GB_HTG1:CEY60A9 | 275370 | AL022281 | Caenorhabditis elegans chromosome X clone Y60A9, **SEQUENCING IN PROGRESS*, in unordered pieces. | Caenorhabditis elegans | 35,610 | Sep. 2, 1999 |
| rxa01748 | 903 | GB_GSS13:AQ447364 | 439 | AQ447364 | mgxb0006N01r CUGI Rice Blast BAC Library Magnaporthe grisea genomic clone mgxb0006N01r, genomic survey sequence. | Magnaporthe grisea | 34,889 | Apr. 8, 1999 |
| | | GB_PR2:HSJ247G22 | 120487 | AL096866 | Human DNA sequence from clone RP1-247G22 on chromosome 6p12.2-21.2, complete sequence. | Homo sapiens | 39,310 | Nov. 22, 1999 |
| | | GB_GSS5:AQ811603 | 375 | AQ811603 | HS_5460_B1_C09_SP6F RPCI-11 Human Male BAC Library Homo sapiens genomic clone Plate = 1036 Col = 17 Row = F, genomic survey sequence. | Homo sapiens | 38,133 | Aug. 25, 1999 |
| rxa01749 | 1740 | GB_HTG5:AC009544 | 211057 | AC009544 | Homo sapiens chromosome 11 clone RP11-85D24 map 11, WORKING DRAFT SEQUENCE, 14 unordered pieces. | Homo sapiens | 37,433 | Nov. 19, 1999 |
| | | GB_HTG5:AC009544 | 211057 | AC009544 | Homo sapiens chromosome 11 clone RP11-85D24 map 11, WORKING DRAFT SEQUENCE, 14 unordered pieces. | Homo sapiens | 37,069 | Nov. 19, 1999 |
| rxa01750 | | | | | | | | |
| rxa01752 | 1584 | GB_PR1:HUMPROFILX | 17630 | M96943 | Human profilaggrin gene exons 1-3, 5' end. | Homo sapiens | 36,352 | Apr. 27, 1993 |
| | | GB_PL2:AF049174 | 535 | AF049174 | Tolypocladium inflatum NRRL 28024 28S ribosomal RNA gene, partial sequence. | Tolypocladium inflatum | 40,187 | Mar. 3, 1999 |
| | | GB_BA1:MLCL458 | 43839 | AL049478 | Mycobacterium leprae cosmid L458. | Mycobacterium leprae | 40,322 | Aug. 12, 1999 |
| rxa01753 | 1662 | GB_PR1:HUMPROFILX | 17630 | M96943 | Human profilaggrin gene exons 1-3, 5' end. | Homo sapiens | 36,794 | Apr. 27, 1993 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01754 | | GB_PL1:YSCFBPA | 2202 | J03207 | S. cerevisiae fructose-1,6-bisphosphatase (FBP) gene, complete cds. | Saccharomyces cerevisiae | 37,762 | Apr. 27, 1993 |
| | | GB_PL2:YSCL8039 | 31806 | U19103 | Saccharomyces cerevisiae chromosome XII cosmid 8039. | Saccharomyces cerevisiae | 37,685 | Aug. 22, 1997 |
| rxa01760 | 405 | GB_IN1:CELF43C9 | 34037 | U40427 | Caenorhabditis elegans cosmid F43C9. | Caenorhabditis elegans | 40,945 | Nov. 16, 1995 |
| | | GB_IN1:CELF43C9 | 34037 | U40427 | Caenorhabditis elegans cosmid F43C9. | Caenorhabditis elegans | 35,484 | Nov. 16, 1995 |
| | | GB_RO.MUSOP5F | 3405 | D14816 | Mouse osteopontin gene, 5′ flanking region | Mus musculus | 35,264 | Feb. 4, 1999 |
| rxa01761 | 4587 | GB_PR4:AC004600 | 133863 | AC004600 | Homo sapiens Chromosome 15q11-q13 PAC clone pDJ373b1 containing Angelman Syndrome gene (UBE3A), complete sequence | Homo sapiens | 37,037 | Mar. 11, 1999 |
| | | GB_PR3 AC004259 | 118684 | AC004259 | Human Chromosome 15q11-q13 PAC clone pDJ14r12 containing Angelman Syndrome gene (UBE3A), complete sequence | Homo sapiens | 37,037 | Jun. 3, 1998 |
| | | GB_PR4:AC004600 | 133863 | AC004600 | Homo sapiens Chromosome 15q11-q13 PAC clone pDJ373b1 containing Angelman Syndrome gene (UBE3A), complete sequence | Homo sapiens | 35,995 | Mar. 11, 1999 |
| rxa01765 | 1065 | GB_EST31 AI694883 | 370 | AI694883 | we52h02 x1 NCI_CGAP_Co3 Homo sapiens cDNA clone IMAGE:2344755 3′, mRNA sequence | Homo sapiens | 39,566 | Jun. 3, 1999 |
| | | GB_EST6 W08057 | 341 | W08057 | mb37e05 r1 Soares mouse p3NMF 19.5 Mus musculus cDNA clone IMAGE 331616 5′ similar to gb Z23090 HEAT SHOCK 27 KD PROTEIN (HUMAN), gb L11609 Mus musculus heat shock protein 25 (MOUSE), mRNA sequence. | Mus musculus | 37,353 | Sep. 5, 1996 |
| rxa01767 | 588 | GB_IN1:CELC39D10 | 40897 | U39678 | Caenorhabditis elegans cosmid C39D10 | Caenorhabditis elegans | 39,590 | Nov. 2, 1995 |
| | | GB_IN1:CEF16H9 | 21721 | Z50005 | Caenorhabditis elegans cosmid F16H9, complete sequence | Caenorhabditis elegans | 36,667 | Sep. 2, 1999 |
| | | GB_IN1 CECC4 | 32063 | Z81490 | Caenorhabditis elegans cosmid CC4, complete sequence | Caenorhabditis elegans | 35,094 | Sep. 2, 1999 |
| | | GB_HTG1:CEY26D4 | 156152 | AL022595 | Caenorhabditis elegans chromosome I clone Y26D4, **SEQUENCING IN PROGRESS**, in unordered pieces | Caenorhabditis elegans | 33,276 | Sep. 7, 1999 |
| rxa01768 | | | | | | | | |
| rxa01769 | 564 | GB_HTG4:AC010034 | 130818 | AC010034 | Drosophila melanogaster clone RPCI98-4O3, **SEQUENCING IN PROGRESS**, 63 unordered pieces. | Drosophila melanogaster | 35,740 | Oct. 16, 1999 |
| | | GB_HTG4:AC010034 | 130818 | AC010034 | Drosophila melanogaster clone RPCI98-4O3, **SEQUENCING IN PROGRESS**, 63 unordered pieces. | Drosophila melanogaster | 35,740 | Oct. 16, 1999 |
| | | GB_EST1 D36647 | 360 | D36647 | CELK035EZF Yuji Kohara unpublished cDNA Caenorhabditis elegans cDNA clone yk35e12 5′, mRNA sequence | Caenorhabditis elegans | 37,870 | Aug. 8, 1994 |
| rxa01770 | 3888 | GB_IN1:SUSENDO16C | 4692 | L34680 | Strongylocentrotus purpuratus calcium-binding protein (endo16) mRNA, complete cds | Strongylocentrotus purpuratus | 39,337 | Jul. 21, 1994 |
| | | GB_EST31:AF121176 | 535 | AF121176 | AF121176 Homo sapiens liver (Chang L-Y) Homo sapiens cDNA clone PFTTA2-2, mRNA sequence | Homo sapiens | 39,626 | May 24, 1999 |
| rxa01771 | 825 | GB_PR1 AB011149 | 5134 | AB011149 | Homo sapiens mRNA for KIAA0577 protein, complete cds. | Homo sapiens | 38,279 | Apr. 10, 1998 |
| | | GB_BA1 CGPROPGEN | 2936 | Y12537 | C. glutamicum proP gene. | Corynebacterium glutamicum | 100,000 | Nov. 17, 1998 |
| | | GB_EST33 AI778471 | 545 | AI778471 | EST259350 tomato susceptible, Cornell Lycopersicon esculentum cDNA clone cLES5M16, mRNA sequence | Lycopersicon esculentum | 41,187 | Jun. 29, 1999 |
| rxa01773 | 600 | GB_IN1:CET11F9 | 37714 | Z74042 | Caenorhabditis elegans cosmid T11F9, complete sequence | Caenorhabditis elegans | 38,077 | Nov. 23, 1998 |
| | | GB_HTG2 U82212 | 46387 | U82212 | Homo sapiens chromosome 10 clone LA10NC01_23_C_3 map 10q26 1-10q26 2, **SEQUENCING IN PROGRESS**, 1 ordered pieces. | Homo sapiens | 42,142 | Dec. 9, 1998 |
| | | GB_HTG2 U82212 | 46387 | U82212 | Homo sapiens chromosome 10 clone LA10NC01_23_C_3 map 10q26 1-10q26 2, **SEQUENCING IN PROGRESS**, 1 ordered pieces. | Homo sapiens | 42,142 | Dec. 9, 1998 |
| | | GB_HTG2 U82212 | 46387 | U82212 | Homo sapiens chromosome 10 clone LA10NC01_23_C_3 map 10q26 1-10q26 2, **SEQUENCING IN PROGRESS**, 1 ordered pieces. | Homo sapiens | 37,748 | Dec. 9, 1998 |
| rxa01774 | 849 | GB_HTG1 HSA557H16 | 228174 | AL078590 | Homo sapiens chromosome 6 clone RP11-557H15, **SEQUENCING IN PROGRESS**, in | Homo sapiens | 38,054 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG1:HSA557H15 | 228174 | AL078590 | *Homo sapiens* chromosome 6 clone RP11-557H15, **SEQUENCING IN PROGRESS**, in unordered pieces | *Homo sapiens* | 38,054 | Nov. 23, 1999 |
| rxa01775 | 687 | GB_PL2:YSCH9998 | 35600 | U00030 | *Saccharomyces cerevisiae* chromosome VIII cosmid 9998. | *Saccharomyces cerevisiae* | 39,110 | Sep. 2, 1997 |
| | | GB_PR3:HS37J18 | 131427 | Z98747 | Human DNA sequence from clone 37J18 on chromosome 1p36.2-36.3. Contains a putative novel gene, ESTs and GSSs, complete sequence. | *Homo sapiens* | 35,036 | Nov. 23, 1999 |
| | | GB_HTG2:AC007475 | 185087 | AC007475 | *Drosophila melanogaster* chromosome 2 clone BACR04E21 (D592) RPCI-98 04.E.21 map 49A-49B strain y; cn bw sp, **SEQUENCING IN PROGRESS**, 36 unordered pieces. | *Drosophila melanogaster* | 37,333 | Aug. 2, 1999 |
| | | GB_HTG2:AC007475 | 185087 | AC007475 | *Drosophila melanogaster* chromosome 2 clone BACR04E21 (D592) RPCI-98 04.E.21 map 49A-49B strain y; cn bw sp, **SEQUENCING IN PROGRESS**, 36 unordered pieces. | *Drosophila melanogaster* | 37,333 | Aug. 2, 1999 |
| rxa01776 | 1575 | GB_GSS10:AQ174954 | 416 | AQ174954 | HS_3211_B2_C03_MR CIT Approved Human Genomic Sperm Library D *Homo sapiens* genomic clone Plate = 3211 Col = 6 Row = F, genomic survey sequence. | *Homo sapiens* | 43,171 | Oct. 17, 1998 |
| | | GB_PR1:HSFGF6 | 1032 | X57075 | *H. sapiens* FGF6 gene. | *Homo sapiens* | 41,196 | Feb. 15, 1995 |
| | | GB_PR2:HSAC000055 | 93578 | AC000055 | Human PAC clone DJ073F11 from Xq23, complete sequence. | *Homo sapiens* | 35,080 | Nov. 14, 1996 |
| rxa01777 | 582 | GB_BA2:AF076997 | 15398 | AF076997 | *Comamonas testosteroni* PtL5 cryptic plasmid pPT1, complete sequence. | *Comamonas testosteroni* | 37,805 | Nov. 30, 1999 |
| | | GB_BA2:AF076997 | 15398 | AF076997 | *Comamonas testosteroni* PtL5 cryptic plasmid pPT1, complete sequence. | *Comamonas testosteroni* | 35,529 | Nov. 30, 1999 |
| rxa01778 | 1260 | GB_PR3:AC002981 | 153568 | AC002981 | *Homo sapiens* Xp22 BAC GS279A12 (Genome Systems) complete sequence. | *Homo sapiens* | 37,305 | Jan. 22, 1998 |
| | | GB_EST29:AI587176 | 384 | AI587176 | tr54c10.x1 NCI_CGAP_Pan1 *Homo sapiens* cDNA clone IMAGE:2222130 3', mRNA sequence. | *Homo sapiens* | 37,240 | May 14, 1999 |
| | | GB_PR1:HSCP450 | 1346 | X65962 | *H. sapiens* mRNA for cytochrome P-450. | *Homo sapiens* | 38,908 | May 29, 1992 |
| rxa01779 | 1542 | GB_EST19:AA202518 | 661 | AA202518 | LD02757.5prime LD *Drosophila melanogaster* embryo BlueScript *Drosophila melanogaster* cDNA clone LD02757 5prime, mRNA sequence. | *Drosophila melanogaster* | 40,212 | Nov. 27, 1998 |
| | | GB_EST34:AI805834 | 453 | AI805834 | te52b03.x1 Soares_NFL_T_GBC_S1 *Homo sapiens* cDNA clone IMAGE:2090285 3' similar to contains Alu repetitive element; mRNA sequence. | *Homo sapiens* | 38,000 | Jul. 7, 1999 |
| | | GB_EST30:AI648920 | 754 | AI648920 | uk32h03.x1 Sugano mouse kidney mkla *Mus musculus* cDNA clone IMAGE:1970741 3' similar to WP:Y76A2B.5 CE19277; mRNA sequence. | *Mus musculus* | 36,967 | Apr. 30, 1999 |
| rxa01780 | 498 | GB_GSS8:AQ038759 | 670 | AQ038759 | CIT-HSP-2325O13.TV CIT-HSP *Homo sapiens* genomic clone 2325O13, genomic survey sequence. | *Homo sapiens* | 32,645 | Jul. 11, 1998 |
| | | GB_GSS8:AQ038759 | 670 | AQ038759 | CIT-HSP-2325O13.TV CIT-HSP *Homo sapiens* genomic clone 2325O13, genomic survey sequence. | *Homo sapiens* | 39,474 | Jul. 11, 1998 |
| rxa01781 | 384 | GB_IN1:CELF52G3 | 42696 | AF026212 | *Caenorhabditis elegans* cosmid F52G3. | *Caenorhabditis elegans* | 39,314 | Sep. 25, 1997 |
| | | GB_GSS14:AQ579313 | 877 | AQ579313 | nbxb0084O07r CUGI Rice BAC Library *Oryza sativa* genomic clone nbxb0084O07r, genomic survey sequence. | *Oryza sativa* | 36,053 | Jun. 2, 1999 |
| | | GB_VI:HAV19AE3 | 3441 | X95259 | Human adenovirus type 19a early region 3 genes. | Human adenovirus type 19a | 38,624 | Jul. 9, 1997 |
| rxa01782 | 519 | GB_IN1:DMSED5 | 930 | X78219 | *D. melanogaster* (Barton) SED5 mRNA. | *Drosophila melanogaster* | 38,372 | Apr. 21, 1995 |
| | | GB_IN2:L49408 | 83527 | L49408 | *Drosophila melanogaster* DNA sequence (P1 DS02740 (D27)), complete sequence. | *Drosophila melanogaster* | 35,992 | Jul. 17, 1998 |
| | | GB_STSs:G46002 | 398 | G46002 | Z556_1 Zebrafish AB *Danio rerio* STS genomic clone Z556 5', sequence tagged site. | *Danio rerio* | 33,920 | Mar. 23, 1999 |
| rxa01783 | 360 | GB_VI:CITV18420 | 19259 | Y18420 | *Citrus tristeza* virus complete genome, isolate T385. | *Citrus tristeza* virus | 41,457 | Apr. 6, 1999 |
| | | GB_IN1:DMSED5 | 930 | X78219 | *D. melanogaster* (Barton) SED5 mRNA. | *Drosophila melanogaster* | 45,802 | Apr. 21, 1995 |
| | | GB_VI:CTY18368 | 2759 | Y18368 | *Citrus tristeza* virus defective RNA, strain T411. | *Citrus tristeza* virus | 41,457 | Apr. 6, 1999 |
| rxa01785 | 699 | GB_BA2:AF121000 | 19751 | AF121000 | *Corynebacterium glutamicum* strain 22243 R-plasmid pAG1, complete sequence. | *Corynebacterium glutamicum* | 40,529 | Apr. 14, 1999 |
| | | GB_PR2:HS1014D13 | 71263 | AL022311 | Human DNA sequence from clone 1014D13 on chromosome 22q13.1-13.2 Contains ESTs, STSs, and a CpG island, complete sequence. | *Homo sapiens* | 35,362 | Nov. 23, 1999 |
| | | GB_BA2:AF121000 | 19751 | AF121000 | *Corynebacterium glutamicum* strain 22243 R-plasmid pAG1, complete sequence. | *Corynebacterium* | 38,012 | Apr. 14, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01787 | 816 | GB_RO:RATSIALYLA | 1128 | L13445 | Rat slalyltransferase gene family related mRNA, complete cds. | Rattus norvegicus | 35,012 | Jul. 26, 1993 |
| | | GB_PR3:HSN75H12 | 46144 | Z84496 | Human DNA sequence from cosmid N75H12 on chromosome 22q12-qter. | Homo sapiens | 37,738 | Nov. 23, 1999 |
| | | GB_GSS13:AQ496514 | 532 | AQ496514 | HS_5118_B2_F05_SP6E RPCI-11 Human Male BAC Library Homo sapiens genomic clone Plate = 694 Col = 10 Row = L, genomic survey sequence. | Homo sapiens | 39,238 | Apr. 28, 1999 |
| rxa01788 | | | | | | | | |
| rxa01789 | 765 | GB_BA1:MTV029 | 3279 | AL021427 | Mycobacterium tuberculosis H37Rv complete genome; segment 1/162. | Mycobacterium tuberculosis | 39,229 | Jun. 17, 1998 |
| | | GB_BA1:MTORIREP | 8400 | X92504 | M. tuberculosis origin of replication and genes rmpA, rpmH, dnaA, dnaN, recF. | Mycobacterium tuberculosis | 36,328 | Aug. 26, 1997 |
| | | GB_GSS4:AQ729452 | 763 | AQ729452 | HS_5474_A1_G07_T7AHS_5474_A1 RPCI-11 Human Male BAC Library Homo sapiens genomic clone Plate = 1050 Col = 13 Row = M, genomic survey sequence. | Homo sapiens | 39,451 | Jul. 15, 1999 |
| rxa01790 | 183 | GB_EST37:AI935426 | 436 | AI935426 | wo84d02.x1 NCI_CGAP_Kid11 Homo sapiens cDNA clone IMAGE:2462019 3' similar to TR:O00193 O00193 SMALL ACIDIC PROTEIN; mRNA sequence. | Homo sapiens | 39,877 | Sep. 2, 1999 |
| | | GB_GSS11:AQ265301 | 621 | AQ265301 | CITBI-E1-2509K16.TF CITBI-E1 Homo sapiens genomic clone 2509K16, genomic survey sequence. | Homo sapiens | 45,856 | Oct. 27, 1998 |
| | | GB_HTG2:AC007596 | 199300 | AC007596 | Homo sapiens chromosome 16 clone 116B6, **SEQUENCING IN PROGRESS**, 42 unordered pieces. | Homo sapiens | 37,572 | May 20, 1999 |
| rxa01791 | 486 | GB_PL2:ATAC004521 | 104797 | AC004521 | Arabidopsis thaliana chromosome II BAC F4I1 genomic sequence, complete sequence. | Arabidopsis thaliana | 43,167 | May 12, 1998 |
| | | GB_GSS13:AQ436125 | 508 | AQ436125 | HS_5049_B2_G12_T7A RPCI-11 Human Male BAC Library Homo sapiens genomic clone Plate = 625 Col = 24 Row = N, genomic survey sequence. | Homo sapiens | 32,762 | Mar. 31, 1999 |
| | | GB_GSS12:AQ342410 | 674 | AQ342410 | RPCI11-121E5.TJ RPCI-11 Homo sapiens genomic clone RPCI-11-121E5, genomic survey sequence. | Homo sapiens | 37,269 | May 6, 1999 |
| rxa01792 | 396 | GB_STS:KLAI9905 | 178 | AJ229905 | Kluyveromyces lactis DNA fragment for sequence tagged site, clone okam5e06r. | Kluyveromyces lactis | 42,697 | Nov. 20, 1998 |
| | | GB_STS:KLAI9905 | 178 | AJ229905 | Kluyveromyces lactis DNA fragment for sequence tagged site, clone okam5e06r. | Kluyveromyces lactis | 42,697 | Nov. 20, 1998 |
| | | GB_GSS15:AQ612295 | 472 | AQ612295 | HS_5121_A2_D09_SP6E RPCI-11 Human Male BAC Library Homo sapiens genomic clone Plate = 697 Col = 18 Row = G, genomic survey sequence. | Homo sapiens | 40,885 | Jun. 15, 1999 |
| rxa01793 | 357 | GB_GSS3:B82515 | 613 | B82515 | RPCI11-16J10.TV RPCI-11 Homo sapiens genomic clone RPCI-11-16J10, genomic survey sequence. | Homo sapiens | 40,164 | Apr. 9, 1999 |
| | | GB_PR2:CNS0000B | 196287 | AL049829 | Human chromosome 14 DNA sequence **IN PROGRESS** BAC R-124D2 of RPCI-11 library from chromosome 14 of Homo sapiens (Human), complete sequence. | Homo sapiens | 33,621 | Oct. 27, 1999 |
| rxa01794 | 4329 | GB_OV:AF001393 | 4329 | AF001393 | Oryzias latipes Medaka OG-12 (MOG-12) mRNA, complete cds. | Oryzias latipes | 35,511 | Sep. 30, 1999 |
| | | GB_GSS15:AQ644157 | 665 | AQ644157 | RPCI93-Dpnll-29O12.TV RPCI93-Dpnll Trypanosoma brucei genomic clone RPCI93-Dpnll-29O12, genomic survey sequence. | Trypanosoma brucei | 39,894 | Jul. 8, 1999 |
| | | GB_GSS15:AQ657704 | 665 | AQ657704 | Sheared DNA-24C24.TR Sheared DNA Trypanosoma brucei genomic clone Sheared DNA-24C24, genomic survey sequence. | Trypanosoma brucei | 37,110 | Jun. 23, 1999 |
| rxa01796 | 897 | GB_OV:GGU25125 | 6418 | U25125 | Gallus gallus preprogastrin gene, complete cds. | Gallus gallus | 40,584 | May 6, 1995 |
| | | GB_PR3:HS404G5 | 119737 | AL035695 | Human DNA sequence from clone 404G5 on chromosome 6q24.1-25.2. Contains part of a human estrogen receptor gene, STSs and GSSs, complete sequence. | Homo sapiens | 34,793 | Nov. 23, 1999 |
| | | GB_PR1:HSPTP1CHG | 8545 | X82818 | H. sapiens PTP1C/HCP gene | Homo sapiens | 35,531 | Jun. 26, 1997 |
| | | GB_PR3:HS404G5 | 119737 | AL035695 | Human DNA sequence from clone 404G5 on chromosome 6q24.1-25.2. Contains part of a human estrogen receptor gene, STSs and GSSs, complete sequence. | Homo sapiens | 37,058 | Nov. 23, 1999 |
| rxa01799 | 1317 | GB_HTG3:AC010869 | 38000 | AC010869 | Leishmania major chromosome 35 clone L7195 strain Friedlin, **SEQUENCING IN PROGRESS**, 4 unordered pieces. | Leishmania major | 40,522 | Oct. 2, 1999 |
| | | GB_HTG3:AC010869 | 38000 | AC010869 | Leishmania major chromosome 35 clone L7195 strain Friedlin, **SEQUENCING IN PROGRESS**, 4 unordered pieces. | Leishmania major | 40,522 | Oct. 2, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01800 | 843 | GB_OM:SSU12574 | 2190 | U12574 | *Sus scrofa* myogenic regulatory factor MyoD (myoD) gene, complete cds. | *Sus scrofa* | 37,068 | Feb. 10, 1996 |
| | | GB_PH:C2PVCG | 22172 | L48605 | Bacteriophage c2 complete genome. | *Lactococcus bacteriophage c2* | 36,747 | Mar. 14, 1996 |
| rxa01803 | 1083 | GB_EST38:AQ066009 | 641 | AQ066009 | 687004F08.y1 687 - Early embryo from Delaware *Zea mays* cDNA, mRNA sequence. | *Zea mays* | 40,000 | Oct. 12, 1999 |
| | | GB_PH:C2PVCG | 22172 | L48605 | Bacteriophage c2 complete genome. | *Lactococcus bacteriophage c2* | 36,867 | Mar. 14, 1996 |
| | | GB_BA2:SC1 | 36925 | AL109962 | *Streptomyces coelicolor* cosmid J1. | *Streptomyces coelicolor A3(2)* | 54,267 | Sep. 24, 1999 |
| | | GB_BA1:PAU12891 | 4062 | U12891 | *Pseudomonas aeruginosa* PAO substrain OT684 pyoverdine gene transcriptional regulator PvdS (pvdS) gene, complete cds. | *Pseudomonas aeruginosa* | 37,841 | Oct. 3, 1996 |
| | | GB_HTG6:AC010203 | 230460 | AC010203 | *Homo sapiens* clone RP11-175P13, *SEQUENCING IN PROGRESS**, 48 unordered pieces. | *Homo sapiens* | 35,185 | Dec. 3, 1999 |
| rxa01804 | 444 | GB_EST24:AI189912 | 784 | AI189912 | qd33e07.x1 Soares_placenta_8to9weeks_2NbHP8to9W *Homo sapiens* cDNA clone IMAGE:1725540 3' similar to gb:Z23064_cds1 HETEROGENEOUS NUCLEAR RIBONUCLEOPROTEIN G (HUMAN); mRNA sequence. | *Homo sapiens* | 40,000 | Oct. 28, 1998 |
| | | GB_EST24:AI189912 | 784 | AI189912 | qd33e07.x1 Soares_placenta_8to9weeks_2NbHP8to9W *Homo sapiens* cDNA clone IMAGE:1725540 3' similar to gb:Z23064_cds1 HETEROGENEOUS NUCLEAR RIBONUCLEOPROTEIN G (HUMAN); mRNA sequence. | *Homo sapiens* | 35,294 | Oct. 28, 1998 |
| rxa01805 | 453 | GB_PR2:HSU73628 | 32289 | U73628 | Human chromosome 11 101h11 cosmid, complete sequence. | *Homo sapiens* | 36,099 | Jun. 19, 1997 |
| | | GB_PR2:HSU73628 | 32289 | U73628 | Human chromosome 11 101h11 cosmid, complete sequence. | *Homo sapiens* | 35,227 | Jun. 19, 1997 |
| rxa01806 | 603 | GB_IN1:CELK02E7 | 36535 | AF025465 | *Caenorhabditis elegans* cosmid K02E7. | *Caenorhabditis elegans* | 37,479 | Sep. 23, 1997 |
| | | GB_HTG3:AC011217 | 157261 | AC011217 | *Homo sapiens* clone 7_J_14, LOW-PASS SEQUENCE SAMPLING. | *Homo sapiens* | 33,333 | Oct. 3, 1999 |
| | | GB_HTG3:AC011217 | 157261 | AC011217 | *Homo sapiens* clone 7_J_14, LOW-PASS SEQUENCE SAMPLING. | *Homo sapiens* | 33,333 | Oct. 3, 1999 |
| rxa01809 | 1299 | GB_HTG3:AC010759 | 155875 | AC010759 | *Homo sapiens* clone 1_K_15, *SEQUENCING IN PROGRESS**, 15 unordered pieces. | *Homo sapiens* | 37,920 | Sep. 22, 1999 |
| | | GB_HTG3:AC010759 | 155875 | AC010759 | *Homo sapiens* clone 1_K_15, *SEQUENCING IN PROGRESS**, 15 unordered pieces. | *Homo sapiens* | 37,920 | Sep. 22, 1999 |
| | | GB_HTG2:AC006235 | 190842 | AC006235 | *Homo sapiens* clone hRPK.520_J_4, *SEQUENCING IN PROGRESS**, 5 unordered pieces. | *Homo sapiens* | 36,019 | Jul. 17, 1999 |
| rxa01813 | 789 | GB_PR4:AC004047 | 134649 | AC004047 | *Homo sapiens* chromosome 4 clone B15O14 map 4q25, complete sequence. | *Homo sapiens* | 36,205 | Dec. 1, 1998 |
| | | GB_HTG2:HS1012F16 | 74539 | AL080274 | *Homo sapiens* chromosome 20 clone RP5-1012F16, *SEQUENCING IN PROGRESS**, in unordered pieces. | *Homo sapiens* | 35,032 | Dec. 3, 1999 |
| | | GB_HTG2:HS1012F16 | 74539 | AL080274 | *Homo sapiens* chromosome 20 clone RP5-1012F16, *SEQUENCING IN PROGRESS**, in unordered pieces. | *Homo sapiens* | 35,032 | Dec. 3, 1999 |
| rxa01815 | 915 | GB_PR3:AC005740 | 186780 | AC005740 | *Homo sapiens* chromosome 5p, BAC clone 50g21 (LBNL H154), complete sequence. | *Homo sapiens* | 37,315 | Oct. 1, 1998 |
| | | GB_HTG3:AC008328 | 114617 | AC008328 | *Drosophila melanogaster* chromosome 2 clone BACR09A04 (D860) RPCI-98 09.A.4 map 28B-28C strain y; cn bw sp, *SEQUENCING IN PROGRESS**, 74 unordered pieces. | *Drosophila melanogaster* | 30,516 | Aug. 6, 1999 |
| | | GB_HTG3:AC008328 | 114617 | AC008328 | *Drosophila melanogaster* chromosome 2 clone BACR09A04 (D860) RPCI-98 09.A.4 map 28B-28C strain y; cn bw sp, *SEQUENCING IN PROGRESS**, 74 unordered pieces. | *Drosophila melanogaster* | 30,516 | Aug. 6, 1999 |
| rxa01816 | 855 | GB_PR3:AC003101 | 208396 | AC003101 | *Homo sapiens* chromosome 17, clone HRPC41C23, complete sequence. | *Homo sapiens* | 34,272 | Jun. 5, 1998 |
| | | GB_EST23:AI144656 | 492 | AI144656 | UI-R-BT0-pl-f-04-0-UI.s1 UI-R-BT0 *Rattus norvegicus* cDNA clone UI-R-BT0-pl-f-04-0-UI 3', mRNA sequence. | *Rattus norvegicus* | 37,526 | Jul. 5, 1999 |
| | | GB_GSS11:AQ341706 | 506 | AQ341706 | RPCI11-120J20.TJ RPCI-11 *Homo sapiens* genomic clone RPCI-11-120J20, genomic survey sequence. | *Homo sapiens* | 40,789 | May 6, 1999 |
| rxa01817 | 756 | GB_BA2:AF030176 | 7000 | AF030176 | *Rhodococcus opacus* putative transposase gene, partial cds; and putative FAD synthetase, putative short-chain dehydrogenase/reductase, maleylacetate reductase (macA), and putative transcription factor genes, complete cds. | *Rhodococcus opacus* | 42,577 | Aug. 5, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01820 | 1497 | GB_EST19:AA263350 | 423 | AA263350 | LD06495.5prime LD Drosophila melanogaster embryo BlueScript Drosophila melanogaster cDNA clone LD06495 5prime, mRNA sequence. | Drosophila melanogaster | 38,955 | Nov. 27, 1998 |
| | | GB_EST19:AA202194 | 368 | AA202194 | LD02304, 5prime LD Drosophila melanogaster embryo BlueScript Drosophila melanogaster cDNA clone LD02304 5prime, mRNA sequence. | Drosophila melanogaster | 39,891 | Nov. 27, 1998 |
| | | GB_BA2:AF030176 | 7000 | AF030176 | Rhodococcus opacus putative transposase gene, partial cds, and putative FAD synthetase, putative short-chain dehydrogenase/reductase, maleylacetate reductase (macA), and putative transcription factor genes, complete cds. | Rhodococcus opacus | 41,799 | Aug. 5, 1998 |
| | | GB_EST32:AI728582 | 686 | AI728582 | BNLGHi11124 Six-day Cotton fiber Gossypium hirsutum cDNA 5′ similar to (U64918) ATGP1 [Arabidopsis thaliana], mRNA sequence. | Gossypium hirsutum | 37,915 | Jun. 11, 1999 |
| | | GB_BA2:AF030176 | 7000 | AF030176 | Rhodococcus opacus putative transposase gene, partial cds; and putative FAD synthetase, putative short-chain dehydrogenase/reductase, maleylacetate reductase (macA), and putative transcription factor genes, complete cds. | Rhodococcus opacus | 37,127 | Aug. 5, 1998 |
| rxa01825 | 393 | GB_HTG1:HSJCF13 | 293368 | AJ239320 | Homo sapiens chromosome X clone cosmid 244B12 map Xq13, *SEQUENCING IN PROGRESS*, in ordered pieces. | Homo sapiens | 34,748 | Sep. 28, 1999 |
| | | GB_HTG1:HSJCF13 | 293368 | AJ239320 | Homo sapiens chromosome X clone cosmid 244B12 map Xq13, *SEQUENCING IN PROGRESS*, in ordered pieces. | Homo sapiens | 34,748 | Sep. 28, 1999 |
| | | GB_HTG1:AP000568 | 136627 | AP000568 | Homo sapiens chromosome 21 clone B753B2 map 21q21.2, *SEQUENCING IN PROGRESS*, in unordered pieces. | Homo sapiens | 34,884 | Oct. 7, 1999 |
| rxa01831 | 585 | GB_IN2:AF047757 | 408 | AF047757 | Trichogramma australicum internal transcribed spacer 2, complete sequence. | Trichogramma australicum | 38,390 | Jul. 10, 1998 |
| | | GB_EST18:AA687516 | 513 | AA687516 | ns58h11.r1 NCI_CGAP_Pr22 Homo sapiens cDNA clone IMAGE:1187877 5′ similar to gb:X15341 CYTOCHROME C OXIDASE POLYPEPTIDE VIA-LIVER (HUMAN); mRNA sequence. | Homo sapiens | 35,057 | Dec. 11, 1997 |
| | | GB_EST18:AA687516 | 513 | AA687516 | ns58h11.r1 NCI_CGAP_Pr22 Homo sapiens cDNA clone IMAGE:1187877 5′ similar to gb:X15341 CYTOCHROME C OXIDASE POLYPEPTIDE VIA-LIVER (HUMAN); mRNA sequence. | Homo sapiens | 37,624 | Dec. 11, 1997 |
| rxa01834 | 825 | GB_PL2:T8F5 | 87192 | AC004512 | Arabidopsis thaliana chromosome 1 BAC T8F5 sequence, complete sequence. | Arabidopsis thaliana | 38,101 | Jul. 22, 1998 |
| | | GB_PR4:AC007677 | 166949 | AC007677 | Homo sapiens clone NH0086N01, complete sequence. | Homo sapiens | 35,888 | Sep. 28, 1999 |
| | | GB_PR4:AC007677 | 166949 | AC007677 | Homo sapiens clone NH0086N01, complete sequence. | Homo sapiens | 36,906 | Sep. 28, 1999 |
| rxa01842 | 1041 | GB_HTG3:AC009183 | 145694 | AC009183 | Drosophila melanogaster chromosome 3 clone BACR39F04 (D839) RPCI-98 39.F.4 map 85F—85F strain y; cn bw sp, *SEQUENCING IN PROGRESS*, 139 unordered pieces. | Drosophila melanogaster | 40,430 | Sep. 16, 1999 |
| | | GB_HTG3:AC009183 | 145694 | AC009183 | Drosophila melanogaster chromosome 3 clone BACR39F04 (D839) RPCI-98 39.F.4 map 85F—85F strain y; cn bw sp, *SEQUENCING IN PROGRESS*, 139 unordered pieces. | Drosophila melanogaster | 40,430 | Sep. 16, 1999 |
| | | GB_HTG5:AC008338 | 136685 | AC008338 | Drosophila melanogaster chromosome X clone BACR30J04 (D908) RPCI-98 30.J.4 map 19C—19E strain y; cn bw sp, *SEQUENCING IN PROGRESS*, 93 unordered pieces. | Drosophila melanogaster | 40,527 | Nov. 15, 1999 |
| rxa01844 | 303 | GB_HTG2:AC007597 | 163880 | AC007597 | Homo sapiens chromosome 16 clone RPCI-11_137H10, *SEQUENCING IN PROGRESS*, 3 ordered pieces. | Homo sapiens | 34,564 | Jul. 20, 1999 |
| | | GB_HTG2:AC007597 | 163880 | AC007597 | Homo sapiens chromosome 16 clone RPCI-11_137H10, *SEQUENCING IN PROGRESS*, 3 ordered pieces. | Homo sapiens | 34,564 | Jul. 20, 1999 |
| | | GB_HTG3:AC009998 | 163590 | AC009998 | Homo sapiens chromosome 15 clone BAC 573G7 map 15q24, LOW-PASS SEQUENCE SAMPLING. | Homo sapiens | 40,816 | Sep. 10, 1999 |
| rxa01845 | 531 | GB_OV:AF012348 | 4921 | AF012348 | Gallus gallus smooth muscle gamma actin (gamma actin) gene, complete cds. | Gallus gallus | 37,333 | Mar. 17, 1998 |
| | | GB_BA1:D85417 | 7984 | D85417 | Propionibacterium freudenreichii hemY, hemH, hemB, hemX, hemR and hemL genes, complete cds. | Propionibacterium freudenreichii | 45,243 | Feb. 6, 1999 |
| | | GB_BA1:D85417 | 7984 | D85417 | Propionibacterium freudenreichii hemY, hemH, hemB, hemX, hemR and hemL genes, complete cds. | Propionibacterium freudenreichii | 40,232 | Feb. 6, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01846 | 382 | GB_HTG1:HSJ323A24 | 278948 | AL121750 | Homo sapiens chromosome 4 clone RP3-323A24, *SEQUENCING IN PROGRESS*, in unordered pieces. | Homo sapiens | 34,840 | Nov. 23, 1999 |
| | | GB_HTG1:HSJ323A24 | 278948 | AL121750 | Homo sapiens chromosome 4 clone RP3-323A24, *SEQUENCING IN PROGRESS*, in unordered pieces. | Homo sapiens | 34,840 | Nov. 23, 1999 |
| | | GB_PR2:HS181C9 | 92472 | Z98743 | Human DNA sequence from clone 181C9 on chromosome 22q13.2-13.33. Contains a PHAPI2 Leucine Rich Acidic Nuclear Protein pseudogene, part of a putative novel gene, ESTs, STSs and GSSs, complete sequence. | Homo sapiens | 42,480 | Nov. 23, 1999 |
| rxa01847 | 858 | GB_PR3:AC004893 | 103738 | AC004893 | Homo sapiens PAC clone DJ0808A01 from 7q21.1-q31.1, complete sequence. | Homo sapiens | 38,321 | Oct. 3, 1998 |
| | | GB_HTG4:AC010182_3 | 110000 | AC010182 | Homo sapiens chromosome 12q seeders clone RPCI11-185N2, *SEQUENCING IN PROGRESS*, 172 unordered pieces. | Homo sapiens | 36,998 | Sep. 15, 1999 |
| | | GB_HTG4:AC010182_3 | 110000 | AC010182 | Homo sapiens chromosome 12q seeders clone RPCI11-185N2, *SEQUENCING IN PROGRESS*, 172 unordered pieces. | Homo sapiens | 36,998 | Sep. 15, 1999 |
| rxa01856 | 669 | GB_GSS15:AQ612487 | 433 | AQ612487 | HS_5122_A1_B07_SP6E RPCI-11 Human Male BAC Library Homo sapiens genomic clone Plate = 698 Col = 13 Row = C, genomic survey sequence. | Homo sapiens | 39,723 | Jun. 15, 1999 |
| | | GB_PR4:AC005876 | 89817 | AC005876 | citb_188_i_5, complete sequence. | Homo sapiens | 39,567 | Nov. 5, 1999 |
| | | GB_PR4:AC005876 | 89817 | AC005876 | citb_188_i_5, complete sequence. | Homo sapiens | 36,677 | Nov. 5, 1999 |
| rxa01857 | 774 | GB_PR3:HS742C19 | 122748 | AL031846 | Human DNA sequence from clone RP4-742C19 on chromosome 22, complete sequence. | Homo sapiens | 33,506 | Nov. 29, 1999 |
| | | GB_PR2:HSJ100I6 | 161525 | AL110503 | Human DNA sequence from clone RP5-1100I6 on chromosome 20 Contains a novel mRNA, GSSs and a CpG Island, complete sequence. | Homo sapiens | 37,450 | Nov. 22, 1999 |
| | | GB_HTG6:AC009893 | 186769 | AC009893 | Homo sapiens chromosome 8 clone RP11-4P3, *SEQUENCING IN PROGRESS*, 5 unordered pieces. | Homo sapiens | 37,368 | Nov. 23, 1999 |
| rxa01858 | | | | | | | | |
| rxa01870 | 798 | GB_RO:AC004155 | 128026 | AC004155 | Mus musculus DNA from BAC 10818 containing the Ercc-4 gene, complete sequence. | Mus musculus | 37,387 | Feb. 19, 1998 |
| | | GB_RO:AC004155 | 128026 | AC004155 | Mus musculus DNA from BAC 10818 containing the Ercc-4 gene, complete sequence. | Mus musculus | 37,707 | Feb. 19, 1998 |
| | | GB_BA2:AF144563 | 5971 | AF144563 | Thermobifida fusca beta-1,4-exocellulase E6 precursor (celF) gene, complete cds; and unknown genes. | Thermobifida fusca | 38,619 | Jun. 21, 1999 |
| rxa01871 | 1086 | GB_BA2:AF079304 | 3350 | AF079304 | Eikenella corrodens type IV pilin (pilA1), type IV pilin (pilA2), putative fimbrial protein (pilB), and putative hemagglutinin protein (hagA) genes, complete cds. | Eikenella corrodens | 40,465 | Jul. 15, 1999 |
| | | GB_BA1:ECECPHAG | 3589 | Z12609 | E. corrodens eepA and eepB genes encoding type 4 N-methylphenylalanine pilin and hag1 gene for hemagglutinin protein. | Eikenella corrodens | 40,517 | Aug. 5, 1992 |
| rxa01874 | 448 | GB_BA2:AE001707 | 19518 | AE001707 | Thermotoga maritima section 19 of 136 of the complete genome. | Thermotoga maritima | 38,124 | Jun. 2, 1999 |
| | | GB_EST6:N51407 | 505 | N51407 | yz17a08.s1 Soares_multiple_sclerosis_2NbHMSP Homo sapiens cDNA clone IMAGE:283286 3', mRNA sequence. | Homo sapiens | 35,735 | Feb. 14, 1996 |
| rxa01875 | 969 | GB_EST29:AI619782 | 374 | AI619782 | ty53b03.x1 NCI_CGAP_Ut2 Homo sapiens cDNA clone IMAGE:2282765 3', mRNA sequence. | Homo sapiens | 38,966 | Apr. 21, 1999 |
| | | GB_EST36:AI885047 | 466 | AI885047 | wl89a01.x1 NCI_CGAP_Bm25 Homo sapiens cDNA clone IMAGE:2432040 3', mRNA sequence. | Homo sapiens | 37,419 | Sep. 1, 1999 |
| | | GB_EST13:AA356276 | 291 | AA356276 | EST64843 Jurkat T-cells VI Homo sapiens cDNA 5' end, mRNA sequence. | Homo sapiens | 41,667 | Apr. 21, 1997 |
| | | GB_EST22:AI050653 | 443 | AI050653 | ub38t03.r1 Soares 2NbMT Mus musculus cDNA clone IMAGE:1380029 5', mRNA sequence. | Mus musculus | 38,851 | Jul. 9, 1998 |
| | | GB_GSS1:CNS0022Z | 1101 | AL061786 | Drosophila melanogaster genome survey sequence T7 end of BAC # BACR05B21 of RPCI-98 library from Drosophila melanogaster (fruit fly), genomic survey sequence. | Drosophila melanogaster | 39,039 | Jun. 3, 1999 |
| rxa01877 | 1194 | GB_HTG4:AC009849 | 114993 | AC009849 | Drosophila melanogaster chromosome 2 clone BACR07H08 (D864) RPCI-98 07.H.8 map 31B–31C strain y; cn bw sp, *SEQUENCING IN PROGRESS*, 55 unordered pieces. | Drosophila melanogaster | 37,274 | Oct. 25, 1999 |
| | | GB_HTG4:AC009849 | 114993 | AC009849 | Drosophila melanogaster chromosome 2 clone BACR07H08 (D864) RPCI-98 07.H.8 map 31B–31C strain y; cn bw sp, *SEQUENCING IN PROGRESS*, 55 unordered pieces. | Drosophila melanogaster | 37,274 | Oct. 25, 1999 |
| | | GB_IN2:AC005454 | 84367 | AC005454 | Drosophila melanogaster, chromosome 2R, region 31C1-31D6, P1 clone DS08879, complete | Drosophila melanogaster | 38,679 | Dec. 15, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01879 | 1056 | GB_PR2:CNS0000Q | 192932 | AL049874 | Human chromosome 14 DNA sequence **IN PROGRESS** BAC R-1042B17 of RPCI-11 library from chromosome 14 of Homo sapiens (Human), complete sequence. | Homo sapiens | 37,094 | Jul. 7, 1999 |
| | | GB_HTG2:AC006732 | 159453 | AC006732 | Caenorhabditis elegans clone Y32G9, **SEQUENCING IN PROGRESS**, 9 unordered pieces. | Caenorhabditis elegans | 34,862 | Feb. 23, 1999 |
| | | GB_HTG2:AC006732 | 159453 | AC006732 | Caenorhabditis elegans clone Y32G9, **SEQUENCING IN PROGRESS**, 9 unordered pieces. | Caenorhabditis elegans | 34,862 | Feb. 23, 1999 |
| rxa01896 | 759 | GB_BA1:SC2G5 | 38404 | AL035478 | Streptomyces coelicolor cosmid 2G5. | Streptomyces coelicolor | 38,420 | Jun. 11, 1999 |
| | | GB_PL1:AP000570 | 157903 | AP000570 | Oryza sativa genomic DNA, chromosome 1, clone:P0711E10. | Oryza sativa | 40,272 | Dec. 3, 1999 |
| | | GB_BA1:SC2G5 | 38404 | AL035478 | Streptomyces coelicolor cosmid 2G5. | Streptomyces coelicolor | 40,270 | Jun. 11, 1999 |
| rxa01899 | 909 | GB_BA1:MTV002 | 56414 | AL008967 | Mycobacterium tuberculosis H37Rv complete genome; segment 122/162. | Mycobacterium tuberculosis | 38,702 | Jun. 17, 1998 |
| | | GB_BA1:MTV002 | 56414 | AL008967 | Mycobacterium tuberculosis H37Rv complete genome; segment 122/162. | Mycobacterium tuberculosis | 38,229 | Jun. 17, 1998 |
| rxa01902 | 1182 | GB_HTG6:AC009893 | 186769 | AC009893 | Homo sapiens chromosome 8 clone RP11-4P3, *SEQUENCING IN PROGRESS*, 5 unordered pieces. | Homo sapiens | 34,868 | Nov. 23, 1999 |
| | | GB_OV:D84063 | 2363 | D84063 | Oryzias latipes Bf/C2 mRNA, complete cds. | Oryzias latipes | 38,074 | Feb. 6, 1999 |
| | | GB_HTG6:AC009893 | 186769 | AC009893 | Homo sapiens chromosome 8 clone RP11-4P3, *SEQUENCING IN PROGRESS*, 5 unordered pieces. | Homo sapiens | 35,616 | Nov. 23, 1999 |
| rxa01903 | 302 | GB_BA1:MSGILVB | 4210 | L49392 | Mycobacterium avium acetolactate synthase (ilvBN) and acetohydroxy acid isomeroreductase (ilvC) gene, complete cds. | Mycobacterium avium | 38,667 | Dec. 11, 1996 |
| | | GB_PR3:AC004833 | 68890 | AC004833 | Homo sapiens PAC clone DJ0547C10 from 7p21-p22, complete sequence. | Homo sapiens | 34,615 | Nov. 5, 1998 |
| | | GB_PR3:AC004833 | 68890 | AC004833 | Homo sapiens PAC clone DJ0547C10 from 7p21-p22, complete sequence. | Homo sapiens | 42,712 | Nov. 5, 1998 |
| rxa01904 | 546 | GB_HTG2:AC006740 | 200965 | AC006740 | Caenorhabditis elegans clone Y38B5, *SEQUENCING IN PROGRESS*, 12 unordered pieces. | Caenorhabditis elegans | 34,074 | Feb. 25, 1999 |
| | | GB_HTG2:AC006695 | 33622 | AC006695 | Caenorhabditis elegans clone W06H8, **SEQUENCING IN PROGRESS**, 1 unordered pieces. | Caenorhabditis elegans | 35,556 | Feb. 23, 1999 |
| | | GB_HTG2:AC006695 | 33622 | AC006695 | Caenorhabditis elegans clone W06H8, *SEQUENCING IN PROGRESS*, 1 unordered pieces. | Caenorhabditis elegans | 35,556 | Feb. 23, 1999 |
| rxa01905 | 654 | GB_IN1:CEW04G3 | 32158 | Z68014 | Caenorhabditis elegans cosmid W04G3, complete sequence. | Caenorhabditis elegans | 38,730 | Sep. 2, 1999 |
| | | GB_PL2:AF067082 | 8947 | AF067082 | Apium graveolens mannitol dehydrogenase (Mtd) gene, complete cds. | Apium graveolens | 38,242 | Sep. 30, 1998 |
| | | GB_IN1:CEW04G3 | 32158 | Z68014 | Caenorhabditis elegans cosmid W04G3, complete sequence. | Caenorhabditis elegans | 36,634 | Sep. 2, 1999 |
| rxa01906 | 588 | GB_PL1:AB012242 | 78973 | AB012242 | Arabidopsis thaliana genomic DNA, chromosome 5, TAC clone: K24G6, complete sequence. | Arabidopsis thaliana | 39,071 | Nov. 20, 1999 |
| | | GB_EST6:N49608 | 454 | N49608 | yy58g01.s1 Soares_multiple_sclerosis_2NbHMSP Homo sapiens cDNA clone IMAGE:277776 Homo sapiens 3', mRNA sequence. | Homo sapiens | 43,603 | Feb. 14, 1996 |
| | | GB_EST6:N49609 | 452 | N49609 | yy58g02.s1 Soares_multiple_sclerosis_2NbHMSP Homo sapiens cDNA clone IMAGE:277778 Homo sapiens 3', mRNA sequence. | Homo sapiens | 43,307 | Feb. 14, 1996 |
| rxa01907 | 735 | GB_HTG3:AC009437 | 159691 | AC009437 | Homo sapiens chromosome 11 clone 56_G_09 map 11, *SEQUENCING IN PROGRESS*, 10 unordered pieces. | Homo sapiens | 36,226 | Aug. 22, 1999 |
| | | GB_HTG3:AC009437 | 159691 | AC009437 | Homo sapiens chromosome 11 clone 56_G_09 map 11, *SEQUENCING IN PROGRESS*, 10 unordered pieces. | Homo sapiens | 36,226 | Aug. 22, 1999 |
| | | GB_HTG3:AC009437 | 159691 | AC009437 | Homo sapiens chromosome 11 clone 56_G_09 map 11, *SEQUENCING IN PROGRESS*, 10 unordered pieces. | Homo sapiens | 38,483 | Aug. 22, 1999 |
| rxa01908 | 969 | GB_PR3:HS90G24 | 154414 | AL008723 | Human DNA sequence from clone 90G24 on chromosome 22. Contains the RFPL2 gene for RET finger protein-like 2, an immunoglobulin Lambda Light Chain C region (IGLC) pseudogene, the gene for SAAT1 (low affinity sodium glucose cotransporter | Homo sapiens | 37,331 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_EST25:AI316482 | 972 | AI316482 | (sodium:solute symporter family)) and a Cleavage and Polyadenylation Specific Factor CPSF 160 kD subunit pseudogene. Contains ESTs, GSSs and three putative CpG islands, complete sequence. uj60g12.y1 Sugano mouse liver mlia *Mus musculus* cDNA clone IMAGE:1924390 5' similar to gb:M12529 APOLIPOPROTEIN E PRECURSOR (HUMAN); gb:D00466 Mouse apolipoprotein E gene (MOUSE); mRNA sequence. | *Mus musculus* | 36,800 | Dec. 17, 1998 |
| rxa01909 | 970 | GB_EST27:AI398904 | 556 | AI398904 | NCW10G7T7 Westergaards *Neurospora crassa* cDNA clone W10G7 3', mRNA sequence. | *Neurospora crassa* | 38,095 | Feb. 8, 1999 |
| | | GB_HTG1:HSI658I14 | 133423 | AL109845 | *Homo sapiens* chromosome 1 clone RP4-658I14, *SEQUENCING IN PROGRESS*, in unordered pieces. | *Homo sapiens* | 40,520 | Nov. 23, 1999 |
| | | GB_HTG1:HSI658I14 | 133423 | AL109845 | *Homo sapiens* chromosome 1 clone RP4-658I14, *SEQUENCING IN PROGRESS*, in unordered pieces. | *Homo sapiens* | 40,520 | Nov. 23, 1999 |
| | | GB_HTG1:HSI658I14 | 133423 | AL109845 | *Homo sapiens* chromosome 1 clone RP4-658I14, *SEQUENCING IN PROGRESS*, in unordered pieces. | *Homo sapiens* | 36,364 | Nov. 23, 1999 |
| rxa01910 | 969 | GB_PR2:CNS00006 | 218956 | AL049831 | Human chromosome 14 DNA sequence *IN PROGRESS* BAC R-330O19 of RPCI-11 library from chromosome 14 of *Homo sapiens* (Human), complete sequence. | *Homo sapiens* | 35,393 | Jun. 29, 1999 |
| | | GB_PR2:CNS00006 | 218956 | AL049831 | Human chromosome 14 DNA sequence *IN PROGRESS* BAC R-330O19 of RPCI-11 library from chromosome 14 of *Homo sapiens* (Human), complete sequence. | *Homo sapiens* | 38,405 | Jun. 29, 1999 |
| | | GB_HTG5:AC009217 | 118561 | AC009217 | *Drosophila melanogaster* chromosome X clone BACR41N19 (D907) RPCI-98 41.N.19 map 19A–19C strain y; cn bw sp, *SEQUENCING IN PROGRESS*, 78 unordered pieces. | *Drosophila melanogaster* | 36,765 | Nov. 16, 1999 |
| rxa01911 | 1062 | GB_HTG2:AC002317 | 94882 | AC002317 | *Homo sapiens* chromosome 17 clone HCIT7H10 map 17, *SEQUENCING IN PROGRESS*, 8 unordered pieces. | *Homo sapiens* | 36,654 | Feb. 20, 1998 |
| | | GB_HTG2:AC002317 | 94882 | AC002317 | *Homo sapiens* chromosome 17 clone HCIT7H10 map 17, *SEQUENCING IN PROGRESS*, 8 unordered pieces. | *Homo sapiens* | 36,654 | Feb. 20, 1998 |
| | | GB_HTG2:AC002317 | 94882 | AC002317 | *Homo sapiens* chromosome 17 clone HCIT7H10 map 17, *SEQUENCING IN PROGRESS*, 8 unordered pieces. | *Homo sapiens* | 37,012 | Feb. 20, 1998 |
| rxa01923 | 873 | GB_HTG2:AC006844 | 299782 | AC006844 | *Caenorhabditis elegans* clone Y108G3Y, *SEQUENCING IN PROGRESS*, 4 unordered pieces. | *Caenorhabditis elegans* | 37,176 | Feb. 24, 1999 |
| | | GB_HTG2:AC006844 | 299782 | AC006844 | *Caenorhabditis elegans* clone Y108G3Y, *SEQUENCING IN PROGRESS*, 4 unordered pieces. | *Caenorhabditis elegans* | 37,176 | Feb. 24, 1999 |
| rxa01930 | 1074 | GB_BA1:ECOUW76 | 225419 | U00039 | *E. coli* chromosomal region from 76.0 to 81.5 minutes. | *Escherichia coli* | 38,902 | Nov. 7, 1996 |
| | | GB_BA1:CGPAN | 2164 | X96580 | *C. glutamicum* panB, panC & xylB genes. | *Corynebacterium glutamicum* | 100,000 | May 11, 1999 |
| | | GB_HTG2:AC007598 | 248427 | AC007598 | *Homo sapiens* chromosome 16 clone 165M1, *SEQUENCING IN PROGRESS*, 105 unordered pieces. | *Homo sapiens* | 38,469 | May 20, 1999 |
| | | GB_HTG2:AC007598 | 248427 | AC007598 | *Homo sapiens* chromosome 16 clone 165M1, *SEQUENCING IN PROGRESS*, 105 unordered pieces. | *Homo sapiens* | 38,469 | May 20, 1999 |
| rxa01931 | 777 | GB_IN1:CEH12I19 | 37427 | Z98851 | *Caenorhabditis elegans* cosmid H12I19, complete sequence. | *Caenorhabditis elegans* | 32,763 | Dec. 18, 1998 |
| | | GB_HTG1:CEY37A1 | 316170 | Z93243 | *Caenorhabditis elegans* chromosome IV clone Y37A1, *SEQUENCING IN PROGRESS*, in unordered pieces. | *Caenorhabditis elegans* | 32,763 | Dec. 3, 1998 |
| | | GB_HTG1:CEY37A1 | 316170 | Z93243 | *Caenorhabditis elegans* chromosome IV clone Y37A1, *SEQUENCING IN PROGRESS*, in unordered pieces. | *Caenorhabditis elegans* | 32,763 | Dec. 3, 1998 |
| rxa01941 | 558 | GB_EST25:AI313927 | 520 | AI313927 | uj38h06.x1 Sugano mouse kidney mkia *Mus musculus* cDNA clone IMAGE:1922267 3' similar to TR:O09047 O09047 COMPLEMENT COMPONENT 3A RECEPTOR 1; mRNA sequence. | *Mus musculus* | 41,148 | Dec. 17, 1998 |
| | | GB_RO:AF053757 | 8308 | AF053757 | *Mus musculus* complement C3a anaphylatoxin receptor (C3ar) gene, complete cds. | *Mus musculus* | 38,649 | Jul. 30, 1998 |
| | | GB_RO:MMU77461 | 2657 | U77461 | *Mus musculus* anaphylatoxin C3a receptor gene, complete cds. | *Mus musculus* | 38,649 | May 28, 1997 |
| rxa01942 | 723 | GB_BA1:BRLPTSG | 3163 | L18875 | *Brevibacterium lactofermentum* phosphoenolpyruvate sugar phosphotransferase (ptsG) gene, | *Brevibacterium* | 67,407 | Oct. 1, 1993 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | | | | complete cds. | lactofermentum | 100,000 | Nov. 24, 1994 |
| | | GB_BA1:CORPTSMA | 2656 | L18874 | *Corynebacterium glutamicum* phosphoenolpyruvate sugar phosphotransferase (ptsM) mRNA, complete cds. | *Corynebacterium glutamicum* | 37,008 | Nov. 24, 1994 |
| | | GB_BA1:CORPTSMA | 2656 | L18874 | *Corynebacterium glutamicum* phosphoenolpyruvate sugar phosphotransferase (ptsM) mRNA, complete cds. | *Corynebacterium glutamicum* | | |
| rxa01944 | 1095 | GB_HTG2:AC004840 | 162485 | AC004840 | *Homo sapiens* clone DJ0607J02, *SEQUENCING IN PROGRESS*, 12 unordered pieces. | *Homo sapiens* | 36,287 | Jun. 12, 1998 |
| | | GB_HTG2:AC004840 | 162485 | AC004840 | *Homo sapiens* clone DJ0607J02, *SEQUENCING IN PROGRESS*, 12 unordered pieces. | *Homo sapiens* | 36,287 | Jun. 12, 1998 |
| | | GB_VI:MCU60315 | 190289 | U60315 | Molluscum contagiosum virus subtype 1, complete genome. | Molluscum contagiosum virus subtype 1 | 37,650 | Aug. 17, 1996 |
| rxa01945 | 2115 | GB_GSS15:AQ632158 | 445 | AQ632158 | RPCI-11-473F7.TJ RPCI-11 *Homo sapiens* genomic clone RPCI-11-473F7, genomic survey sequence. | *Homo sapiens* | 38,095 | Jun. 17, 1999 |
| | | GB_GSS15:AQ632158 | 445 | AQ632158 | RPCI-11-473F7.TJ RPCI-11 *Homo sapiens* genomic clone RPCI-11-473F7, genomic survey sequence. | *Homo sapiens* | 40,275 | Jun. 17, 1999 |
| rxa01957 | 585 | GB_EST16:C35275 | 300 | C35275 | C35275 Yuji Kohara unpublished cDNA:Strain N2 hermaphrodite embryo *Caenorhabditis elegans* cDNA clone yk427e6 3′, mRNA sequence. | *Caenorhabditis elegans* | 37,698 | Oct. 18, 1999 |
| | | GB_IN2:CELC29H12 | 42635 | U23169 | *Caenorhabditis elegans* cosmid C29H12. | *Caenorhabditis elegans* | 34,477 | Jul. 13, 1995 |
| | | GB_GSS1:CNS00GP0 | 1101 | AL072364 | *Drosophila melanogaster* genome survey sequence T7 end of BAC:BACR33I08 of RPCI-98 library from *Drosophila melanogaster* (fruit fly), genomic survey sequence. | *Drosophila melanogaster* | 34,321 | Jun. 3, 1999 |
| rxa01958 | 630 | GB_PR1:HSIL1RECA | 12565 | X64532 | *H. sapiens* gene for interleukin-1 receptor antagonist. | *Homo sapiens* | 42,079 | Jun. 25, 1997 |
| | | GB_PR3:HSU65590 | 33414 | U65590 | *Homo sapiens* IL-1 receptor antagonist IL-1Ra (IL-1RN) gene, alternatively spliced forms, complete cds. | *Homo sapiens* | 42,079 | Dec. 21, 1997 |
| | | GB_GSS11:AQ293677 | 476 | AQ293677 | HS_2254_A2_C03_MF CIT Approved Human Genomic Sperm Library D *Homo sapiens* genomic clone Plate = 2254 Col = 6 Row = E, genomic survey sequence. | *Homo sapiens* | 36,772 | Dec. 15, 1998 |
| rxa01959 | | | | | | | | |
| rxa01960 | | | | | | | | |
| rxa01961 | 603 | GB_BA2:U67460 | 12589 | U67460 | *Methanococcus jannaschii* section 2 of 150 of the complete genome. | *Methanococcus jannaschii* | 36,013 | Jan. 28, 1998 |
| | | GB_EST25:AI260761 | 626 | AI260761 | LP04729.3prime LP *Drosophila melanogaster* larval-early pupal pOT2 *Drosophila melanogaster* cDNA clone LP04729 3prime, mRNA sequence. | *Drosophila melanogaster* | 39,130 | Nov. 17, 1998 |
| | | GB_EST25:AI294890 | 554 | AI294890 | LP08371.3prime LP *Drosophila melanogaster* larval-early pupal pOT2 *Drosophila melanogaster* cDNA clone LP08371 3prime, mRNA sequence. | *Drosophila melanogaster* | 38,940 | Dec. 1, 1998 |
| rxa01962 | 693 | GB_BA2:U67460 | 12589 | U67460 | *Methanococcus jannaschii* section 2 of 150 of the complete genome. | *Methanococcus jannaschii* | 34,795 | Jan. 28, 1998 |
| | | GB_BA2:U67460 | 12589 | U67460 | *Methanococcus jannaschii* section 2 of 150 of the complete genome. | *Methanococcus jannaschii* | 37,666 | Jan. 28, 1998 |
| rxa01963 | 784 | GB_PR4:AC006397 | 91460 | AC006397 | *Homo sapiens* BAC clone GS170I02 from 7p21-p15.1, complete sequence. | *Homo sapiens* | 35,401 | Feb. 17, 1999 |
| | | GB_PR3:AC005565 | 39441 | AC005565 | *Homo sapiens* chromosome 16, cosmid clone 444B9 (LANL), complete sequence. | *Homo sapiens* | 37,891 | Aug. 30, 1998 |
| | | GB_PR2:D86999 | 40778 | D86999 | *Homo sapiens* immunoglobulin lambda gene locus DNA, clone:22A12. | *Homo sapiens* | 38,212 | Nov. 5, 1999 |
| rxa01964 | 1426 | GB_GSS13:AQ465174 | 437 | AQ465174 | HS_5109_A2_C07_SP6E RPCI-11 Human Male BAC Library *Homo sapiens* genomic clone Plate = 685 Col = 14 Row = E, genomic survey sequence. | *Homo sapiens* | 40,084 | Apr. 23, 1999 |
| | | GB_GSS13:AQ457528 | 599 | AQ457528 | HS_5087_A1_H06_SP6E RPCI-11 Human Male BAC Library *Homo sapiens* genomic clone Plate = 663 Col = 11 Row = O, genomic survey sequence. | *Homo sapiens* | 36,728 | Apr. 23, 1999 |
| | | GB_GSS13:AQ454028 | 527 | AQ454028 | HS_5171_B1_D12_T7A RPCI-11 Human Male BAC Library *Homo sapiens* genomic clone Plate = 747 Col = 23 Row = H, genomic survey sequence. | *Homo sapiens* | 37,137 | Apr. 21, 1999 |
| rxa01965 | 684 | GB_IN2:AC004283 | 80095 | AC004283 | *Drosophila melanogaster* DNA sequence (P1 DS05557 (D152)), complete sequence. | *Drosophila melanogaster* | 36,982 | Aug. 29, 1998 |
| | | GB_EST28:AI541584 | 585 | AI541584 | SD02734.5prime SD *Drosophila melanogaster* Schneider L2 cell culture pOT2 *Drosophila melanogaster* cDNA clone SD02734 5prime, mRNA sequence. | *Drosophila melanogaster* | 38,375 | Mar. 22, 1999 |
| | | GB_EST22:AI013385 | 434 | AI013385 | EST208060 Normalized rat spleen, Bento Soares *Rattus sp.* cDNA clone RSPBK32 3′ end, mRNA sequence. | *Rattus sp.* | 42,126 | Jan. 31, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01966 | 780 | GB_GSS1:CNS00AMI | 810 | AL055260 | *Drosophila melanogaster* genome survey sequence TET3 end of BAC # BACR21F10 of RPCI-98 library from *Drosophila melanogaster* (fruit fly), genomic survey sequence. | *Drosophila melanogaster* | 37,592 | Jun. 4, 1999 |
| | | GB_HTG3:AC009567 | 164147 | AC009567 | *Homo sapiens* chromosome 4 clone 21_G_20 map 4, **SEQUENCING IN PROGRESS**, 14 unordered pieces. | *Homo sapiens* | 35,844 | Sep. 29, 1999 |
| | | GB_HTG3:AC009567 | 164147 | AC009567 | *Homo sapiens* chromosome 4 clone 21_G_20 map 4, **SEQUENCING IN PROGRESS**, 14 unordered pieces. | *Homo sapiens* | 35,844 | Sep. 29, 1999 |
| rxa01968 | 1281 | GB_PR4:AC005146 | 157653 | AC005146 | *Homo sapiens* 12q24.2 PAC RPCI1-157K6 (Roswell Park Cancer Institute Human PAC library) complete sequence. | *Homo sapiens* | 40,620 | Nov. 11, 1998 |
| | | GB_PR4:AC006549 | 174844 | AC006549 | *Homo sapiens*, complete sequence. | *Homo sapiens* | 34,202 | Nov. 26, 1999 |
| | | GB_PR2:HSAC002070 | 165197 | AC002070 | Human BAC clone 7E17 from 12q, complete sequence. | *Homo sapiens* | 36,482 | May 12, 1997 |
| rxa01969 | 489 | GB_SY:SCU53587 | 4546 | U53587 | Artificial *Corynebacterium glutamicum* IS1207-derived transposon transposase genes, complete cds, and 3'5"-aminoglycoside phosphotransferase (aphA-3) gene, complete cds. | synthetic construct | 98,160 | May 6, 1996 |
| | | GB_PAT:I43826 | 1452 | I43826 | Sequence 1 from U.S. Pat. No. 5633154. | Unknown. | 98,963 | Oct. 7, 1997 |
| | | GB_BA1:CGIS1207 | 1453 | X96962 | *C. glutamicum* insertion sequence IS1207 and transposase gene. | *Corynebacterium glutamicum* | 98,755 | May 1, 1997 |
| rxa01973 | | | | | | | | |
| rxa01974 | 1908 | GB_PL1:SC9320A | 24000 | Z68329 | *S. cerevisiae* chromosome IV cosmid 9320A. | *Saccharomyces cerevisiae* | 36,528 | Aug. 11, 1997 |
| | | GB_PL1:SC9320X | 22253 | Z70202 | *S. cerevisiae* chromosome IV cosmid 9320X. | *Saccharomyces cerevisiae* | 36,528 | Aug. 11, 1997 |
| | | GB_PR4:AC006210 | 186986 | AC006210 | *Homo sapiens* Xp22-150 BAC GSHB-309P15 (Genome Systems Human BAC Library) complete sequence. | *Homo sapiens* | 38,351 | Dec. 31, 1998 |
| rxa01976 | 1644 | GB_BA2:CGU13922 | 4412 | U13922 | *Corynebacterium glutamicum* putative type II 5-cytosine methyltransferase (cgIM) and putative type II restriction endonuclease (cgIIR) and putative type I or type III restriction endonuclease (cgIIIR) genes, complete cds. | *Corynebacterium glutamicum* | 47,727 | Feb. 3, 1998 |
| | | GB_BA2:CGU13922 | 4412 | U13922 | *Corynebacterium glutamicum* putative type II 5-cytosine methyltransferase (cgIM) and putative type II restriction endonuclease (cgIIR) and putative type I or type III restriction endonuclease (cgIIIR) genes, complete cds. | *Corynebacterium glutamicum* | 37,515 | Feb. 3, 1998 |
| rxa01977 | 899 | GB_PR3:HS426F10 | 91640 | AL023586 | Human DNA sequence from clone 426F10 on chromosome 1p36.21-36.33 Contains EST, CA repeat, STS, complete sequence. | *Homo sapiens* | 38,295 | Nov. 23, 1999 |
| | | GB_GSS6:AQ823696 | 587 | AQ823696 | HS_3228_A1_D10_T7C CIT Approved Human Genomic Sperm Library D *Homo sapiens* genomic clone Plate = 3228 Col = 19 Row = G, genomic survey sequence. | *Homo sapiens* | 37,637 | Aug. 26, 1999 |
| | | GB_VI:HS3DNA1 | 892 | M29629 | Varicella-zoster virus (VZV) DNA, 5' end. | Human herpesvirus 3 | 33,857 | Aug. 2, 1993 |
| rxa01982 | 1281 | GB_EST8:AA009257 | 472 | AA009257 | mh02g07.r1 Soares mouse embryo NbME 13.5 14.5 *Mus musculus* cDNA clone IMAGE:441372 5', mRNA sequence. | *Mus musculus* | 36,017 | Jul. 26, 1996 |
| | | GB_EST8:AA009257 | 472 | AA009257 | mh02g07.r1 Soares mouse embryo NbME 13.5 14.5 *Mus musculus* cDNA clone IMAGE:441372 5', mRNA sequence. | *Mus musculus* | 38,710 | Jul. 26, 1996 |
| rxa01987 | 336 | GB_PR4:AC009330 | 174768 | AC009330 | *Homo sapiens* clone RP11-83M17 from 7q31, complete sequence. | *Homo sapiens* | 33,036 | Dec. 9, 1999 |
| | | GB_HTG6:AC007300 | 171472 | AC007300 | *Drosophila melanogaster* chromosome 2 clone BACR09I15 (D570) RPCI-98 09.I.15 map 32A—32A strain y; cn bw sp, **SEQUENCING IN PROGRESS**, 43 unordered pieces. | *Drosophila melanogaster* | 38,782 | Dec. 7, 1999 |
| rxa01988 | 549 | GB_HTG3:AC009542 | 160367 | AC009542 | *Homo sapiens* chromosome 7, **SEQUENCING IN PROGRESS**, 17 unordered pieces. | *Homo sapiens* | 35,065 | Aug. 27, 1999 |
| | | GB_IN1:AC002446 | 50978 | AC002446 | *Drosophila melanogaster* (P1 DS06754 (D83) DNA sequence, complete sequence. | *Drosophila melanogaster* | 38,920 | Aug. 19, 1997 |
| | | GB_PR3:HSU19H10 | 43303 | AL021182 | Human DNA sequence from cosmid U19H10 on chromosome X. Contains ESTs and CA repeat. | *Homo sapiens* | 39,006 | Nov. 23, 1999 |
| | | GB_PR3:HSU19H10 | 43303 | AL021182 | Human DNA sequence from cosmid U19H10 on chromosome X. Contains ESTs and CA repeat. | *Homo sapiens* | 38,447 | Nov. 23, 1999 |
| rxa01990 | 1022 | GB_GSS9:AQ100628 | 382 | AQ100628 | HS_3054_B2_A05_MF CIT Approved Human Genomic Sperm Library D *Homo sapiens* genomic clone Plate = 3054 Col = 10 Row = B, genomic survey sequence. | *Homo sapiens* | 38,320 | Aug. 27, 1998 |
| | | GB_EST14:AA406679 | 338 | AA406679 | MBAFCZ2F12T3A *Brugia malayi* adult female cDNA (SAW96MLW-BmAF) *Brugia malayi* cDNA clone AFCZ2F12 5', mRNA sequence. | *Brugia malayi* | 38,039 | May 1, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01991 | 996 | GB_EST21:AA991134 | 600 | AA991134 | BSBmMFSZ06C1SK *Brugia malayi* microfilaria cDNA (SAW94LS-BmMf) *Brugia malayi* cDNA clone BSBmMFSZ06C1 5', mRNA sequence. | *Brugia malayi* | 40,090 | Jun. 5, 1998 |
| | | GB_HTG3:AC007559 | 156374 | AC007559 | *Homo sapiens* clone NH0364J06, **SEQUENCING IN PROGRESS**, 29 unordered pieces. | *Homo sapiens* | 35,931 | Aug. 13, 1999 |
| | | GB_HTG3:AC007559 | 156374 | AC007559 | *Homo sapiens* clone NH0364J06, **SEQUENCING IN PROGRESS**, 29 unordered pieces. | *Homo sapiens* | 35,931 | Aug. 13, 1999 |
| | | GB_HTG3:AC007559 | 156374 | AC007559 | *Homo sapiens* clone NH0364J06, **SEQUENCING IN PROGRESS**, 29 unordered pieces. | *Homo sapiens* | 36,120 | Aug. 13, 1999 |
| rxa01992 | | | | | | | | |
| rxa01998 | 660 | GB_BA1:XCXPSGEN | 5324 | X59079 | *X. campestris* xps E, F, G, H, I, and J genes for protein secretion and pathogenicity functions. | *Xanthomonas campestris* | 38,447 | Sep. 12, 1993 |
| | | GB_GSS15:AQ659461 | 394 | AQ659461 | Sheared DNA-5C7.TR Sheared DNA *Trypanosoma brucei* genomic clone Sheared DNA-5C7, genomic survey sequence. | *Trypanosoma brucei* | 49,180 | Jun. 23, 1999 |
| | | GB_GSS4:AQ741049 | 713 | AQ741049 | HS_2272_A2_B02_MR CIT Approved Human Genomic Sperm Library D *Homo sapiens* genomic clone Plate = 2272 Col = 4 Row = C, genomic survey sequence. | *Homo sapiens* | 39,614 | Jul. 16, 1999 |
| rxa01999 | 594 | GB_HTG2:AC007321 | 159558 | AC007321 | *Homo sapiens* clone NH0507C01, **SEQUENCING IN PROGRESS**, 4 unordered pieces. | *Homo sapiens* | 34,524 | Apr. 16, 1999 |
| | | GB_HTG2:AC007321 | 159558 | AC007321 | *Homo sapiens* clone NH0507C01, **SEQUENCING IN PROGRESS**, 4 unordered pieces. | *Homo sapiens* | 34,524 | Apr. 16, 1999 |
| | | GB_HTG2:AC007321 | 159558 | AC007321 | *Homo sapiens* clone NH0507C01, **SEQUENCING IN PROGRESS**, 4 unordered pieces. | *Homo sapiens* | 35,094 | Apr. 16, 1999 |
| rxa02001 | 1281 | GB_BA1:D90917 | 154619 | D90917 | *Synechocystis* sp. PCC6803 complete genome, 27/27, 3418852-3573470. | *Synechocystis* sp. | 50,474 | Feb. 7, 1999 |
| | | GB_BA1:MTV016 | 53662 | AL021841 | *Mycobacterium tuberculosis* H37Rv complete genome; segment 143/162. | *Mycobacterium tuberculosis* | 39,223 | Jun. 23, 1999 |
| rxa02004 | 230 | GB_BA1:BSUB0006 | 210440 | Z99109 | *Bacillus subtilis* complete genome (section 6 of 21); from 999501 to 1209940. | *Bacillus subtilis* | 36,445 | Nov. 26, 1997 |
| | | GB_HTG3:AC011491 | 162134 | AC011491 | *Homo sapiens* chromosome 19 clone CIT978SKB_180A7, **SEQUENCING IN PROGRESS**, 161 unordered pieces. | *Homo sapiens* | 37,383 | Oct. 7, 1999 |
| | | GB_HTG3:AC011491 | 162134 | AC011491 | *Homo sapiens* chromosome 19 clone CIT978SKB_180A7, **SEQUENCING IN PROGRESS**, 161 unordered pieces. | *Homo sapiens* | 37,383 | Oct. 7, 1999 |
| | | GB_HTG3:AC011357 | 160676 | AC011357 | *Homo sapiens* chromosome 5 clone CIT-HSPC_362D12, **SEQUENCING IN PROGRESS**, 42 unordered pieces. | *Homo sapiens* | 54,585 | Oct. 6, 1999 |
| rxa02006 | 595 | GB_HTG2:AC006901 | 294136 | AC006901 | *Caenorhabditis elegans* clone Y74A11X, **SEQUENCING IN PROGRESS**, 81 unordered pieces. | *Caenorhabditis elegans* | 37,500 | Feb. 26, 1999 |
| | | GB_HTG2:AC006901 | 294136 | AC006901 | *Caenorhabditis elegans* clone Y74A11X, **SEQUENCING IN PROGRESS**, 81 unordered pieces. | *Caenorhabditis elegans* | 37,500 | Feb. 26, 1999 |
| | | GB_HTG1:CEY70C5 | 224525 | Z98878 | *Caenorhabditis elegans* chromosome V clone Y70C5, **SEQUENCING IN PROGRESS**, in unordered pieces. | *Caenorhabditis elegans* | 36,021 | Aug. 28, 1997 |
| rxa02007 | 756 | GB_BA2:CGL012293 | 2952 | AJ012293 | *Corynebacterium glutamicum* ilvD gene. | *Corynebacterium glutamicum* | 100,000 | Oct. 1, 1999 |
| | | GB_PR4:AC006285 | 150172 | AC006285 | *Homo sapiens*, complete sequence. | *Homo sapiens* | 38,740 | Nov. 15, 1999 |
| | | GB_PR4:AC006285 | 150172 | AC006285 | *Homo sapiens*, complete sequence. | *Homo sapiens* | 38,701 | Nov. 15, 1999 |
| rxa02009 | 223 | GB_PR4:AC004926 | 153556 | AC004926 | *Homo sapiens* PAC clone DJ0910H09 from 7q21.1-q21.2, complete sequence. | *Homo sapiens* | 38,462 | Feb. 17, 1999 |
| | | GB_PR2:AP000053 | 100000 | AP000053 | *Homo sapiens* genomic DNA, chromosome 21q22.1, segment 24/28, complete sequence. | *Homo sapiens* | 37,674 | Nov. 20, 1999 |
| | | GB_PR2:AP000121 | 100000 | AP000121 | *Homo sapiens* genomic DNA of 21q22.1, GART and AML related, SLC5A3-f4A4 region, segment 4/8, complete sequence. | *Homo sapiens* | 37,674 | Sep. 25, 1999 |
| rxa02013 | 649 | GB_BA1:MTCI237 | 27030 | Z94752 | *Mycobacterium tuberculosis* H37Rv complete genome; segment 46/162. | *Mycobacterium tuberculosis* | 39,308 | Jun. 17, 1998 |
| | | GB_HTG4:AC010885 | 201581 | AC010885 | *Homo sapiens* chromosome unknown clone NH0368K23, WORKING DRAFT SEQUENCE, in unordered pieces. | *Homo sapiens* | 37,206 | Oct. 29, 1999 |
| | | GB_HTG4:AC010885 | 201581 | AC010885 | *Homo sapiens* chromosome unknown clone NH0368K23, WORKING DRAFT SEQUENCE, in unordered pieces. | *Homo sapiens* | 37,206 | Oct. 29, 1999 |
| rxa02014 | 630 | GB_HTG3:AC010769 | 119431 | AC010769 | *Homo sapiens* chromosome 15 clone 28_B_17 map 15, LOW-PASS SEQUENCE SAMPLING. | *Homo sapiens* | 33,816 | Sep. 22, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG3:AC010769 | 119431 | AC010769 | *Homo sapiens* chromosome 15 clone 28_B_17 map 15, LOW-PASS SEQUENCE SAMPLING. | *Homo sapiens* | 33,816 | Sep. 22, 1999 |
| | | GB_EST34:AI783738 | 320 | AI783738 | tu45b07.x1 NCI_CGAP_Pr28 *Homo sapiens* cDNA clone IMAGE:2253973 3', mRNA sequence. | *Homo sapiens* | 37,855 | Jul. 1, 1999 |
| rxa02019 | 524 | GB_EST15:AA473289 | 318 | AA473289 | vd44g09.r1 Barstead MPLRB1 *Mus musculus* cDNA clone IMAGE:803488 5', mRNA sequence. | *Mus musculus* | 38,153 | Jun. 18, 1997 |
| | | GB_HTG1:CEY102A5_3 | 110000 | Z99711 | *Caenorhabditis elegans* chromosome V clone Y102A5, *SEQUENCING IN PROGRESS*, in unordered pieces. | *Caenorhabditis elegans* | 38,867 | Jun. 9, 1998 |
| | | GB_HTG1:CEY102A5_3 | 110000 | Z99711 | *Caenorhabditis elegans* chromosome V clone Y102A5, *SEQUENCING IN PROGRESS*, in unordered pieces. | *Caenorhabditis elegans* | 38,867 | Jun. 9, 1998 |
| rxa02021 | 1071 | GB_BA1:CGDNAAROP | 2612 | X85965 | *C. glutamicum* ORF3 and aroP gene. | *Corynebacterium glutamicum* | 99,905 | Nov. 30, 1997 |
| | | GB_BA1:CGDAPE | 1966 | X81379 | *C. glutamicum* dapE gene and orf2. | *Corynebacterium glutamicum* | 36,406 | Aug. 8, 1995 |
| rxa02023 | 891 | GB_BA1:SCI7 | 34893 | AL096743 | *Streptomyces coelicolor* cosmid I7. | *Streptomyces coelicolor* | 36,782 | Jul. 1, 1999 |
| | | GB_BA1:CGDAPE | 1966 | X81379 | *C. glutamicum* dapE gene and orf2. | *Corynebacterium glutamicum* | 99,864 | Aug. 8, 1995 |
| | | GB_PR3:AC004067 | 161326 | AC004067 | *Homo sapiens* chromosome 4 clone B386O24 map 4q25, complete sequence. | *Homo sapiens* | 39,651 | Nov. 8, 1998 |
| | | GB_HTG3:AC009725 | 145005 | AC009725 | *Mus musculus* chromosome 6 clone 388_N_17 map 6, **SEQUENCING IN PROGRESS*, 2 ordered pieces. | *Mus musculus* | 38,215 | Oct. 1, 1999 |
| rxa02032 | 693 | GB_PR4:AC006961 | 171419 | AC006961 | *Homo sapiens* chromosome 18, clone RP11-31P16, complete sequence. | *Homo sapiens* | 37,703 | Nov. 19, 1999 |
| | | GB_PR4:AC006961 | 171419 | AC006961 | *Homo sapiens* chromosome 18, clone RP11-31P16, complete sequence. | *Homo sapiens* | 40,839 | Nov. 19, 1999 |
| rxa02036 | 504 | GB_PR2:HSDJ799G3 | 127639 | AL078624 | Human DNA sequence from clone RP4-799G3 on chromosome 1q42.11-42.3, complete sequence. | *Homo sapiens* | 35,657 | Nov. 22, 1999 |
| | | GB_BA1:AOPCZA361 | 37941 | AJ223998 | *Amycolatopsis orientalis* cosmid PCZA361. | *Amycolatopsis orientalis* | 46,341 | Mar. 29, 1999 |
| | | GB_PL1:ATDNADAL1 | 8747 | Y14851 | *Arabidopsis thaliana* dal1 gene. | *Arabidopsis thaliana* | 35,223 | Sep. 23, 1997 |
| rxa02039 | 863 | GB_PR3:AC005609 | 157970 | AC005609 | *Homo sapiens* chromosome 5, BAC clone 203o13 (LBNL H155), complete sequence. | *Homo sapiens* | 37,176 | Sep. 4, 1998 |
| | | GB_HTG3:AC008468 | 245016 | AC008468 | *Homo sapiens* chromosome 5 clone CIT-HSPC_365B8, **SEQUENCING IN PROGRESS*, 14 unordered pieces. | *Homo sapiens* | 36,842 | Aug. 3, 1999 |
| | | GB_HTG3:AC008468 | 245016 | AC008468 | *Homo sapiens* chromosome 5 clone CIT-HSPC_365B8, **SEQUENCING IN PROGRESS*, 14 unordered pieces. | *Homo sapiens* | 36,842 | Aug. 3, 1999 |
| rxa02040 | 551 | GB_HTG3:AC009303 | 198549 | AC009303 | *Homo sapiens* clone NH0098C01, *SEQUENCING IN PROGRESS*, 2 unordered pieces. | *Homo sapiens* | 35,424 | Aug. 13, 1999 |
| | | GB_HTG3:AC009303 | 198549 | AC009303 | *Homo sapiens* clone NH0098C01, *SEQUENCING IN PROGRESS*, 2 unordered pieces. | *Homo sapiens* | 35,424 | Aug. 13, 1999 |
| | | GB_HTG3:AC009303 | 198549 | AC009303 | *Homo sapiens* clone NH0098C01, *SEQUENCING IN PROGRESS*, 2 unordered pieces. | *Homo sapiens* | 32,597 | Aug. 13, 1999 |
| rxa02045 | 384 | GB_EST3:R23812 | 459 | R23812 | yh34g05.r1 Soares placenta Nb2HP *Homo sapiens* cDNA clone IMAGE:131672 5', mRNA sequence. | *Homo sapiens* | 47,273 | Apr. 20, 1995 |
| | | GB_EST19:AA778733 | 611 | AA778733 | af88d02.s1 Soares_testis_NHT *Homo sapiens* cDNA clone 1049091 3', mRNA sequence. | *Homo sapiens* | 38,806 | Feb. 5, 1998 |
| | | GB_PR2:HSU59185 | 2529 | U59185 | Human putative monocarboxylate transporter (MCT) mRNA, complete cds. | *Homo sapiens* | 43,164 | Oct. 3, 1997 |
| rxa02046 | 540 | GB_HTG3:AC005507 | 196595 | AC005507 | *Plasmodium falciparum* chromosome 12 clone 3D7, **SEQUENCING IN PROGRESS*, 3 unordered pieces. | *Plasmodium falciparum* | 37,218 | Sep. 23, 1999 |
| | | GB_HTG3:AC005507 | 196595 | AC005507 | *Plasmodium falciparum* chromosome 12 clone 3D7, **SEQUENCING IN PROGRESS*, 3 unordered pieces. | *Plasmodium falciparum* | 37,218 | Sep. 23, 1999 |
| | | GB_EST1:T09984 | 330 | T09984 | 0540m7 gmbPHB3.1, G. Roman Reddy *Plasmodium falciparum* genomic clone 0540m, mRNA sequence. | *Plasmodium falciparum* | 32,121 | Nov. 29, 1993 |
| rxa02049 | 732 | GB_PL1:ATHCOLR | 1098 | M37778 | *A. thaliana* middle repetative sequence. | *Arabidopsis thaliana* | 33,755 | Apr. 27, 1993 |
| | | GB_PL2:ATAC006954 | 87035 | AC006954 | *Arabidopsis thaliana* chromosome II BAC F25P17 genomic sequence, complete sequence. | *Arabidopsis thaliana* | 33,755 | Apr. 7, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_EST33:AI779067 | 495 | AI779067 | EST259946 tomato susceptible, Cornell *Lycopersicon esculentum* cDNA clone cLES7C7, mRNA sequence. | *Lycopersicon esculentum* | 35,223 | Jun. 29, 1999 |
| rxa02050 | 918 | GB_HTG2:AC008307 | 91654 | AC008307 | *Drosophila melanogaster* chromosome 3 clone BACR03D22 (D709) RPCI-98 03.D.22 map 86F-87A strain y; cn bw sp, **SEQUENCING IN PROGRESS*, 94 unordered pieces. | *Drosophila melanogaster* | 36,182 | Aug. 2, 1999 |
| | | GB_HTG2:AC008307 | 91654 | AC008307 | *Drosophila melanogaster* chromosome 3 clone BACR03D22 (D709) RPCI-98 03.D.22 map 86F-87A strain y; cn bw sp, **SEQUENCING IN PROGRESS*, 94 unordered pieces. | *Drosophila melanogaster* | 36,182 | Aug. 2, 1999 |
| | | GB_EST31:AU060923 | 663 | AU060923 | *Dictyostelium discoideum* SL (H. Urushihara) *Dictyostelium discoideum* cDNA clone S1C248, mRNA sequence. | *Dictyostelium discoideum* | 39,388 | May 20, 1999 |
| rxa02051 | 621 | GB_EST16:C43896 | 369 | C43896 | Yuji Kohara unpublished cDNA:Strain N2 hermaphrodite embryo *Caenorhabditis elegans* cDNA clone yk336c10 5′, mRNA sequence. | *Caenorhabditis elegans* | 41,160 | Oct. 18, 1999 |
| | | GB_EST16:C40413 | 360 | C40413 | Yuji Kohara unpublished cDNA:Strain N2 hermaphrodite embryo *Caenorhabditis elegans* cDNA clone yk230e7 5′, mRNA sequence. | *Caenorhabditis elegans* | 42,090 | Oct. 18, 1999 |
| | | GB_EST36:AV191515 | 360 | AV191515 | Yuji Kohara unpublished cDNA:Strain N2 hermaphrodite embryo *Caenorhabditis elegans* cDNA clone yk594g6 5′, mRNA sequence. | *Caenorhabditis elegans* | 40,833 | Jul. 22, 1999 |
| rxa02053 | 702 | GB_IN1:AF035264 | 6397 | AF035264 | *Drosophila melanogaster* POU domain protein (pdm-1) gene, promoter region and exon 1. | *Drosophila melanogaster* | 36,888 | Dec. 4, 1997 |
| | | GB_BA1:MTV036 | 24055 | AL021931 | *Mycobacterium tuberculosis* H37Rv complete genome; segment 19/162. | *Mycobacterium tuberculosis* | 37,647 | Jun. 17, 1998 |
| | | GB_EST30:AI658116 | 497 | AI658116 | fc22e07.y1 Zebrafish WashU MPIMG EST *Danio rerio* cDNA 5′ similar to TR:Q15883 Q15883 X104; mRNA sequence. | *Danio rerio* | 41,129 | May 6, 1999 |
| rxa02057 | 654 | GB_PAT:E14601 | 4394 | E14601 | *Brevibacterium lactofermentum* gene for alpha-ketoglutaric acid dehydrogenase. | *Brevibacterium lactofermentum* | 96,667 | Jul. 28, 1999 |
| | | GB_BA1:D84102 | 4394 | D84102 | *Corynebacterium glutamicum* DNA for 2-oxoglutarate dehydrogenase, complete cds. | *Corynebacterium glutamicum* | 96,667 | Feb. 6, 1999 |
| | | GB_PAT:E14601 | 4394 | E14601 | *Brevibacterium lactofermentum* gene for alpha-ketoglutaric acid dehydrogenase. | *Corynebacterium glutamicum* | 38,199 | Jul. 28, 1999 |
| rxa02058 | 675 | GB_GSS9:AQ129748 | 432 | AQ129748 | HS_2254_B1_H03_MF CIT Approved Human Genomic Sperm Library D *Homo sapiens* genomic clone Plate = 2254 Col = 5 Row = P, genomic survey sequence. | *Homo sapiens* | 40,000 | Sep. 23, 1998 |
| | | GB_PL2:T15B16 | 90596 | AF104919 | *Arabidopsis thaliana* BAC T15B16. | *Arabidopsis thaliana* | 35,338 | Nov. 11, 1998 |
| | | GB_PL2:AC007138 | 120185 | AC007138 | *Arabidopsis thaliana* BAC T7B11 from chromosome IV near 10 cM, complete sequence. | *Arabidopsis thaliana* | 39,426 | Apr. 1, 1999 |
| rxa02059 | 618 | GB_HTG3:AC008672 | 131573 | AC008672 | *Homo sapiens* chromosome 5 clone CIT978SKB_3B12, *SEQUENCING IN PROGRESS*, 71 unordered pieces. | *Homo sapiens* | 40,871 | Aug. 3, 1999 |
| | | GB_HTG3:AC008672 | 131573 | AC008672 | *Homo sapiens* chromosome 5 clone CIT978SKB_3B12, *SEQUENCING IN PROGRESS*, 71 unordered pieces. | *Homo sapiens* | 40,871 | Aug. 3, 1999 |
| | | GB_IN1:DDU06228 | 2695 | U06228 | *Dictyostelium discoideum* CRAC (dagA) gene, complete cds. | *Dictyostelium discoideum* | 36,513 | Feb. 1, 1995 |
| rxa02066 | 615 | GB_PR2:CNS01DRA | 198444 | AL110505 | Human chromosome 14 DNA sequence *IN PROGRESS* BAC R-81618 of RPCI-11 library from chromosome 14 of *Homo sapiens* (Human), complete sequence. | *Homo sapiens* | 36,903 | Nov. 11, 1999 |
| | | GB_PR:HS230G1 | 125515 | Z84466 | *Homo sapiens* DNA sequence from PAC 230G1 on chromosome Xp11.3. Contains EST, STS and GSS, complete sequence. | *Homo sapiens* | 41,751 | Nov. 23, 1999 |
| | | GB_PR2:CNS01DRA | 198444 | AL110505 | Human chromosome 14 DNA sequence *IN PROGRESS* BAC R-81618 of RPCI-11 library from chromosome 14 of *Homo sapiens* (Human), complete sequence. | *Homo sapiens* | 36,589 | Nov. 11, 1999 |
| rxa02067 | 579 | GB_HTG3:AC009543 | 159209 | AC009543 | *Homo sapiens* chromosome 11 clone 63_H_13 map 11, *SEQUENCING IN PROGRESS*, 12 unordered pieces. | *Homo sapiens* | 35,366 | Oct. 7, 1999 |
| | | GB_HTG3:AC009543 | 159209 | AC009543 | *Homo sapiens* chromosome 11 clone 63_H_13 map 11, *SEQUENCING IN PROGRESS*, 12 unordered pieces. | *Homo sapiens* | 35,366 | Oct. 7, 1999 |
| | | GB_PR:HS230G1 | 125515 | Z84466 | *Homo sapiens* DNA sequence from PAC 230G1 on chromosome Xp11.3. Contains EST, STS | *Homo sapiens* | 36,348 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02069 | 702 | GB_BA1:MTCI61 | 13540 | Z98260 | and GSS, complete sequence. Mycobacterium tuberculosis H37Rv complete genome; segment 53/162. | Mycobacterium tuberculosis | 36,642 | Jun. 17, 1998 |
|  |  | GB_BA1:MTCI61 | 13540 | Z98260 | Mycobacterium tuberculosis H37Rv complete genome; segment 53/162. | Mycobacterium tuberculosis | 39,474 | Jun. 17, 1998 |
| rxa02070 | 1245 | GB_BA2:AE001112 | 14704 | AE001112 | Archaeoglobus fulgidus section 167 of 172 of the complete genome. | Archaeoglobus fulgidus | 39,352 | Dec. 15, 1997 |
|  |  | GB_PR3:HSDJ47M23 | 129320 | AL096816 | Human DNA sequence **SEQUENCING IN PROGRESS* from clone dJ47M23, complete sequence. | Homo sapiens | 40,413 | Nov. 23, 1999 |
|  |  | GB_HTG3:AC009139 | 152666 | AC009139 | Homo sapiens chromosome 16 clone RPCI-11__538I12, **SEQUENCING IN PROGRESS*, 27 unordered pieces. | Homo sapiens | 35,275 | Aug. 3, 1999 |
| rxa02076 | 657 | GB_EST34:AI789138 | 594 | AI789138 | uk51e02.y1 Sugano mouse kidney mkia Mus musculus cDNA clone IMAGE:1972538 5' similar to WP:R10H10.7 CE06298 TYROSINE-PROTEIN KINASE LIKE; mRNA sequence. | Mus musculus | 43,041 | Jul. 2, 1999 |
|  |  | GB_GSS1:FR0013995 | 552 | AL005239 | F. rubripes GSS sequence, clone 137O18aC6, genomic survey sequence. | Fugu rubripes | 37,079 | Sep. 18, 1997 |
|  |  | GB_GSS3:B27548 | 642 | B27548 | F19J9TFBIGF Arabidopsis thaliana genomic clone F19J9, genomic survey sequence. | Arabidopsis thaliana | 37,056 | Oct. 13, 1997 |
| rxa02080 | 930 | GB_GSS15:AQ652136 | 411 | AQ652136 | Sheared DNA-7M23.TR Sheared DNA Trypanosoma brucei genomic clone Sheared DNA-7M23, genomic survey sequence. | Trypanosoma brucei | 39,259 | Jun. 22, 1999 |
|  |  | GB_GSS15:AQ652498 | 450 | AQ652498 | Sheared DNA-22K16.TR Sheared DNA Trypanosoma brucei genomic clone Sheared DNA-22K16, genomic survey sequence. | Trypanosoma brucei | 39,597 | Jun. 22, 1999 |
|  |  | GB_HTG3:AC009683 | 171597 | AC009683 | Homo sapiens chromosome 8 clone 76_N__5 map 8, **SEQUENCING IN PROGRESS*, 10 unordered pieces. | Homo sapiens | 37,053 | Sep. 29, 1999 |
| rxa02081 | 1752 | GB_OV:BSU43200 | 2070 | U43200 | Boreogadus saida antifreeze glycopeptide AFGP polyprotein precursor gene, complete cds. | Boreogadus saida | 37,016 | May 12, 1997 |
|  |  | GB_BA2:AE001615 | 12401 | AE001615 | Chlamydia pneumoniae section 31 of 103 of the complete genome. | Chlamydophila pneumoniae | 36,385 | Mar. 8, 1999 |
| rxa02084 | 468 | GB_OV:BSU43200 | 2070 | U43200 | Boreogadus saida antifreeze glycopeptide AFGP polyprotein precursor gene, complete cds. | Boreogadus saida | 37,672 | May 12, 1997 |
|  |  | GB_PR4:AC007382 | 80547 | AC007382 | Homo sapiens clone NH0288C18, complete sequence. | Homo sapiens | 41,138 | Sep. 8, 1999 |
|  |  | GB_GSS4:AQ731530 | 508 | AQ731530 | HS__5543__A2__A05__T7A RPCI-11 Human Male BAC Library Homo sapiens genomic clone Plate = 1119 Col = 10 Row = A, genomic survey sequence. | Homo sapiens | 36,245 | Jul. 15, 1999 |
| rxa02089 | 594 | GB_PR4:AC007382 | 80547 | AC007382 | Homo sapiens clone NH0288C18, complete sequence. | Homo sapiens | 35,398 | Sep. 8, 1999 |
|  |  | GB_PR2:AP000031 | 149298 | AP000031 | Homo sapiens genomic DNA, chromosome 21q22.1, segment 2/28, complete sequence. | Homo sapiens | 38,699 | Nov. 20, 1999 |
|  |  | GB_PR2:AP000135 | 111894 | AP000135 | Homo sapiens genomic DNA of 21q22.1, GART and AML, f43D11-119B8 region, segment 10/10, complete sequence. | Homo sapiens | 38,699 | Sep. 25, 1999 |
|  |  | GB_PR2:AP000213 | 100000 | AP000213 | Homo sapiens genomic DNA, chromosome 21q22.1, D21S226-AML region, clone f43D11-119B8, segment 11/12, complete sequence. | Homo sapiens | 38,699 | Nov. 20, 1999 |
| rxa02090 | 924 | GB_PL2:ATAC006841 | 123183 | AC006841 | Arabidopsis thaliana chromosome II BAC F3K23 genomic sequence, complete sequence. | Arabidopsis thaliana | 39,826 | Apr. 6, 1999 |
|  |  | GB_PL1:SCXV55KB | 54719 | Z70678 | S. cerevisiae chromosome XV DNA, 54.7 kb region. | Saccharomyces cerevisiae | 37,817 | May 16, 1997 |
|  |  | GB_PR1:D87675 | 301692 | D87675 | Homo sapiens DNA for amyloid precursor protein, complete cds. | Homo sapiens | 39,140 | Sep. 22, 1997 |
| rxa02091 | 774 | GB_BA2:AF031929 | 2675 | AF031929 | Lactobacillus helveticus cochaperonin GroES and chaperonin GroEL genes, complete cds; and DNA mismatch repair enzyme (hexA) gene, partial cds. | Lactobacillus helveticus | 35,509 | Aug. 8, 1998 |
|  |  | GB_BA1:CGU43536 | 3464 | U43536 | Corynebacterium glutamicum heat shock, ATP-binding protein (clpB) gene, complete cds. | Corynebacterium glutamicum | 39,124 | Mar. 13, 1997 |
| rxa02094 | 840 | GB_BA1:RCFBC | 3874 | X03476 | Rhodopseudomonas sphaeroides fbc operon (fbcF, fbcB, fbcC genes). | Rhodobacter sphaeroides | 36,478 | Feb. 10, 1999 |
|  |  | GB_RO:MMHC188A7 | 120990 | AF109719 | Mus musculus casein kinase 2 beta subunit (gMCK2) gene, partial cds; BAT4, NG20 (NG20), BAT3, BAT2, AIF-1, B144, lymphotoxin beta, TNF, and TNF beta genes, complete cds; IKBL gene, partial cds; and unknown gene. | Mus musculus | 38,118 | Oct. 25, 1999 |
|  |  | GB_EST10:AA168948 | 549 | AA168948 | ms39e08.r1 Life Tech mouse embryo 13.5dpc 10666014 Mus musculus cDNA clone IMAGE:613934 5' similar to gb:U15980 Mus musculus (MOUSE); mRNA sequence. | Mus musculus | 40,789 | Dec. 19, 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02097 | 3495 | GB_EST24:AI101223 | 348 | AI101223 | EST210512 Normalized rat brain, Bento Soares Rattus sp. cDNA clone RBRBK04 3' end, mRNA sequence. | Rattus sp. | 40,634 | Jan. 31, 1999 |
| | | GB_BA2:RMU31512 | 1974 | U31512 | Rhizobium meliloti RmDEGP (degP) gene, complete cds. | Sinorhizobium meliloti | 39,159 | Mar. 5, 1996 |
| | | GB_EST15:AA502050 | 346 | AA502050 | ng57-04.s1 NCL_CGAP_Lip2 Homo sapiens cDNA clone IMAGE:938886 similar to contains Alu repetitive element; mRNA sequence. | Homo sapiens | 40,751 | Aug. 18, 1997 |
| | | GB_EST16:AA589883 | 400 | AA589883 | vl80h08.r1 Stratagene mouse diaphragm (#937303) Mus musculus cDNA clone IMAGE:987039 5' similar to gb:M75716 Mus musculus alpha-1 protease inhibitor 2 (MOUSE); mRNA sequence. | Mus musculus | 35,427 | Sep. 16, 1997 |
| rxa02102 | 1281 | GB_IN2:AF135118 | 10830 | AF135118 | Drosophila melanogaster laminin alpha 1,2 (wing blister) mRNA, complete cds. | Drosophila melanogaster | 36,926 | May 23, 1999 |
| | | GB_IN1:AC002516 | 48158 | AC002516 | Drosophila melanogaster (P1 DS01068 (D37)) DNA sequence, complete sequence. | Drosophila melanogaster | 37,838 | Aug. 28, 1997 |
| | | GB_GSS3:B09866 | 1194 | B09866 | T16G20-Sp6 TAMU Arabidopsis thaliana genomic clone T16G20, genomic survey sequence. | Arabidopsis thaliana | 35,332 | May 14, 1997 |
| rxa02103 | 519 | GB_GSS3:B09866 | 1194 | B09866 | T16G20-Sp6 TAMU Arabidopsis thaliana genomic clone T16G20, genomic survey sequence. | Arabidopsis thaliana | 36,310 | May 14, 1997 |
| | | GB_EST34:AV165661 | 290 | AV165661 | AV165661 Mus musculus head C57BL/6J 13-day embryo Mus musculus cDNA clone 3110038F04, mRNA sequence. | Mus musculus | 37,716 | Jul. 6, 1999 |
| rxa02104 | 1245 | GB_RO:AC002121 | 84056 | AC002121 | Genomic sequence from Mouse 11, complete sequence. | Mus musculus | 39,096 | Jul. 10, 1997 |
| | | GB_BA2:ECOUW67_0 | 110000 | U18997 | Escherichia coli K-12 chromosomal region from 67,4 to 76.0 minutes. | Escherichia coli | 39,024 | Dec. 22, 1994 |
| | | GB_BA2:AE000394 | 12221 | AE000394 | Escherichia coli K-12 MG1655 section 284 of 400 of the complete genome. | Escherichia coli | 39,024 | Nov. 12, 1998 |
| | | GB_BA1:ECORNPBW | 4434 | D90212 | E. coli mpB gene and ORFs. | Escherichia coli | 45,255 | Feb. 7, 1999 |
| rxa02107 | | | | | | | | |
| rxa02108 | 732 | GB_BA1:D90912 | 128598 | D90912 | Synechocystis sp. PCC6803 complete genome, 14/27, 1719644-1848241. | Synechocystis sp. | 38,095 | Feb. 7, 1999 |
| | | GB_GSS13:AQ498890 | 431 | AQ498890 | HS_5154_A1_E06_SP6F RPCI-11 Human Male BAC Library Homo sapiens genomic clone Plate = 730 Col = 11 Row = I, genomic survey sequence. | Homo sapiens | 37,150 | Apr. 28, 1999 |
| rxa02109 | 1044 | GB_BA1:D90912 | 128598 | D90912 | Synechocystis sp. PCC6803 complete genome, 14/27, 1719644-1848241. | Synechocystis sp. | 38,781 | Feb. 7, 1999 |
| | | GB_IN2:AC001658 | 91019 | AC001658 | Drosophila melanogaster DNA sequence (P1 DS00913 (D24)), complete sequence. | Drosophila melanogaster | 35,687 | Jul. 17, 1998 |
| | | GB_EST19:AA802304 | 561 | AA802304 | GM04170.5prime GM Drosophila melanogaster ovary BlueScript Drosophila melanogaster cDNA clone GM04170 5prime, mRNA sequence. | Drosophila melanogaster | 40,451 | Nov. 25, 1998 |
| | | GB_EST35:AI822653 | 733 | AI822653 | LO-1173T3 Ice plant Lambda Uni-Zap XR expression library, 0 hours NaCl treatment Mesembryanthemum crystallinum cDNA clone LO-1173 5' similar to Profilin 1 (AF092547) [Ricinus communis], mRNA sequence. | Mesembryanthemum crystallinum | 36,957 | Jul. 12, 1999 |
| rxa02114 | 509 | GB_BA1:SMU94899 | 2379 | U94899 | Sinorhizobium meliloti dissimilatory nitrous oxide reduction proteins NosY, NosL and NosX genes, complete cds. | Sinorhizobium meliloti | 42,744 | Sep. 6, 1997 |
| | | GB_BA1:SMU94899 | 2379 | U94899 | Sinorhizobium meliloti dissimilatory nitrous oxide reduction proteins NosY, NosL and NosX genes, complete cds. | Sinorhizobium meliloti | 39,486 | Sep. 6, 1997 |
| rxa02117 | 18754 | GB_BA2:AF094575 | 597 | AF094575 | Streptococcus pneumoniae serotype 19A DexB (dexB) gene, partial sequence; capsular polysaccharide biosynthesis operon, complete sequence; and oligopeptide permease AliA (aliA) gene, partial cds. | Streptococcus pneumoniae | 40,480 | Sep. 9, 1999 |
| | 5832 | GB_BA2:AF105113 | | AF105113 | Streptococcus pneumoniae type 19A putative oligosaccharide repeat unit transporter (cps19AJ) gene, partial cds; UDP-N-acetyl glucosamine-2-epimerase (cps19AK), glucose-1-phosphate thymidylyl transferase (cps19AL), dTDP-4-keto-6-deoxyglucose-3,5-epimerase (cps19AM), dTDP-glucose-4,6 dehydratase (cps19AN), and dTDP-L-rhamnose synthase (cps19AO) genes, complete cds; and AliA (aliA) gene, partial cds. | Streptococcus pneumoniae | 40,652 | Sep. 9, 1999 |
| | | GB_EST9:AA073381 | 429 | AA073381 | mm93a12.r1 Stratagene mouse heart (#937316) Mus musculus cDNA clone IMAGE:535966 5' similar to gb:X03765 Mouse mRNA for cytoplasmatic beta-actin (MOUSE); mRNA sequence. | Mus musculus | 46,341 | Feb. 15, 1997 |
| rxa02121 | 828 | GB_PR4:AC004874 | 95983 | AC004874 | Homo sapiens PAC clone DJ0744D13 from 7q11, complete sequence. | Homo sapiens | 40,791 | Nov. 21, 1998 |
| | | GB_EST14:AA418305 | 440 | AA418305 | zv96g05.s1 Soares_NhHMPu_S1 Homo sapiens cDNA clone IMAGE:767672 3', mRNA sequence. | Homo sapiens | 40,093 | Oct. 16, 1997 |
| | | GB_BA2:U32763 | 12021 | U32763 | Haemophilus influenzae Rd section 78 of 163 of the complete genome. | Haemophilus influenzae | 37,715 | May 29, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02123 | 1494 | GB_BA1:MTCY10D7 | 39800 | Z79700 | *Mycobacterium tuberculosis* H37Rv complete genome; segment 44/162. | *Mycobacterium tuberculosis* Rd | 62,083 | Jun. 17, 1998 |
| | | GB_BA1:MTCY10D7 | 39800 | Z79700 | *Mycobacterium tuberculosis* H37Rv complete genome; segment 44/162. | *Mycobacterium tuberculosis* | 38,462 | Jun. 17, 1998 |
| | | GB_GSS15:AQ639831 | 649 | AQ639831 | 927P1-20A2.TV 927P1 *Trypanosoma brucei* genomic clone 927P1-20A2, genomic survey sequence. | *Trypanosoma brucei* | 36,124 | Jul. 8, 1999 |
| rxa02124 | 2079 | GB_PR2:HS242N11 | 167514 | AL023655 | Human DNA sequence from clone 242N11 on chromosome 6p22.3-23. Contains ESTs, STSs, GSSs, genomic marker D6S285, and ca and gaaa repeat polymorphisms, complete sequence. | *Homo sapiens* | 33,866 | Nov. 23, 1999 |
| | | GB_PR2:HS242N11 | 167514 | AL023655 | Human DNA sequence from clone 242N11 on chromosome 6p22.3-23. Contains ESTs, STSs, GSSs, genomic marker D6S285, and ca and gaaa repeat polymorphisms, complete sequence. | *Homo sapiens* | 36,342 | Nov. 23, 1999 |
| rxa02125 | 924 | GB_HTG1:CEY116A8_4 | 110000 | Z98858 | *Caenorhabditis elegans* chromosome IV clone Y116A8, *SEQUENCING IN PROGRESS*, in unordered pieces. | *Caenorhabditis elegans* | 36,615 | Jan. 23, 1998 |
| | | GB_IN1:CEY116A8B | 29344 | AL021469 | *Caenorhabditis elegans* cosmid Y116A8B, complete sequence. | *Caenorhabditis elegans* | 36,615 | Nov. 23, 1998 |
| | | GB_HTG1:CEY116A8_4 | 110000 | Z98858 | *Caenorhabditis elegans* chromosome IV clone Y116A8, *SEQUENCING IN PROGRESS*, in unordered pieces. | *Caenorhabditis elegans* | 36,615 | Jan. 23, 1998 |
| rxa02129 | 357 | GB_HTG5:AC007809 | 141122 | AC007809 | *Drosophila melanogaster* chromosome 3 clone BACR45M03 (D718) RPCI-98 45.M.3 map 88C—88C strain y; cn bw sp, **SEQUENCING IN PROGRESS*, 98 unordered pieces. | *Drosophila melanogaster* | 37,255 | Nov. 16, 1999 |
| | | GB_IN2:CELT02C5 | 36267 | U55374 | *Caenorhabditis elegans* cosmid T02C5. | *Caenorhabditis elegans* | 41,834 | Oct. 8, 1999 |
| rxa02132 | | GB_IN1:CEZC101 | 26147 | Z93395 | *Caenorhabditis elegans* cosmid ZC101, complete sequence. | *Caenorhabditis elegans* | 38,873 | Jul. 23, 1999 |
| rxa02137 | 921 | GB_EST16:C48630 | 360 | C48630 | C48630 Yuji Kohara unpublished cDNA:Strain N2 hermaphrodite embryo *Caenorhabditis elegans* cDNA clone yk459c11 5', mRNA sequence. | *Caenorhabditis elegans* | 39,326 | Oct. 18, 1999 |
| | | GB_GSS12:AQ381854 | 597 | AQ381854 | RPCI11-137P5.TJ RPCI-11 *Homo sapiens* genomic clone RPCI-11-137P5, genomic survey sequence. | *Homo sapiens* | 37,879 | May 21, 1999 |
| | | GB_HTG3:AC010253 | 74835 | AC010253 | *Homo sapiens* chromosome 5 clone CIT-HSPC_432B14, *SEQUENCING IN PROGRESS*, 34 unordered pieces. | *Homo sapiens* | 35,082 | Sep. 15, 1999 |
| rxa02138 | 465 | GB_BA1:SC6G10 | 36734 | AL049497 | *Streptomyces coelicolor* cosmid 6G10. | *Streptomyces coelicolor* | 40,047 | Mar. 24, 1999 |
| | | GB_BA1:MSGB1554CS | 36548 | L78814 | *Mycobacterium leprae* cosmid B1554 DNA sequence. | *Mycobacterium leprae* | 60,991 | Jun. 15, 1996 |
| | | GB_BA1:MSGB1551CS | 36548 | L78813 | *Mycobacterium leprae* cosmid B1551 DNA sequence. | *Mycobacterium leprae* | 60,991 | Jun. 15, 1996 |
| rxa02141 | 531 | GB_HTG2:AC003118 | 98940 | AC003118 | *Homo sapiens* chromosome 1, *SEQUENCING IN PROGRESS*, 3 unordered pieces. | *Homo sapiens* | 34,008 | Nov. 24, 1997 |
| | | GB_HTG2:AC003118 | 98940 | AC003118 | *Homo sapiens* chromosome 1, *SEQUENCING IN PROGRESS*, 3 unordered pieces. | *Homo sapiens* | 34,008 | Nov. 24, 1997 |
| | | GB_PR3:HS395P12 | 147724 | AL022310 | Human DNA sequence from clone 395P12 on chromosome 1q24-25. Contains the TXGP1 gene for tax-transcriptionally activated glycoprotein 1 (34 kD) (OX40 ligand, OX40L) and a GOT2 (Aspartate Aminotransferase, mitochondrial precursor, EC 2.6.1.1, Transaminase A, Glutamate Oxaloacetate Transaminase-2) pseudogene. Contains ESTs, STSs and GSSs, complete sequence. | *Homo sapiens* | 34,008 | Nov. 23, 1999 |
| rxa02146 | 750 | GB_BA1:SC6G10 | 36734 | AL049497 | *Streptomyces coelicolor* cosmid 6G10. | *Streptomyces coelicolor* | 36,167 | Mar. 24, 1999 |
| | | GB_HTG6:AC008224 | 199774 | AC008224 | *Drosophila melanogaster* chromosome 3 clone BACR29J02 (D817) RPCI-98 29.J.2 map 83D—83D strain y; cn bw sp, *SEQUENCING IN PROGRESS*, 37 unordered pieces. | *Drosophila melanogaster* | 36,437 | Nov. 24, 1999 |
| | | GB_GSS12:AQ407179 | 476 | AQ407179 | HS_5088_A2_G01_T7A RPCI-11 Human Male BAC Library *Homo sapiens* genomic clone Plate = 664 Col = 2 Row = M, genomic survey sequence. | *Homo sapiens* | 37,143 | Mar. 17, 1999 |
| rxa02151 | 1311 | GB_PR3:AC000074 | 44450 | AC000074 | *Homo sapiens* Chromosome 22q11.2 Cosmid Clone 20b in DGCR Region, complete sequence. | *Homo sapiens* | 37,798 | Oct. 31, 1998 |
| | | GB_PR2:HSAC002122 | 79931 | AC002122 | Human unknown clone GS293304 from 5p15.2, complete sequence. | *Homo sapiens* | 36,064 | May 27, 1997 |
| | | GB_PR2:HSAC002122 | 79931 | AC002122 | Human unknown clone GS293304 from 5p15.2, complete sequence. | *Homo sapiens* | 35,051 | May 27, 1997 |
| rxa02152 | 525 | GB_PAT:AR009990 | 2793 | AR009990 | Sequence 1 from U.S. Pat. No. 5756677. | Unknown. | 44,311 | Dec. 4, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02163 | 876 | GB_IN1:AF027735 | 3060 | AF027735 | *Nephila clavipes* minor ampullate silk protein MiSp1 mRNA, partial cds. | *Nephila clavipes* | 44,311 | Apr. 23, 1998 |
| | | GB_PAT:I95876 | 2793 | I95876 | Sequence 1 from U.S. Pat. No. 5733771. | Unknown. | 44,311 | Dec. 1, 1998 |
| | | GB_PR3:HSJ117516 | 96276 | AL049538 | Human DNA sequence from clone 117516 on chromosome 20. Contains the gene for Ras inhibitor JC265 (Ras association (RalGDS/AF-6) domain containing protein), ESTs, STSs, GSSs and two putative CpG islands, complete sequence. | *Homo sapiens* | 36,385 | Nov. 23, 1999 |
| | | GB_GSS4:AQ690740 | 975 | AQ690740 | nbxb0082N18f CUGI Rice BAC Library *Oryza sativa* genomic clone nbxb0082N18f, genomic survey sequence. | *Oryza sativa* | 39,474 | Jul. 1, 1999 |
| rxa02164 | 1698 | GB_PH:SVVWBORF | 6051 | X72092 | *Streptomyces venezuelae* bacteriophage VWB orfs. | Bacteriophage VWB | 41,416 | Aug. 24, 1995 |
| | | GB_BA2:AF000579 | 8931 | AF000579 | *Bordetella bronchiseptica* LysR transcriptional activator homolog (bbuR), urease accessory protein D (ureD), urease structural subunit A (ureA), urease accessory protein J (ureJ), urease structural subunits B (ureB) and C (ureC), urease accessory proteins EF (ureEF) and G (ureG) genes, complete cds. | *Bordetella bronchiseptica* | 38,005 | Feb. 23, 1998 |
| rxa02165 | | GB_PR3:HS431P23 | 147971 | AL009178 | Human DNA sequence from clone 431P23 on chromosome 6q27. Contains the first coding exon of the MLLT4 gene for myeloid/lymphoid or mixed-lineage leukemia (trithorax (*Drosophila*) homolog); translocated to, 4 (AF-6, Afadin, MLLT-4, ALL-1 fusion partner), and a Serine Palmitoyltransferase 2 (EC 2.3.1.50, Long Chain Base Biosynthesis protein 2, LCB-2, SPT-2) pseudogene. Contains ESTs, STSs, GSSs, and a putative CpG island, complete sequence. | *Homo sapiens* | 35,604 | Nov. 23, 1999 |
| | 735 | GB_PR2:AB016897 | 331211 | AB016897 | *Homo sapiens* genomic DNA, chromosome 6q27, complete sequence. | *Homo sapiens* | 38,314 | Nov. 20, 1999 |
| | | GB_IN2:AF079177 | 2159 | AF079177 | *Theileria parva* strain KNP2 p67 surface antigen (p67) gene, complete cds. | *Theileria parva* | 39,207 | Mar. 9, 1999 |
| | | GB_IN2:AF079176 | 2285 | AF079176 | *Theileria parva* strain Hluhluwe3 p67 surface antigen (p67) gene, complete cds. | *Theileria parva* | 39,049 | Mar. 9, 1999 |
| | | GB_EST27:AI397572 | 482 | AI397572 | NCSC5G2T3 Subtracted Conidial *Neurospora crassa* cDNA clone SC5G2 5', mRNA sequence. | *Neurospora crassa* | 38,936 | Feb. 8, 1999 |
| rxa02166 | 300 | GB_BA1:MLCB1351 | 38936 | Z95117 | *Mycobacterium leprae* cosmid B1351. | *Mycobacterium leprae* | 37,627 | Jun. 24, 1997 |
| | | GB_BA1:MLCB1351 | 38936 | Z95117 | *Mycobacterium leprae* cosmid B1351. | *Mycobacterium leprae* | 40,741 | Jun. 24, 1997 |
| rxa02168 | 2937 | GB_BA1:MAFASGEN | 10520 | X87822 | *B. ammoniagenes* FAS gene. | *Corynebacterium ammoniagenes* | 61,515 | Oct. 3, 1996 |
| rxa02169 | 969 | GB_BA1:MLCL458 | 43839 | AL049478 | *Mycobacterium leprae* cosmid L458. | *Mycobacterium leprae* | 50,292 | Aug. 27, 1999 |
| | | GB_PR3:HSL19H1 | 40145 | Z68164 | Human DNA sequence from cosmid L19H1, Huntington's Disease Region, chromosome 4p16.3, containing multiple EST matches. | *Homo sapiens* | 37,621 | Nov. 23, 1999 |
| | | GB_RO:MMA3CA212 | 4784 | X94406 | *Mus musculus* partial b3 gene for alpha3 subunit of L-type Ca2+ channel, exons 2-13. | *Mus musculus* | 37,620 | Nov. 24, 1999 |
| | | GB_RO:RATCACH3B | 2525 | M88751 | Rat calcium channel beta subunit-III mRNA, complete cds. | *Rattus norvegicus* | 36,345 | May 27, 1994 |
| | | GB_RO:MMU20372 | 2469 | U20372 | *Mus musculus* voltage-dependent calcium channel beta-3 subunit (CCHB3) mRNA, complete cds. | *Mus musculus* | 36,865 | Mar. 2, 1996 |
| rxa02170 | 897 | GB_HTG6:AC005497 | 212097 | AC005497 | *Homo sapiens* chromosome 17 clone RP11-952N18 map 17, *SEQUENCING IN PROGRESS*, 2 ordered pieces. | *Homo sapiens* | 36,101 | Nov. 20, 1999 |
| | | GB_HTG6:AC005497 | 212097 | AC005497 | *Homo sapiens* chromosome 17 clone RP11-952N18 map 17, *SEQUENCING IN PROGRESS*, 2 ordered pieces. | *Homo sapiens* | 37,570 | Nov. 20, 1999 |
| | | GB_PR2:AP000104 | 100000 | AP000104 | *Homo sapiens* genomic DNA of 21q22.1, GART and AML related, Q78C10-149C3 region, segment 7/20, complete sequence. | *Homo sapiens* | 34,871 | Sep. 25, 1999 |
| rxa02172 | 462 | GB_EST24:AI170522 | 367 | AI170522 | EST216450 Normalized rat lung, Bento Soares *Rattus* sp. cDNA clone RLUCO75 3' end, mRNA sequence. | *Rattus* sp. | 38,904 | Jan. 20, 1999 |
| | | GB_GSS13:AQ430048 | 538 | AQ430048 | HS_5061_B2_G09_T7A RPCI-11 Human Male BAC Library *Homo sapiens* genomic clone Plate = 637 Col = 18 Row = N, genomic survey sequence. | *Homo sapiens* | 37,143 | Mar. 31, 1999 |
| | | GB_GSS4:AQ701704 | 589 | AQ701704 | HS_2130_A1_E03_MR CIT Approved Human Genomic Sperm Library Library D *Homo sapiens* genomic clone Plate = 2130 Col = 5 Row = I, genomic survey sequence. | *Homo sapiens* | 35,280 | Jul. 7, 1999 |
| rxa02177 | 1056 | GB_HTG4:AC009403 | 198495 | AC009403 | *Homo sapiens* clone DJ1015O24, *SEQUENCING IN PROGRESS*, 3 unordered pieces. | *Homo sapiens* | 37,154 | Oct. 28, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02178 | | GB_HTG4:AC009403 | 198495 | AC009403 | *Homo sapiens* clone DJ1015O24, *SEQUENCING IN PROGRESS*, 3 unordered pieces. | *Homo sapiens* | 37,154 | Oct. 28, 1999 |
| | | GB_PR2:AP000094 | 100000 | AP000094 | *Homo sapiens* genomic DNA of 21q22.1, GART and AML related, B335D16-P10G11 region, segment 4/7, complete sequence. | *Homo sapiens* | 38,536 | Sep. 25, 1999 |
| rxa02180 | 1581 | GB_BA1:SC6C5 | 18160 | AL034492 | *Streptomyces coelicolor* cosmid 6C5. | *Streptomyces coelicolor* | 53,635 | Dec. 14, 1998 |
| | | GB_HTG4:AC011121 | 172050 | AC011121 | *Homo sapiens* chromosome 11 clone 364_C_06 map 11, *SEQUENCING IN PROGRESS*, 9 ordered pieces. | *Homo sapiens* | 37,170 | Oct. 14, 1999 |
| | | GB_HTG4:AC011121 | 172050 | AC011121 | *Homo sapiens* chromosome 11 clone 364_C_06 map 11, *SEQUENCING IN PROGRESS*, 9 ordered pieces. | *Homo sapiens* | 37,170 | Oct. 14, 1999 |
| rxa02181 | 801 | GB_PL1:STU76701 | 3049 | U76701 | *Solanum tuberosum* NADH nitrate reductase (StNR2) mRNA, complete cds. | *Solanum tuberosum* | 38,846 | Nov. 18, 1996 |
| | | GB_EST36:AI896605 | 633 | AI896605 | EST266048 tomato callus, TAMU *Lycopersicon esculentum* cDNA clone cLEC16C12, mRNA sequence. | *Lycopersicon esculentum* | 39,671 | Jul. 27, 1999 |
| | | GB_EST38:AW035744 | 620 | AW035744 | EST281898 tomato callus, TAMU *Lycopersicon esculentum* cDNA clone cLEC36M13, mRNA sequence. | *Lycopersicon esculentum* | 40,555 | Sep. 15, 1999 |
| rxa02183 | | | | | | | | |
| rxa02185 | 702 | GB_BA1:MTV043 | 68848 | AL022004 | *Mycobacterium tuberculosis* H37Rv complete genome; segment 40/162. | *Mycobacterium tuberculosis* | 38,793 | Jun. 24, 1999 |
| | | GB_BA1:MSGB1935CS | 40085 | L04666 | *M. leprae* genomic sequence, cosmid b1935. | *Mycobacterium leprae* | 38,067 | Jun. 14, 1998 |
| | | GB_BA1:MLCB57 | 38029 | Z99494 | *Mycobacterium leprae* cosmid B57. | *Mycobacterium leprae* | 38,067 | Feb. 10, 1999 |
| rxa02186 | 321 | GB_BA2:CNSPAX03 | 307120 | AJ248285 | *Pyrococcus abyssi* complete genome; segment 3/6. | *Pyrococcus abyssi* | 35,873 | Sep. 9, 1999 |
| | | GB_HTG3:AC010677 | 116108 | AC010677 | *Homo sapiens* clone MS2304L04, *SEQUENCING IN PROGRESS*, 4 unordered pieces. | *Homo sapiens* | 39,145 | Oct. 4, 1999 |
| | | GB_HTG3:AC010677 | 116108 | AC010677 | *Homo sapiens* clone MS2304L04, *SEQUENCING IN PROGRESS*, 4 unordered pieces. | *Homo sapiens* | 39,145 | Oct. 4, 1999 |
| rxa02187 | 2322 | GB_EST33:AI779784 | 362 | AI779784 | EST260663 tomato susceptible, Cornell *Lycopersicon esculentum* cDNA clone cLES9K1, mRNA sequence. | *Lycopersicon esculentum* | 41,011 | Jun. 29, 1999 |
| | | GB_EST33:AI779784 | 362 | AI779784 | EST260663 tomato susceptible, Cornell *Lycopersicon esculentum* cDNA clone cLES9K1, mRNA sequence. | *Lycopersicon esculentum* | 41,011 | Jun. 29, 1999 |
| rxa02199 | 693 | GB_PR3:AC005274 | 205150 | AC005274 | *Homo sapiens* chromosome 17, clone hRPK.1090_M_7, complete sequence. | *Homo sapiens* | 36,337 | Jul. 29, 1998 |
| | | GB_HTG2:AC007732 | 110348 | AC007732 | *Homo sapiens* chromosome 17 clone hRPC.1030_A_12 map 17, *SEQUENCING IN PROGRESS*, 7 unordered pieces. | *Homo sapiens* | 35,924 | Jun. 5, 1999 |
| rxa02203 | 501 | GB_IN1:DMU11052 | 4871 | U11052 | *Drosophila melanogaster* peroxidasin precursor mRNA, complete cds. | *Drosophila melanogaster* | 39,873 | Jan. 26, 1995 |
| | | GB_EST17:AA642571 | 323 | AA642571 | nq73c08.s1 NCL_CGAP_Pr22 *Homo sapiens* cDNA clone IMAGE:1157966 3' similar to TR:G9372 G9372 UBIQUITIN; mRNA sequence. | *Homo sapiens* | 49,485 | Oct. 27, 1997 |
| rxa02206 | 1059 | GB_EST27:AI425489 | 312 | AI425489 | my32e11.y1 Barstead mouse pooled organs MPLRB4 *Mus musculus* cDNA clone IMAGE:697580 5', mRNA sequence. | *Mus musculus* | 40,514 | Mar. 9, 1999 |
| | | GB_EST23:AI154481 | 308 | AI154481 | ua03h07.r1 Soares 2NbMT *Mus musculus* cDNA clone IMAGE:1345693 5', mRNA sequence. | *Mus musculus* | 42,748 | Sep. 30, 1998 |
| | | GB_PR2:AP000269 | 70932 | AP000269 | *Homo sapiens* genomic DNA, chromosome 21q22.1, D21S226-AML region, clone:T293, complete sequence. | *Homo sapiens* | 39,306 | Nov. 20, 1999 |
| rxa02207 | 898 | GB_PL1:D32140 | 1360 | D32140 | *Cyanidioschyzon merolae* DNA for actin, complete cds. | *Cyanidioschyzon merolae* | 37,331 | Feb. 7, 1999 |
| | | GB_PR2:AP000269 | 70932 | AP000269 | *Homo sapiens* genomic DNA, chromosome 21q22.1, D21S226-AML region, clone:T293, complete sequence. | *Homo sapiens* | 35,481 | Nov. 20, 1999 |
| | | GB_EST21:AA982901 | 442 | AA982901 | vx59f07.r1 Stratagene mouse macrophage (#937306) *Mus musculus* cDNA clone IMAGE:1279525 5' similar to gb:X59543_ma1 RIBONUCLEOSIDE-DIPHOSPHATE REDUCTASE M1 CHAIN (HUMAN); gb:K02927 Mouse ribonucleotide reductase subunit M1 mRNA, complete (MOUSE); mRNA sequence. | *Mus musculus* | 42,141 | May 27, 1998 |
| | | GB_EST8:W85369 | 558 | W85369 | mf48h04.r1 Soares mouse embryo NbME 13.5 14.5 *Mus musculus* cDNA clone IMAGE:408343 *Mus musculus* 5' similar to gb:K02927 Mouse ribonucleotide reductase subunit M1 mRNA, complete | | 39,964 | Sep. 12, 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02211 | | GB_PAT:E14824 | 2379 | E14824 | (MOUSE); mRNA sequence. cDNA encoding M1 subunit of human ribonucleotide reductase. | Homo sapiens | 36,812 | Jul. 28, 1999 |
| rxa02212 | 621 | GB_HTG3:AC009518 | 241128 | AC009518 | Homo sapiens chromosome 7, **SEQUENCING IN PROGRESS**, 68 unordered pieces. | Homo sapiens | 36,542 | Sep. 1, 1999 |
| | | GB_HTG3:AC009518 | 241128 | AC009518 | Homo sapiens chromosome 7, **SEQUENCING IN PROGRESS**, 68 unordered pieces. | Homo sapiens | 36,542 | Sep. 1, 1999 |
| | | GB_HTG3:AC009518 | 241128 | AC009518 | Homo sapiens chromosome 7, **SEQUENCING IN PROGRESS**, 68 unordered pieces. | Homo sapiens | 41,382 | Sep. 1, 1999 |
| rxa02216 | 329 | GB_HTG2:AC007641 | 102402 | AC007641 | Mus musculus chromosome 10 clone 644_M_8 map 10, **SEQUENCING IN PROGRESS**, 7 unordered pieces. | Mus musculus | 31,307 | May 22, 1999 |
| | | GB_HTG2:AC007641 | 102402 | AC007641 | Mus musculus chromosome 10 clone 644_M_8 map 10, **SEQUENCING IN PROGRESS**, 7 unordered pieces. | Mus musculus | 31,307 | May 22, 1999 |
| | | GB_HTG2:AC007641 | 102402 | AC007641 | Mus musculus chromosome 10 clone 644_M_8 map 10, **SEQUENCING IN PROGRESS**, 7 unordered pieces. | Mus musculus | 32,198 | May 22, 1999 |
| rxa02217 | 786 | GB_RO:RNU91516 | 1540 | U91516 | Rattus norvegicus oxytocin receptor (OTR) gene, promoter region. | Rattus norvegicus | 36,256 | Nov. 25, 1997 |
| | | GB_RO:RNU91516 | 1540 | U91516 | Rattus norvegicus oxytocin receptor (OTR) gene, promoter region. | Rattus norvegicus | 37,176 | Nov. 25, 1997 |
| rxa02218 | 390 | GB_HTG3:AC008656 | 43033 | AC008656 | Homo sapiens chromosome 5 clone CIT978SKB_19416, **SEQUENCING IN PROGRESS**, 64 unordered pieces. | Homo sapiens | 39,894 | Aug. 3, 1999 |
| | | GB_HTG3:AC008656 | 43033 | AC008656 | Homo sapiens chromosome 5 clone CIT978SKB_19416, **SEQUENCING IN PROGRESS**, 64 unordered pieces. | Homo sapiens | 39,894 | Aug. 3, 1999 |
| | | GB_HTG3:AC008656 | 43033 | AC008656 | Homo sapiens chromosome 5 clone CIT978SKB_19416, **SEQUENCING IN PROGRESS**, 64 unordered pieces. | Homo sapiens | 37,598 | Aug. 3, 1999 |
| rxa02219 | 1509 | GB_PR3:HS475N16 | 113109 | AL035587 | Human DNA sequence from clone 475N16 on chromosome 6p12.3-21.2, complete sequence. | Homo sapiens | 36,266 | Nov. 23, 1999 |
| | | GB_PR3:HS475N16 | 113109 | AL035587 | Human DNA sequence from clone 475N16 on chromosome 6p12.3-21.2, complete sequence. | Homo sapiens | 35,255 | Nov. 23, 1999 |
| | | GB_EST10:AA142336 | 411 | AA142336 | ms07f02.r1 Stratagene mouse skin (#937313) Mus musculus cDNA clone IMAGE:606267 5' similar to SW:RCA1_YEAST P40341 MITOCHONDRIAL RESPIRATORY CHAIN COMPLEXES ASSEMBLY PROTEIN RCA1; mRNA sequence. | Mus musculus | 38,398 | Feb. 12, 1997 |
| rxa02221 | 1485 | GB_PR3:AC002422 | 160091 | AC002422 | Human Chromosome X, complete sequence. | Homo sapiens | 38,435 | Jan. 30, 1998 |
| | | GB_HTG2:AC006755 | 199917 | AC006755 | Caenorhabditis elegans clone Y40C5, **SEQUENCING IN PROGRESS**, 1 unordered pieces. | Caenorhabditis elegans | 39,229 | Feb. 23, 1999 |
| | | GB_HTG2:AC006755 | 199917 | AC006755 | Caenorhabditis elegans clone Y40C5, **SEQUENCING IN PROGRESS**, 1 unordered pieces. | Caenorhabditis elegans | 39,229 | Feb. 23, 1999 |
| rxa02223 | 601 | GB_HTG6:AC008224 | 199774 | AC008224 | Drosophila melanogaster chromosome 3 clone BACR29J02 (D817) RPCI-98 29.I.2 map 83D—83D strain y; cn bw sp, **SEQUENCING IN PROGRESS**, 37 unordered pieces. | Drosophila melanogaster | 35,333 | Nov. 24, 1999 |
| | | GB_HTG3:AC011511 | 158296 | AC011511 | Homo sapiens chromosome 19 clone CITB-H1_2369P2, **SEQUENCING IN PROGRESS**, 57 unordered pieces. | Homo sapiens | 35,593 | Oct. 7, 1999 |
| | | GB_HTG3:AC011511 | 158296 | AC011511 | Homo sapiens chromosome 19 clone CITB-H1_2369P2, **SEQUENCING IN PROGRESS**, 57 unordered pieces. | Homo sapiens | 35,593 | Oct. 7, 1999 |
| rxa02226 | 1156 | GB_HTG2:AC006890 | 298195 | AC006890 | Caenorhabditis elegans clone Y67D8x, **SEQUENCING IN PROGRESS**, 23 unordered pieces. | Caenorhabditis elegans | 36,810 | Feb. 24, 1999 |
| | | GB_HTG2:AC006890 | 298195 | AC006890 | Caenorhabditis elegans clone Y67D8x, **SEQUENCING IN PROGRESS**, 23 unordered pieces. | Caenorhabditis elegans | 35,433 | Feb. 24, 1999 |
| | | GB_HTG2:AC006890 | 298195 | AC006890 | Caenorhabditis elegans clone Y67D8x, **SEQUENCING IN PROGRESS**, 23 unordered pieces. | Caenorhabditis elegans | 36,810 | Feb. 24, 1999 |
| rxa02227 | 741 | GB_EST5:H98835 | 440 | H98835 | yx14f12.s1 Soares melanocyte 2NbHM Homo sapiens cDNA clone IMAGE:261743 3', mRNA sequence. | Homo sapiens | 38,182 | Dec. 15, 1995 |
| | | GB_EST5:N25530 | 586 | N25530 | yx76c03.s1 Soares melanocyte 2NbHM Homo sapiens cDNA clone IMAGE:267652 3', mRNA sequence. | Homo sapiens | 37,543 | Dec. 29, 1995 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_BA1:CGU43535 | 2531 | U43535 | *Corynebacterium glutamicum* multidrug resistance protein (cmr) gene, complete cds. | *Corynebacterium glutamicum* | 38,812 | Apr. 9, 1997 |
| rxa02230 | 660 | GB_EST16:AA570388 | 527 | AA570388 | nk62c08.s1 NCI_CGAP_Scht *Homo sapiens* cDNA clone IMAGE:1018094 3' similar to contains element MSR1 repetitive element; mRNA sequence. | *Homo sapiens* | 41,096 | Sep. 9, 1997 |
| | | GB_PR2:HSU43030 | 1539 | U43030 | Human cardiotrophin-1 (CTF1) mRNA, complete cds. | *Homo sapiens* | 36,335 | Jan. 9, 1996 |
| | | GB_IN1:CELK08B5 | 35728 | U41022 | *Caenorhabditis elegans* cosmid K08B5. | *Caenorhabditis elegans* | 35,387 | Nov. 30, 1995 |
| rxa02231 | 879 | GB_PL2:ATAC006429 | 94818 | AC006429 | *Arabidopsis thaliana* chromosome II BAC F15K19 genomic sequence, complete sequence. | *Arabidopsis thaliana* | 33,687 | Apr. 23, 1999 |
| | | GB_PR3:AC004554 | 195142 | AC004554 | *Homo sapiens* Xp22 BAC GSHB-59016 (Genome Systems Human BAC library) complete sequence. | *Homo sapiens* | 38,921 | May 30, 1998 |
| | | GB_HTG2:AC007853 | 116280 | AC007853 | *Drosophila melanogaster* chromosome 3 clone BACR03L02 (D766) RPCI-98 03.L.2 map 96B—96C strain y; cn bw sp, **SEQUENCING IN PROGRESS**, 80 unordered pieces. | *Drosophila melanogaster* | 36,237 | Aug. 2, 1999 |
| rxa02238 | 408 | GB_BA1:MTCY21B4 | 39150 | Z80108 | *Mycobacterium tuberculosis* H37Rv complete genome; segment 62/162. | *Mycobacterium tuberculosis* | 52,206 | Jun. 23, 1998 |
| | | GB_BA1:MTCY21B4 | 39150 | Z80108 | *Mycobacterium tuberculosis* H37Rv complete genome; segment 62/162. | *Mycobacterium tuberculosis* | 36,935 | Jun. 23, 1998 |
| rxa02244 | 1656 | GB_VI:AF105451 | 801 | AF105451 | HIV-1 isolate A-DII-07 from Italy, envelope glycoprotein, C2-V5 region (env) gene, partial cds. | Human immunodeficiency virus type 1 | 40,864 | Apr. 25, 1999 |
| | | GB_PR1:AB016195 | 10558 | AB016195 | *Homo sapiens* ELK1 pseudogene (ELK2) and immunoglobulin heavy chain gamma pseudogene (IGHGP). | *Homo sapiens* | 38,929 | Apr. 9, 1999 |
| | | GB_PR3:HSN21F1 | 39212 | Z94162 | Human DNA sequence from cosmid N21F1 on chromosome 22 Contains exon trap and STS, complete sequence. | *Homo sapiens* | 38,763 | Nov. 23, 1999 |
| rxa02254 | 800 | GB_IN1:DMAC001648 | 51989 | AC001648 | *Drosophila melanogaster* (P1 DS03431 (D102)) DNA sequence, complete sequence. | *Drosophila melanogaster* | 36,884 | Apr. 22, 1997 |
| | | GB_GSS12:AQ360240 | 541 | AQ360240 | HS_5035_A2_E07_T7 RPCI11 Human Male BAC Library *Homo sapiens* genomic clone Plate = 611 Col = 14 Row = I, genomic survey sequence. | *Homo sapiens* | 36,386 | Mar. 6, 1999 |
| | | GB_GSS11:AQ258453 | 620 | AQ258453 | nbxb0020L15f CUGI Rice BAC Library *Oryza sativa* genomic clone nbxb0020L15f, genomic survey sequence. | *Oryza sativa* | 36,271 | Oct. 23, 1998 |
| | | GB_GSS14:AQ577777 | 568 | AQ577777 | nbxb0091L17f CUGI Rice BAC Library *Oryza sativa* genomic clone nbxb0091L17f, genomic survey sequence. | *Oryza sativa* | 39,456 | Jun. 2, 1999 |
| rxa02255 | 1059 | GB_PR4:AC006332 | 153477 | AC006332 | *Homo sapiens* clone NH0376O14, complete sequence. | *Homo sapiens* | 35,019 | Nov. 11, 1999 |
| | | GB_PAT:E02669 | 1197 | E02669 | DNA encoding *Bacillus* sp. L-lactic acid dehydrogenase. | *Bacillus* sp. | 39,719 | Sep. 29, 1997 |
| | | GB_PL1:YSCBOI2 | 3201 | D38310 | Yeast BOI2 gene for Boi2p. | *Saccharomyces cerevisiae* | 35,769 | Feb. 8, 1999 |
| rxa02266 | 636 | GB_BA1:REGIONB | 4961 | Z13995 | *N. meningitidis* lipA and lipB genes for LipA and LipB proteins. | *Neisseria meningitidis* | 35,691 | Dec. 29, 1993 |
| | | GB_HTG1:AP000568 | 136627 | AP000568 | *Homo sapiens* chromosome 21 clone B753B2 map 21q21.2, **SEQUENCING IN PROGRESS**, in unordered pieces. | *Homo sapiens* | 37,500 | Oct. 7, 1999 |
| | | GB_HTG1:AP000568 | 136627 | AP000568 | *Homo sapiens* chromosome 21 clone B753B2 map 21q21.2, **SEQUENCING IN PROGRESS**, in unordered pieces. | *Homo sapiens* | 37,500 | Oct. 7, 1999 |
| rxa02267 | 996 | GB_PR4:AC007283 | 127361 | AC007283 | *Homo sapiens* clone NH0536I18, complete sequence. | *Homo sapiens* | 37,155 | Sep. 28, 1999 |
| | | GB_IN1:CEC54C6 | 35500 | Z77131 | *Caenorhabditis elegans* cosmid C54C6, complete sequence. | *Caenorhabditis elegans* | 38,280 | Nov. 23, 1998 |
| | | GB_HTG3:AC008905 | 129915 | AC008905 | *Homo sapiens* chromosome 5 clone CITB-H1_225914, **SEQUENCING IN PROGRESS**, 40 unordered pieces. | *Homo sapiens* | 35,895 | Aug. 3, 1999 |
| rxa02271 | 681 | GB_HTG3:AC007441 | 219832 | AC007441 | *Drosophila melanogaster* chromosome 3 clone BACR10E03 (D690) RPCI-98 10 E.3 map 88A—88B strain y; cn bw sp, **SEQUENCING IN PROGRESS**, 188 unordered pieces. | *Drosophila melanogaster* | 33,284 | Oct. 8, 1999 |
| | | GB_HTG3:AC007441 | 219832 | AC007441 | *Drosophila melanogaster* chromosome 3 clone BACR10E03 (D690) RPCI-98 10.E.3 map 88A—88B strain y; cn bw sp, **SEQUENCING IN PROGRESS**, 188 unordered pieces. | *Drosophila melanogaster* | 33,284 | Oct. 8, 1999 |
| | | GB_HTG3:AC008029 | 123186 | AC008029 | *Drosophila melanogaster* chromosome 3 clone BACR01C11 (D819) RPCI-98 01.C.11 map 84D—84D strain y; cn bw sp, **SEQUENCING IN PROGRESS**, 92 unordered pieces. | *Drosophila melanogaster* | 34,315 | Aug. 2, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02279 | 1581 | GB_IN1:AC003121 | 69822 | AC003121 | *Drosophila melanogaster* (P1 DS00329 (D89)) DNA sequence, complete sequence. | *Drosophila melanogaster* | 38,046 | Nov. 26, 1997 |
| | | GB_IN1:AC003121 | 69822 | AC003121 | *Drosophila melanogaster* (P1 DS00329 (D89)) DNA sequence, complete sequence. | *Drosophila melanogaster* | 39,220 | Nov. 26, 1997 |
| | | GB_BA1:MTCY39 | 38500 | Z74025 | *Mycobacterium tuberculosis* H37Rv complete genome; segment 89/162. | *Mycobacterium tuberculosis* | 39,685 | Jun. 17, 1998 |
| rxa02280 | | | | | | | | |
| rxa02286 | 672 | GB_BA1:MTV025 | 121125 | AL022121 | *Mycobacterium tuberculosis* H37Rv complete genome; segment 155/162. | *Mycobacterium tuberculosis* | 36,953 | Jun. 24, 1999 |
| | | GB_PL2:AC002130 | 114738 | AC002130 | The sequence of BAC F1N21 from *Arabidopsis thaliana* chromosome 1, complete sequence. | *Arabidopsis thaliana* | 39,216 | Jan. 8, 1998 |
| | | GB_PL2:AC007259 | 97146 | AC007259 | *Arabidopsis thaliana* chromosome I BAC T28P6 genomic sequence, complete sequence. | *Arabidopsis thaliana* | 36,090 | Aug. 17, 1999 |
| rxa02287 | 675 | GB_HTG3:AC009281 | 221178 | AC009281 | *Homo sapiens* chromosome 15 clone 8_C_22 map 15, **SEQUENCING IN PROGRESS*, 49 unordered pieces. | *Homo sapiens* | 35,565 | Aug. 12, 1999 |
| | | GB_HTG3:AC009281 | 221178 | AC009281 | *Homo sapiens* chromosome 15 clone 8_C_22 map 15, **SEQUENCING IN PROGRESS*, 49 unordered pieces. | *Homo sapiens* | 35,565 | Aug. 12, 1999 |
| | | GB_RO:MUSMURINC | 4597 | M65736 | Mouse murinoglobulin mRNA, complete cds. | *Mus musculus* | 38,485 | Apr. 27, 1993 |
| rxa02294 | 498 | GB_EST19:AA813194 | 398 | AA813194 | ai80g12.s1 Soares_testis_NHT *Homo sapiens* cDNA clone 1377190 3', mRNA sequence. | *Homo sapiens* | 36,797 | Dec. 31, 1998 |
| | | GB_EST19:AA813194 | 398 | AA813194 | ai80g12.s1 Soares_testis_NHT *Homo sapiens* cDNA clone 1377190 3', mRNA sequence. | *Homo sapiens* | 33,417 | Dec. 31, 1998 |
| rxa02295 | 903 | GB_PAT:I89451 | 18318 | I89451 | Sequence 6 from U.S. Pat. No. 5721354. | Unknown. | 38,839 | Aug. 10, 1998 |
| | | GB_VI:HCU33331 | 18535 | U33331 | Human cytomegalovirus Toledo strain UL/b region. | human herpesvirus 5 | 38,839 | Jan. 27, 1996 |
| | | GB_PR3:HS550H1 | 108803 | AL035420 | Human DNA sequence from clone 550H1 on chromosome 20q11.1-11.22 Contains a pseudogene similar to HIGH MOBILITY GROUP PROTEIN 2A, a novel mRNA, ESTs, STSs, GSSs and CpG Islands, complete sequence. | *Homo sapiens* | 38,796 | Nov. 23, 1999 |
| rxa02296 | 612 | GB_BA2:AF065312 | 1694 | AF065312 | *Yersinia pestis* hypothetical protein (yceG) gene, partial cds; thymidylate kinase (tmk) gene, complete cds; and putative DNA polymerase III delta subunit (holB) gene, partial cds. | *Yersinia pestis* | 41,351 | Nov. 16, 1999 |
| | | GB_PR3:HS550H1 | 108803 | AL035420 | Human DNA sequence from clone 550H1 on chromosome 20q11.1-11.22 Contains a pseudogene similar to HIGH MOBILITY GROUP PROTEIN 2A, a novel mRNA, ESTs, STSs, GSSs and CpG Islands, complete sequence. | *Homo sapiens* | 37,919 | Nov. 23, 1999 |
| | | GB_PR3:HS550H1 | 108803 | AL035420 | Human DNA sequence from clone 550H1 on chromosome 20q11.1-11.22 Contains a pseudogene similar to HIGH MOBILITY GROUP PROTEIN 2A, a novel mRNA, ESTs, STSs, GSSs and CpG Islands, complete sequence. | *Homo sapiens* | 37,607 | Nov. 23, 1999 |
| rxa02297 | 1260 | GB_BA2:AF065312 | 1694 | AF065312 | *Yersinia pestis* hypothetical protein (yceG) gene, partial cds; thymidylate kinase (tmk) gene, complete cds; and putative DNA polymerase III delta subunit (holB) gene, partial cds. | *Yersinia pestis* | 39,683 | Nov. 16, 1999 |
| | | GB_RO:AF007836 | 5655 | AF007836 | *Rattus norvegicus* rab3 effector (RIM) mRNA, alternatively spliced, complete cds. | *Rattus norvegicus* | 37,844 | Aug. 15, 1997 |
| | | GB_IN2:EGU27015 | 2394 | U27015 | *Echinococcus granulosus* 18S ribosomal RNA gene, complete sequence. | *Echinococcus granulosus* | 38,710 | Jul. 16, 1996 |
| rxa02298 | 1782 | GB_BA2:AF116184 | 540 | AF116184 | *Corynebacterium glutamicum* L-aspartate-alpha-decarboxylase precursor (panD) gene, complete cds. | *Corynebacterium glutamicum* | 44,231 | May 2, 1999 |
| | | GB_BA2:AF116184 | 540 | AF116184 | *Corynebacterium glutamicum* L-aspartate-alpha-decarboxylase precursor (panD) gene, complete cds. | *Corynebacterium glutamicum* | 42,007 | May 2, 1999 |
| rxa02300 | 456 | GB_BA2:AF116184 | 540 | AF116184 | *Corynebacterium glutamicum* L-aspartate-alpha-decarboxylase precursor (panD) gene, complete cds. | *Corynebacterium glutamicum* | 46,250 | May 2, 1999 |
| | | GB_BA1:MTV004 | 69350 | AL009198 | *Mycobacterium tuberculosis* H37Rv complete genome; segment 144/162. | *Mycobacterium tuberculosis* | 39,602 | Jun. 18, 1998 |
| rxa02301 | 840 | GB_EST22:AI048692 | 172 | AI048692 | ub30g04.r1 Soares 2NbMT *Mus musculus* cDNA clone IMAGE:1379286 5', mRNA sequence. | *Mus musculus* | 43,284 | Jul. 8, 1998 |
| | | GB_HTG3:AC008573 | 205755 | AC008573 | *Homo sapiens* chromosome 5 clone CIT-HSPC_551I11, *SEQUENCING IN PROGRESS*, 95 unordered pieces. | *Homo sapiens* | 35,115 | Aug. 3, 1999 |
| | | GB_HTG3:AC008573 | 205755 | AC008573 | *Homo sapiens* chromosome 5 clone CIT-HSPC_551I11, *SEQUENCING IN PROGRESS*, 95 unordered pieces. | *Homo sapiens* | 35,115 | Aug. 3, 1999 |

TABLE 4-continued

ALIGNMENT RESULTS

| ID # | length (NT) | Genbank Hit | Genbank Hit Accession | Length | Accession | Name of Genbank Hit | Source of Genbank Hit | % homology (GAP) | Date of Deposit |
|---|---|---|---|---|---|---|---|---|---|
| rxa02302 |  | GB_HTG3:AC008573 | AC008573 | 205755 |  | *Homo sapiens* chromosome 5 clone CIT-HSPC_551I11, *SEQUENCING IN PROGRESS*, 95 unordered pieces. | *Homo sapiens* | 36,527 | Aug. 3, 1999 |
|  | 1002 | GB_HTG6:AC008076 | AC008076 | 200000 |  | *Homo sapiens* chromosome 4, *SEQUENCING IN PROGRESS*, 18 unordered pieces. | *Homo sapiens* | 34,884 | Dec. 2, 1999 |
|  |  | GB_HTG3:AC008930 | AC008930 | 258026 |  | *Homo sapiens* chromosome 5 clone CITB-H1_2292M9, *SEQUENCING IN PROGRESS*, 166 unordered pieces. | *Homo sapiens* | 36,945 | Aug. 3, 1999 |
|  |  | GB_HTG3:AC008930 | AC008930 | 258026 |  | *Homo sapiens* chromosome 5 clone CITB-H1_2292M9, *SEQUENCING IN PROGRESS*, 166 unordered pieces. | *Homo sapiens* | 36,945 | Aug. 3, 1999 |
| rxa02303 |  |  |  |  |  |  |  |  |  |
| rxa02304 | 1014 | GB_PAT:A69720 | A69720 | 53789 |  | Sequence 3 from Patent WO9807868. | unidentified | 36,915 | May 7, 1999 |
|  |  | GB_BA1:AMM223012 | AJ223012 | 53784 |  | *Amycolatopsis mediterranei* genes encoding rifamycin polyketide synthases, ORFs 1 to 5. | *Amycolatopsis mediterranei* | 36,915 | Feb. 9, 1998 |
|  |  | GB_BA2:AF040570 | AF040570 | 76199 |  | *Amycolatopsis mediterranei* rifamycin biosynthetic gene cluster. | *Amycolatopsis mediterranei* | 36,915 | Feb. 5, 1998 |
| rxa02307 |  |  |  |  |  |  |  |  |  |
| rxa02308 | 552 | GB_HTG3:AC009340 | AC009340 | 110415 |  | *Drosophila melanogaster* chromosome 2 clone BACR04E19 (D1026) RPCI-98 04.E.19 map 34A-34E strain y; cn bw sp, *SEQUENCING IN PROGRESS*, 103 unordered pieces. | *Drosophila melanogaster* | 36,066 | Aug. 27, 1999 |
|  |  | GB_HTG3:AC009340 | AC009340 | 110415 |  | *Drosophila melanogaster* chromosome 2 clone BACR04E19 (D1026) RPCI-98 04.E.19 map 34A-34E strain y; cn bw sp, *SEQUENCING IN PROGRESS*, 103 unordered pieces. | *Drosophila melanogaster* | 36,068 | Aug. 27, 1999 |
|  |  | GB_IN2:AC005656 | AC005656 | 48843 |  | *Drosophila melanogaster* chromosome 2R, region 34B6–34C2, P1 clone DS08787, complete sequence. | *Drosophila melanogaster* | 46,154 | Feb. 6, 1999 |
| rxa02314 | 564 | GB_HTG5:AC011247 | AC011247 | 206436 |  | *Homo sapiens* clone NH0541E12, WORKING DRAFT SEQUENCE, 1 unordered pieces. | *Homo sapiens* | 36,201 | Nov. 13, 1999 |
|  |  | GB_HTG5:AC011247 | AC011247 | 206436 |  | *Homo sapiens* clone NH0541E12, WORKING DRAFT SEQUENCE, 1 unordered pieces. | *Homo sapiens* | 35,036 | Nov. 13, 1999 |
|  |  | GB_HTG3:AC011152 | AC011152 | 142616 |  | *Homo sapiens* clone 7_H_4, LOW-PASS SEQUENCE SAMPLING. | *Homo sapiens* | 35,548 | Oct. 1, 1999 |
| rxa02324 | 1209 | GB_BA2:AF110185 | AF110185 | 20302 |  | *Burkholderia pseudomallei* strain 1026b DbhB (dbhB), general secretory pathway protein D (gspD), general secretory pathway protein E (gspE), general secretory pathway protein F (gspF), GspC (gspC), general secretory pathway protein G (gspG), general secretory pathway protein H (gspH), general secretory pathway protein I (gspI), general secretory pathway protein J (gspJ), general secretory pathway protein K (gspK), general secretory pathway protein L (gspL), general secretory pathway protein M (gspM), and general secretory pathway protein N (gspN) genes, complete cds; and unknown genes. | *Burkholderia pseudomallei* | 39,670 | Aug. 2, 1999 |
|  |  | GB_BA1:PSEAMNH | D90216 | 5215 |  | *P. chlororaphis* genes for amidase (EC 3.5.1.4) and for nitrile hydratase (EC 4.2.1.84). | *Pseudomonas chlororaphis* | 51,254 | Feb. 7, 1999 |
|  |  | GB_PAT:E12519 | E12519 | 4775 |  | Nucleotide sequence of *Rhodococcus rhodochrous* genomic DNA region containing amidase and nitrilehydratase genes. | *Rhodococcus rhodochrous* | 51,646 | Jun. 24, 1998 |
| rxa02325 | 990 | GB_BA1:CGPYC | Y09548 | 3728 |  | *Corynebacterium glutamicum* pyc gene. | *Corynebacterium glutamicum* | 100,000 | May 8, 1998 |
| rxa02331 | 489 | GB_PR4:AC006079 | AC006079 | 178109 |  | *Homo sapiens* chromosome 17, clone hRPK.855_D_21, complete sequence. | *Homo sapiens* | 37,807 | Dec. 12, 1998 |
|  |  | GB_GSS8:AQ036832 | AQ036832 | 441 |  | CIT-HSP-2334L1.1TF CIT-HSP *Homo sapiens* genomic clone 2334L1, genomic survey sequence. | *Homo sapiens* | 42,359 | Jul. 11, 1998 |
|  |  | GB_PL1:YSKGA11 | M68870 | 4159 |  | *Kluyveromyces lactis* transcriptional activator (GAL11) gene, complete cds. | *Kluyveromyces lactis* | 40,252 | May 14, 1993 |
|  |  | GB_PR2:HSAY18950 | Y18950 | 584 |  | *Homo sapiens* partial gene for caspase-9, intronic sequence (584 bp). | *Homo sapiens* | 40,529 | Oct. 8, 1999 |
|  |  | GB_PL1:YSKGA11 | M68870 | 4159 |  | *Kluyveromyces lactis* transcriptional activator (GAL11) gene, complete cds. | *Kluyveromyces lactis* | 38,679 | May 14, 1993 |
| rxa02336 | 303 | GB_BA1:CGU35023 | U35023 | 3195 |  | *Corynebacterium glutamicum* thiosulfate sulfurtransferase (thtR) gene, partial cds, acyl CoA carboxylase (accBC) gene, complete cds. | *Corynebacterium glutamicum* | 35,548 | Jan. 16, 1997 |
|  |  | GB_PL2:AF114171 | AF114171 | 183990 |  | *Sorghum bicolor* BAC clone 25 M18, complete sequence. | *Sorghum bicolor* | 41,414 | Apr. 25, 1999 |
|  |  | GB_PR4:AC006324 | AC006324 | 157310 |  | *Homo sapiens* clone DJ1164F05, complete sequence. | *Homo sapiens* | 41,785 | Nov. 11, 1999 |
| rxa02337 | 1446 | GB_BA1:CGU35023 | U35023 | 3195 |  | *Corynebacterium glutamicum* thiosulfate sulfurtransferase (thtR) gene, partial cds, acyl CoA | *Corynebacterium* | 100,000 | Jan. 16, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_BA1:MTCY22G8 | 22550 | Z95585 | carboxylase (accBC) gene, complete cds. Mycobacterium tuberculosis H37Rv complete genome, segment 49/162. | Mycobacterium tuberculosis | 38,072 | Jun. 17, 1998 |
| rxa02339 | 515 | GB_PR2:HSAY18950 | 584 | Y18950 | Homo sapiens partial gene for caspase-9, intronic sequence (584 bp). | Homo sapiens | 42,949 | Oct. 8, 1999 |
| | | GB_PR2:HS149A16 | 173354 | AL021937 | Human DNA sequence from clone 149A16 on chromosome 22q12-13. Contains an IGLC (immunoglobulin Lambda Chain C) pseudogene, the RFPL3 and RFPL3S genes for Ret finger protein-like 3 and Ret finger protein-like 3 antisense respectively, a gene for a novel immunoglobulin Lambda Chain V family protein, a novel gene for a protein similar to mouse RGDS (RALGDS, RALGEF, Guanine Nucleotide Dissociation Stimulator A) and rabbit oncogene RSC, a novel gene for the human ortholog of worm F16A11.2 and bacterial and archea-bacterial predicted proteins, a novel gene for a protein similar to BPI (Bacterial Permeability-Increading Protein) and rabbit LBP (Liposaccharide-Binding Protein), and a the 5' part of a novel gene. Contains ESTs, STSs, GSS, genomic marker D22S1175, a ca repeat polymorphism and putative CpG islands, complete sequence. | Homo sapiens | 37,376 | Nov. 23, 1999 |
| | | GB_HTG3:AC009726 | 177618 | AC009726 | Homo sapiens chromosome 18 clone 263_O_14 map 18, **SEQUENCING IN PROGRESS*, 12 unordered pieces. | Homo sapiens | 37,037 | Aug. 29, 1999 |
| | | GB_HTG3:AC009726 | 177618 | AC009726 | Homo sapiens chromosome 18 clone 263_O_14 map 18, **SEQUENCING IN PROGRESS*, 12 unordered pieces. | Homo sapiens | 37,037 | Aug. 29, 1999 |
| rxa02340 | 1188 | GB_VI:AF063866 | 236120 | AF063866 | Melanoplus sanguinipes entomopoxvirus, complete genome. | Melanoplus sanguinipes entomopoxvirus | 34,480 | Dec. 22, 1998 |
| | | GB_HTG4:AC011089 | 171283 | AC011089 | Homo sapiens chromosome 2 clone 303_K_20 map 2, **SEQUENCING IN PROGRESS* 25 ordered pieces. | Homo sapiens | 37,757 | Oct. 14, 1999 |
| | | GB_HTG4:AC011089 | 171283 | AC011089 | Homo sapiens chromosome 2 clone 303_K_20 map 2, **SEQUENCING IN PROGRESS* 25 ordered pieces. | Homo sapiens | 37,757 | Oct. 14, 1999 |
| rxa02341 | 609 | GB_GSS14:AQ580594 | 303 | AQ580594 | RPCI-11-452K5.TJ RPCI-11 Homo sapiens genomic clone RPCI-11-452K5, genomic survey sequence. | Homo sapiens | 38,305 | Jun. 7, 1999 |
| | | GB_GSS12:AQ393454 | 561 | AQ393454 | CITBI-E1-2556E3.TR CITBI-E1 Homo sapiens genomic clone 2556E3, genomic survey sequence. | Homo sapiens | 37,882 | Mar. 6, 1999 |
| | | GB_GSS14:AQ507468 | 627 | AQ507468 | RPCI-11-298O19.TJ RPCI-11 Homo sapiens genomic clone RPCI-11-298O19, genomic survey sequence. | Homo sapiens | 38,480 | Apr. 29, 1999 |
| rxa02347 | 444 | GB_PR3:AC005549 | 147416 | AC005549 | Homo sapiens chromosome 17, clone hRPK.215_E_13, complete sequence. | Homo sapiens | 39,909 | Sep. 22, 1998 |
| | | GB_PR3:AC005549 | 147416 | AC005549 | Homo sapiens chromosome 17, clone hRPK.215_E_13, complete sequence. | Homo sapiens | 33,784 | Sep. 22, 1998 |
| | | GB_GSS8:B92789 | 742 | B92789 | CIT-HSP-2164J8.TR CIT-HSP Homo sapiens genomic clone 2164J8, genomic survey sequence. | Homo sapiens | 39,409 | Jun. 25, 1998 |
| rxa02349 | | | | | | | | |
| rxa02352 | 578 | GB_EST19:AA738949 | 396 | AA738949 | vv68d12.r1 Stratagene mouse skin (#937313) Mus musculus cDNA clone IMAGE:1227575 5', mRNA sequence. | Mus musculus | 36,023 | Jan. 14, 1998 |
| | | GB_GSS14:AQ526017 | 500 | AQ526017 | HS_5329_A2_F02_T7A RPCI-11 Human Male BAC Library Homo sapiens genomic clone Plate = 905 Col = 4 Row = K, genomic survey sequence. | Homo sapiens | 38,537 | May 11, 1999 |
| | | GB_PR3:U82695 | 167460 | U82695 | Homo sapiens cosmid LM1937 from Xq28. | Homo sapiens | 38,421 | Jan. 3, 1998 |
| rxa02356 | 1119 | GB_BA1:MTCY16B7 | 43430 | Z81331 | Mycobacterium tuberculosis H37Rv complete genome; segment 123/162. | Mycobacterium tuberculosis | 39,087 | Jun. 17, 1998 |
| | | GB_BA1:SRMSIK | 2384 | Y08921 | S. reticuli gene encoding Msik protein and orf1. | Streptomyces reticuli | 58,356 | Mar. 21, 1997 |
| | | GB_BA1:MSGY414A | 40121 | AD000007 | Mycobacterium tuberculosis sequence from clone y414a. | Mycobacterium tuberculosis | 58,423 | Dec. 3, 1996 |
| rxa02358 | 414 | GB_BA1:BSUB0021 | 215534 | Z99124 | Bacillus subtilis complete genome (section 21 of 21) from 3999281 to 4214814. | Bacillus subtilis | 36,829 | Nov. 26, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_PR3:HSDA22P16 | 103367 | AL049641 | Human DNA sequence *SEQUENCING IN PROGRESS* from clone DA22P16, complete sequence. | Homo sapiens | 36,430 | Nov. 23, 1999 |
| rxa02360 | 2556 | GB_BA1:BSUB0021 | 215534 | Z99124 | Bacillus subtilis complete genome (section 21 of 21) from 3999281 to 4214814. | Bacillus subtilis | 37,440 | Nov. 26, 1997 |
| | | GB_EST21:AA970555 | 420 | AA970555 | oo94h05.s1 NCI_CGAP_Kid5 Homo sapiens cDNA clone IMAGE:1573881 3' similar to gb:X61970 PROTEASOME ZETA CHAIN (HUMAN); mRNA sequence. | Homo sapiens | 36,905 | May 20, 1998 |
| | | GB_GSS4:AQ739589 | 909 | AQ739589 | HS_5381_B2_G06_T7A RPCI-11 Human Male BAC Library Homo sapiens genomic clone Plate = 957 Col = 12 Row = N, genomic survey sequence. | Homo sapiens | 44,912 | Jul. 16, 1999 |
| rxa02361 | 774 | GB_IN1:CEY53H1C | 37004 | AL117201 | Caenorhabditis elegans cosmid Y53H1C, complete sequence. | Caenorhabditis elegans | 38,436 | Nov. 19, 1999 |
| | | GB_IN2:CELK04F10 | 35413 | AF039719 | Caenorhabditis elegans cosmid K04F10. | Caenorhabditis elegans | 36,891 | May 26, 1999 |
| | | GB_PL1:AB011477 | 78181 | AB011477 | Arabidopsis thaliana genomic DNA, chromosome 5, P1 clone: MHK7, complete sequence. | Arabidopsis thaliana | 37,095 | Nov. 20, 1999 |
| | | GB_PL1:AB011477 | 78181 | AB011477 | Arabidopsis thaliana genomic DNA, chromosome 5, P1 clone: MHK7, complete sequence. | Arabidopsis thaliana | 36,794 | Nov. 20, 1999 |
| rxa02362 | 3822 | GB_EST18:AA178985 | 357 | AA178985 | zp12g08.s1 Stratagene fetal retina 937202 Homo sapiens cDNA clone IMAGE:609278 3', mRNA sequence. | Homo sapiens | 39,875 | Dec. 31, 1996 |
| | | GB_GSS4:AQ710468 | 555 | AQ710468 | HS_5336_A2_B09_T7A RPCI-11 Human Male BAC Library Homo sapiens genomic clone Plate = 912 Col = 18 Row = C, genomic survey sequence. | Homo sapiens | 39,820 | Jul. 13, 1999 |
| | | GB_EST37:AI986900 | 380 | AI986900 | rs19a09.y1 Sommer Pristionchus Pristionchus pacificus cDNA clone IMAGE: 5' similar to WP:C06A1.1 CE02114 TRANSITIONAL ENDOPLASMIC RETICULUM ATPASE HOMOLOG 1; mRNA sequence. | Pristionchus pacificus | 42,105 | Sep. 1, 1999 |
| rxa02387 | 732 | GB_BA2:SCF76 | 18292 | AL121600 | Streptomyces coelicolor cosmid F76. | Streptomyces coelicolor A3(2) | 40,195 | Sep. 29, 1999 |
| | | GB_SY:SCU53587 | 4546 | U53587 | Artificial Corynebacterium glutamicum IS1207-derived transposon transposase genes, complete cds, and 3'5''-aminoglycoside phosphotransferase (aphA-3) gene, complete cds. | synthetic construct | 36,755 | May 6, 1996 |
| | | GB_PAT1:E16763 | 2517 | E16763 | gDNA encoding aspartate transferase (AAT). | Corynebacterium glutamicum | 38,687 | Jul. 28, 1999 |
| rxa02368 | | | | | | | | |
| rxa02374 | 744 | GB_PL2:AC010924 | 80442 | AC010924 | Arabidopsis thaliana chromosome 1 BAC T24D18 sequence, complete sequence. | Arabidopsis thaliana | 39,261 | Nov. 6, 1999 |
| | | GB_VI:HEICG | 152261 | X14112 | Herpes simplex virus (HSV) type 1 complete genome. | human herpesvirus 1 | 39,856 | Apr. 17, 1997 |
| | | GB_VI:HS1U1R | 108360 | D10879 | Herpes simplex virus type 1 long unique region UL. | human herpesvirus 1 | 39,856 | Feb. 3, 1999 |
| rxa02381 | 1146 | GB_BA1:CGPROAGEN | 1783 | X82929 | C. glutamicum proA gene. | Corynebacterium glutamicum | 98,974 | Jan. 23, 1997 |
| | | GB_BA1:CGPROAGEN | 1783 | X82929 | C. glutamicum proA gene. | Corynebacterium glutamicum | 37,156 | Jan. 23, 1997 |
| | | GB_GSS10:AQ215523 | 445 | AQ215523 | HS_2259_B2_F03_MR CIT Approved Human Genomic Sperm Library D Homo sapiens genomic clone Plate = 2259 Col = 6 Row = L, genomic survey sequence. | Homo sapiens | 40,674 | Sep. 19, 1998 |
| rxa02383 | 736 | GB_EST35:AI810729 | 450 | AI810729 | tt86t09.x1 NCI_CGAP_Prc28 Homo sapiens cDNA clone IMAGE:2248481 3', mRNA sequence. | Homo sapiens | 41,568 | Jul. 7, 1999 |
| | | GB_EST22:AI048725 | 347 | AI048725 | ub31d01.r1 Soares 2NbMT Mus musculus cDNA clone IMAGE:1379329 5', mRNA sequence. | Mus musculus | 39,412 | Jul. 8, 1998 |
| | | GB_EST15:AA466288 | 431 | AA466288 | vh34c01.r1 Barstead mouse pooled organs MPLRB4 Mus musculus cDNA clone IMAGE:888864 5', mRNA sequence. | Mus musculus | 39,336 | Jun. 11, 1997 |
| rxa02387 | 885 | GB_PR3:AC004687 | 175120 | AC004687 | Homo sapiens chromosome 17, clone hRPC.1171_I_10, complete sequence. | Homo sapiens | 34,518 | Jun. 26, 1998 |
| | | GB_PR3:AC004687 | 175120 | AC004687 | Homo sapiens chromosome 17, clone hRPC.1171_I_10, complete sequence. | Homo sapiens | 38,551 | Jun. 26, 1998 |
| | | GB_GSS15:AQ604975 | 536 | AQ604975 | HS_2135_B2_G04_T7C CIT Approved Human Genomic Sperm Library D Homo sapiens genomic clone Plate = 2135 Col = 8 Row = N, genomic survey sequence. | Homo sapiens | 39,321 | Jun. 10, 1999 |
| rxa02390 | 792 | GB_BA2:SC51A | 42527 | AL121596 | Streptomyces coelicolor cosmid 51A. | Streptomyces coelicolor A3(2) | 38,804 | Sep. 28, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02393 | 405 | GB_BA2:AF073776 | 5138 | AF073776 | Pseudomonas aeruginosa MexZ (mexZ), complete cds; and mexGH operon, complete sequence. | Pseudomonas aeruginosa | 37,245 | Oct. 19, 1998 |
| | | GB_BA1:AB015853 | 5461 | AB015853 | Pseudomonas aeruginosa gene for MexX and MexY, complete cds. | Pseudomonas aeruginosa | 40,641 | Nov. 13, 1998 |
| | | GB_BA1:RCU57682 | 86896 | U57682 | Rhodobacter capsulatus cosmids 143-147, complete sequence. | Rhodobacter capsulatus | 44,246 | Feb. 7, 1997 |
| | | GB_PL2:T2K10 | 88037 | AC005966 | Arabidopsis thaliana chromosome 1 BAC T2K10 sequence, complete sequence. | Arabidopsis thaliana | 42,455 | Feb. 10, 1999 |
| | | GB_PL2:T24H24 | 88848 | AF075598 | Arabidopsis thaliana BAC T24H24. | Arabidopsis thaliana | 34,826 | Aug. 3, 1998 |
| rxa02395 | 2013 | GB_BA1:SC5F2A | 40105 | AL049587 | Streptomyces coelicolor cosmid 5F2A. | Streptomyces coelicolor | 51,688 | May 24, 1999 |
| | | GB_BA1:CGBETPGEN | 2339 | X93514 | C. glutamicum betP gene. | Corynebacterium glutamicum | 48,877 | Sep. 8, 1997 |
| | | GB_PL2:AF015436 | 682 | AF015436 | Liquidambar formosane internal transcribed spacer 1, 5.8S ribosomal RNA gene; and internal transcribed spacer 2, complete sequence. | Liquidambar formosana | 36,217 | Feb. 1, 1999 |
| rxa02396 | 402 | GB_BA2:AE000070 | 9973 | AE000070 | Rhizobium sp. NGR234 plasmid pNGR234a, section 7 of 46 of the complete plasmid sequence. | Rhizobium sp. NGR234 | 35,572 | Dec. 12, 1997 |
| | | GB_BA2:AE000070 | 9973 | AE000070 | Rhizobium sp. NGR234 plasmid pNGR234a, section 7 of 46 of the complete plasmid sequence. | Rhizobium sp. NGR234 | 37,436 | Dec. 12, 1997 |
| | | GB_BA1:CVAJ677 | 1087 | AJ000677 | Chromatium vinosum recA gene. | Allochromatium vinosum | 37,500 | Aug. 8, 1997 |
| rxa02398 | 1725 | GB_PR1:HUMJUNA | 3622 | J04111 | Human c-jun proto oncogene (JUN), complete cds, clone hCJ-1. | Homo sapiens | 37,806 | Jan. 6, 1995 |
| | | GB_EST35:AL041724 | 462 | AL041724 | DKFZp434O0317_r1 434 (synonym; htes3) Homo sapiens cDNA clone DKFZp434O0317 5', mRNA sequence. | Homo sapiens | 40,260 | Sep. 29, 1999 |
| rxa02403 | 888 | GB_PAT:I96176 | 3622 | I96176 | Sequence 13 from U.S. Pat. No. 5734039. | Unknown. | 37,806 | Dec. 1, 1998 |
| | | GB_BA1:CGACEB | 3024 | X78491 | C. glutamicum (ATCC 13032) aceB gene. | Corynebacterium glutamicum | 47,410 | Jan. 13, 1995 |
| | | GB_BA1:CORACEB | 2725 | L27123 | Corynebacterium glutamicum malate synthase (aceB) gene, complete cds. | Corynebacterium glutamicum | 43,981 | Jun. 8, 1995 |
| rxa02406 | 672 | GB_IN1:CEK06A4 | 34006 | Z70755 | Caenorhabditis elegans cosmid K06A4, complete sequence. | Caenorhabditis elegans | 37,875 | Nov. 23, 1998 |
| | | GB_EST22:AI062160 | 629 | AI062160 | GH01261.5prime GH Drosophila melanogaster head pOT2 Drosophila melanogaster cDNA clone GH01261 5prime, mRNA sequence. | Drosophila melanogaster | 37,687 | Nov. 24, 1998 |
| rxa02407 | 495 | GB_PR1:HSRPIILS | 6732 | X63564 | H. sapiens mRNA for RNA polymerase II largest subunit. | Homo sapiens | 36,486 | Feb. 13, 1992 |
| | | GB_PR1:HSRPIILS | 6732 | X63564 | H. sapiens mRNA for RNA polymerase II largest subunit. | Homo sapiens | 38,813 | Feb. 13, 1992 |
| | | GB_BA1:MTCY130 | 32514 | Z73902 | Mycobacterium tuberculosis H37Rv complete genome; segment 59/162. | Mycobacterium tuberculosis | 54,321 | Jun. 17, 1998 |
| | | GB_BA1:MSGY151 | 37036 | AD000018 | Mycobacterium tuberculosis sequence from clone y151. | Mycobacterium tuberculosis | 40,000 | Dec. 10, 1996 |
| | | GB_EST19:AA391133 | 474 | AA391133 | LD10081.5prime LD Drosophila melanogaster embryo BlueScript Drosophila melanogaster cDNA clone LD10081 5prime, mRNA sequence. | Drosophila melanogaster | 38,015 | Nov. 27, 1998 |
| rxa02408 | 1035 | GB_PAT:I92047 | 551 | I92047 | Sequence 14 from U.S. Pat. No. 5726299. | Unknown. | 46,000 | Dec. 1, 1998 |
| | | GB_PAT:I78759 | 549 | I78759 | Sequence 15 from U.S. Pat. No. 5693781. | Unknown. | 45,438 | Apr. 3, 1998 |
| | | GB_PAT:I92048 | 549 | I92048 | Sequence 15 from U.S. Pat. No. 5726299. | Unknown. | 45,438 | Dec. 1, 1998 |
| rxa02409 | 660 | GB_EST19:AA438982 | 672 | AA438982 | LD13390.5prime LD Drosophila melanogaster embryo BlueScript Drosophila melanogaster cDNA clone LD13390 5prime, mRNA sequence. | Drosophila melanogaster | 36,130 | Nov. 27, 1998 |
| | | GB_EST28:AI513795 | 635 | AI513795 | GH26887.5prime GH Drosophila melanogaster head pOT2 Drosophila melanogaster cDNA clone GH26887 5prime, mRNA sequence. | Drosophila melanogaster | 38,840 | Mar. 16, 1999 |
| | | GB_HTG3:AC009601 | 40300 | AC009601 | Leishmania major chromosome 35 clone L165 strain Friedlin, *SEQUENCING IN PROGRESS*, 2 ordered pieces. | Leishmania major | 35,759 | Sep. 30, 1999 |
| rxa02412 | 603 | GB_BA1:AB020624 | 1605 | AB020624 | Corynebacterium glutamicum murI gene for D-glutamate racemase, complete cds. | Corynebacterium glutamicum | 40,237 | Jul. 24, 1999 |
| | | GB_EST19:AA756805 | 646 | AA756805 | vv72b10.r1 Stratagene mouse skin (#937313) Mus musculus cDNA clone IMAGE:1227931 5' similar to gb:D21261 SM22-ALPHA HOMOLOG (HUMAN); mRNA sequence. | Mus musculus | 34,483 | Jan. 21, 1998 |
| | | GB_RO:AF149291 | 1388 | AF149291 | Mus musculus transgelin mRNA, complete cds. | Mus musculus | 37,540 | Jun. 8, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02417 | 2247 | GB_GSS14:AQ554774 | 813 | AQ554774 | RPCI-11-436G15.TV RPCI-11 Homo sapiens genomic clone RPCI-11-436G15, genomic survey sequence. | Homo sapiens | 34,649 | May 28, 1999 |
| | | GB_GSS4:AQ713076 | 500 | AQ713076 | HS_5384_A2_C05_SP6E RPCI-11 Human Male BAC Library Homo sapiens genomic clone Plate = 960 Col = 10 Row = E, genomic survey sequence. | Homo sapiens | 35,200 | Jul. 13, 1999 |
| rxa02421 | 933 | GB_STs:G47161 | 448 | G47161 | Z15758_1 Zebrafish AB Danio rerio STS genomic clone Z15758 5', sequence tagged site | Danio rerio | 39,910 | Mar. 23, 1999 |
| | | GB_HTG3:AC005708 | 76712 | AC005708 | Drosophila melanogaster chromosome 2 clone DS08537 (D425) map 50C1-50C2 strain y2; cn bw sp, **SEQUENCING IN PROGRESS*, 20 unordered pieces. | Drosophila melanogaster | 36,207 | Jan. 15, 1999 |
| | | GB_HTG3:AC005812 | 76721 | AC005812 | Drosophila melanogaster chromosome 2 clone DS07345 (D445) map 50C1-50C2 strain y; cn bw sp, **SEQUENCING IN PROGRESS*, 8 unordered pieces. | Drosophila melanogaster | 36,205 | Sep. 20, 1999 |
| | | GB_HTG2:AC005673 | 77023 | AC005673 | Drosophila melanogaster chromosome 2 clone DS00096 (D427) map 50C1-50C4 strain y; cn bw sp, **SEQUENCING IN PROGRESS*, 12 unordered pieces. | Drosophila melanogaster | 39,321 | Jul. 30, 1999 |
| rxa02425 | 653 | GB_BA1:PFPHCOAHL | 2700 | Y13067 | Pseudomonas fluorescens genes encoding p-hydroxycinnamoyl CoA hydratase/lyase and vanillin: NAD+ oxidoreductase. | Pseudomonas fluorescens | 40,854 | May 5, 1998 |
| | | GB_EST27:AI438343 | 610 | AI438343 | SWOvAFCAP31F09SK Onchocerca volvulus adult female cDNA clone SWOvAFCAP31F09 5', mRNA sequence. | Onchocerca volvulus | 41,244 | Mar. 9, 1999 |
| rxa02427 | 510 | GB_BA1:XANHRPA1A | 1824 | M99173 | Xanthomonas campestris HrpA1 gene, complete cds. | Xanthomonas campestris | 37,520 | Sep. 14, 1993 |
| | | GB_OV:CCA245635 | 2455 | AJ245635 | Cyprinus carpio IL-1 gene for interleukin-1-beta. | Cyprinus carpio | 35,614 | Aug. 5, 1999 |
| | | GB_OV:AB010701 | 1213 | AB010701 | Cyprinus carpio IL-1 mRNA for interleukin-1 beta, complete cds. | Cyprinus carpio | 36,821 | Jan. 29, 1998 |
| | | GB_OV:CCA245635 | 2455 | AJ245635 | Cyprinus carpio IL-1 gene for interleukin-1-beta. | Cyprinus carpio | 35,060 | Aug. 5, 1999 |
| rxa02428 | 1257 | GB_IN1:CEY40B1B | 29313 | AL032636 | Caenorhabditis elegans cosmid Y40B1B, complete sequence. | Caenorhabditis elegans | 37,068 | Nov. 12, 1999 |
| | | GB_GSS12:AQ374513 | 640 | AQ374513 | RPCI11-145N15.TJ RPCI-11 Homo sapiens genomic clone RPCI-11-145N15, genomic survey sequence. | Homo sapiens | 35,636 | May 20, 1999 |
| rxa02430 | 309 | GB_IN1:CEY40B1B | 29313 | AL032636 | Caenorhabditis elegans cosmid Y40B1B, complete sequence. | Caenorhabditis elegans | 32,800 | Nov. 12, 1999 |
| | | GB_BA1:MTCY1A11 | 30850 | Z78020 | Mycobacterium tuberculosis H37Rv complete genome; segment 83/162. | Mycobacterium tuberculosis | 64,610 | Jun. 17, 1998 |
| rxa02433 | 723 | GB_PR4:AC004998 | 135572 | AC004998 | Homo sapiens clone DJ164D05, complete sequence. | Homo sapiens | 41,118 | Jun. 17, 1999 |
| | | GB_PR2:AC002091 | 161799 | AC002091 | Genomic sequence from Human 17, complete sequence. | Homo sapiens | 36,393 | Sep. 9, 1997 |
| | | GB_HTG5:AC009754 | 212978 | AC009754 | Homo sapiens chromosome 15 clone RP11-519C12, WORKING DRAFT SEQUENCE, 16 ordered pieces. | Homo sapiens | 33,008 | Nov. 17, 1999 |
| | | GB_HTG5:AC009754 | 212978 | AC009754 | Homo sapiens chromosome 15 clone RP11-519C12, WORKING DRAFT SEQUENCE, 16 ordered pieces. | Homo sapiens | 39,716 | Nov. 17, 1999 |
| | | GB_PR4:HUAC003108 | 164564 | AC003108 | Human Chromosome 16 BAC clone CIT987SK-327O24, complete sequence. | Homo sapiens | 35,180 | Nov. 23, 1999 |
| rxa02437 | 933 | GB_IN2:AC005650 | 60019 | AC005650 | Drosophila melanogaster, chromosome 2R, region 59B4-59B7, P1 clone DS02885, complete sequence. | Drosophila melanogaster | 40,397 | Jan. 30, 1999 |
| | | GB_IN2:AC005650 | 60019 | AC005650 | Drosophila melanogaster, chromosome 2R, region 59B4-59B7, P1 clone DS02885, complete sequence. | Drosophila melanogaster | 37,719 | Jan. 30, 1999 |
| | | GB_RO:AF081193 | 2250 | AF081193 | Mus musculus calcium and DAG-regulated guanine nucleotide exchange factor I mRNA, complete cds. | Mus musculus | 37,835 | Nov. 28, 1998 |
| rxa02443 | 1077 | GB_HTG4:AC009370 | 59409 | AC009370 | Drosophila melanogaster chromosome 3L/75C1 clone RPCI98-35F4, **SEQUENCING IN PROGRESS*, 40 unordered pieces. | Drosophila melanogaster | 35,480 | Oct. 16, 1999 |
| | | GB_HTG4:AC009370 | 59409 | AC009370 | Drosophila melanogaster chromosome 3L/75C1 clone RPCI98-35F4, **SEQUENCING IN PROGRESS*, 40 unordered pieces. | Drosophila melanogaster | 35,460 | Oct. 16, 1999 |
| | | GB_EST9:AA081445 | 311 | AA081445 | zn18a01.r1 Stratagene neuroepithelium NT2RAMI 937234 Homo sapiens cDNA clone IMAGE:547752 5', mRNA sequence. | Homo sapiens | 36,334 | Oct. 21, 1996 |
| rxa02444 | 1401 | GB_BA2:SCF76 | 18292 | AL121600 | Streptomyces coelicolor cosmid F76. | Streptomyces coelicolor A3(2) | 39,226 | Sep. 29, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02452 | 303 | GB_PR2:HS1022J11 | 137658 | AL049765 | Human DNA sequence from clone 1022J11 on chromosome 20q13.13-13.2, complete sequence. | *Homo sapiens* | 35,444 | Nov. 23, 1999 |
|  |  | GB_HTG1:AC002345 | 132645 | AC002345 | *Homo sapiens* chromosome 17 clone 20D5, **SEQUENCING IN PROGRESS*, 10 unordered pieces. | *Homo sapiens* | 35,106 | Aug. 25, 1997 |
|  |  | GB_GSS14:AQ579499 | 825 | AQ579499 | nbxb0084D17f CUGI Rice BAC Library *Oryza sativa* genomic clone nbxb0084D17f, genomic survey sequence. | *Oryza sativa* | 39,535 | Jun. 2, 1999 |
|  |  | GB_GSS14:AQ579499 | 825 | AQ579499 | nbxb0084D17f CUGI Rice BAC Library *Oryza sativa* genomic clone nbxb0084D17f, genomic survey sequence. | *Oryza sativa* | 36,213 | Jun. 2, 1999 |
| rxa02454 | 1365 | GB_HTG3:AC007810 | 140175 | AC007810 | *Drosophila melanogaster* chromosome 3 clone BACR14A01 (D720) RPCI-98 14 A.1 map 90C—90C strain y; cn bw sp, **SEQUENCING IN PROGRESS**, 89 unordered pieces. | *Drosophila melanogaster* | 33,931 | Sep. 17, 1999 |
|  |  | GB_HTG3:AC007810 | 140175 | AC007810 | *Drosophila melanogaster* chromosome 3 clone BACR14A01 (D720) RPCI-98 14.A.1 map 90C—90C strain y; cn bw sp, **SEQUENCING IN PROGRESS**, 89 unordered pieces. | *Drosophila melanogaster* | 33,931 | Sep. 17, 1999 |
|  |  | GB_PR3:AC005339 | 32360 | AC005339 | *Homo sapiens* chromosome 19, cosmid R33729, complete sequence. | *Homo sapiens* | 38,131 | Jul. 30, 1998 |
| rxa02457 | 1233 | GB_HTG3:AC009346 | 105005 | AC009346 | *Drosophila melanogaster* chromosome 3 clone BACR03P13 (D672) RPCI-98 03.P.13 map 83A—83B strain y; cn bw sp, **SEQUENCING IN PROGRESS**, 83 unordered pieces. | *Drosophila melanogaster* | 36,829 | Aug. 27, 1999 |
|  |  | GB_EST20:AA820427 | 436 | AA820427 | LD24042.5prime LD *Drosophila melanogaster* embryo pOT2 *Drosophila melanogaster* cDNA clone LD24042.5prime, mRNA sequence. | *Drosophila melanogaster* | 38,018 | Feb. 25, 1999 |
|  |  | GB_HTG3:AC009346 | 105005 | AC009346 | *Drosophila melanogaster* chromosome 3 clone BACR03P13 (D672) RPCI-98 03.P.13 map 83A—83B strain y; cn bw sp, **SEQUENCING IN PROGRESS**, 83 unordered pieces. | *Drosophila melanogaster* | 36,829 | Aug. 27, 1999 |
| rxa02459 | 858 | GB_BA2:AF114233 | 1852 | AF114233 | *Corynebacterium glutamicum* 5-enolpyruvylshikimate 3-phosphate synthase (aroA) gene, complete cds. | *Corynebacterium glutamicum* | 99,248 | Feb. 7, 1999 |
|  |  | GB_HTG1:CEY45F10_2 | 110000 | Z93245 | *Caenorhabditis elegans* chromosome IV clone Y45F10, **SEQUENCING IN PROGRESS**, in unordered pieces. | *Caenorhabditis elegans* | 35,621 | Sep. 17, 1997 |
|  |  | GB_HTG1:CEY45F10_2 | 110000 | Z93245 | *Caenorhabditis elegans* chromosome IV clone Y45F10, **SEQUENCING IN PROGRESS**, in unordered pieces. | *Caenorhabditis elegans* | 35,621 | Sep. 17, 1997 |
| rxa02460 rxa02461 | 531 | GB_EST10:AA153371 | 590 | AA153371 | ms02a12.rf Stratagene mouse embryonic carcinoma (#937317) *Mus musculus* cDNA clone IMAGE:605758 5' similar to gb:M24194 GUANINE NUCLEOTIDE-BINDING PROTEIN BETA SUBUNIT-LIKE PROTEIN (HUMAN); gb:X75313 *M. musculus* (MOUSE); mRNA sequence. | *Mus musculus* | 39,203 | Feb. 11, 1997 |
|  |  | GB_EST10:AA153371 | 590 | AA153371 | ms02a12.rf Stratagene mouse embryonic carcinoma (#937317) *Mus musculus* cDNA clone IMAGE:605758 5' similar to gb:M24194 GUANINE NUCLEOTIDE-BINDING PROTEIN BETA SUBUNIT-LIKE PROTEIN (HUMAN); gb:X75313 *M. musculus* (MOUSE); mRNA sequence. | *Mus musculus* | 41,920 | Feb. 11, 1997 |
| rxa02464 | 1323 | GB_HTG4:AC008754 | 86446 | AC008754 | *Homo sapiens* chromosome 19 clone CITB-E1_3023J11, **SEQUENCING IN PROGRESS**, 73 unordered pieces. | *Homo sapiens* | 36,064 | Oct. 31, 1999 |
|  |  | GB_HTG4:AC008754 | 86446 | AC008754 | *Homo sapiens* chromosome 19 clone CITB-E1_3023J11, **SEQUENCING IN PROGRESS**, 73 unordered pieces. | *Homo sapiens* | 36,064 | Oct. 31, 1999 |
|  |  | GB_HTG4:AC008754 | 86446 | AC008754 | *Homo sapiens* chromosome 19 clone CITB-E1_3023J11, **SEQUENCING IN PROGRESS**, 73 unordered pieces. | *Homo sapiens* | 37,589 | Oct. 31, 1999 |
| rxa02465 | 522 | GB_PR3:AC004960 | 143834 | AC004960 | *Homo sapiens* PAC clone DJ1098B01 from 7q11.23-q21, complete sequence. | *Homo sapiens* | 35,010 | Nov. 5, 1998 |
|  |  | GB_GSS9:AQ122158 | 428 | AQ122158 | HS_3083_A1_E10_MR CIT Approved Human Genomic Sperm Library D *Homo sapiens* genomic clone Plate = 3083 Col = 19 Row = I, genomic survey sequence. | *Homo sapiens* | 39,720 | Sep. 22, 1998 |
|  |  | GB_BA2:AF053227 | 840 | AF053227 | *Photobacterium leiognathi* probable flavin reductase (luxG) gene, complete cds. | *Photobacterium leiognathi* | 37,572 | Jun. 12, 1998 |
| rxa02466 | 825 | GB_EST21:AA942401 | 825 | AA942401 | LD26583.5prime LD *Drosophila melanogaster* embryo pOT2 *Drosophila melanogaster* cDNA clone LD26583.5prime, mRNA sequence. | *Drosophila melanogaster* | 37,705 | Nov. 25, 1998 |
|  | 187 | GB_GSS12:AQ400564 | 485 | AQ400564 | HS_5064_A1_G09_T7A RPCI-11 Human Male BAC Library *Homo sapiens* genomic clone | *Homo sapiens* | 38,043 | Mar. 13, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02467 | 348 | GB_GSS12:AQ400564 | 485 | AQ400564 | Plate = 640 Col = 17 Row = M, genomic survey sequence. HS_5064_A1_G09_T7A RPCI-11 Human Male BAC Library Homo sapiens genomic clone Plate = 640 Col = 17 Row = M, genomic survey sequence. | Homo sapiens | 37,647 | Mar. 13, 1999 |
| | | GB_HTG2:AC005718 | 149592 | AC005718 | Drosophila melanogaster chromosome 2 clone DS02336 (D440) map 60C8-60D2 strain y; cn bw sp, *SEQUENCING IN PROGRESS*, 68 unordered pieces. | Drosophila melanogaster | 40,525 | Jul. 30, 1999 |
| | | GB_HTG2:AC005718 | 149592 | AC005718 | Drosophila melanogaster chromosome 2 clone DS02336 (D440) map 60C8-60D2 strain y; cn bw sp, *SEQUENCING IN PROGRESS*, 68 unordered pieces. | Drosophila melanogaster | 40,525 | Jul. 30, 1999 |
| | | GB_PR3:AC004217 | 103319 | AC004217 | Homo sapiens 12q24.1 PAC RPCI3-521E19 (Roswell Park Cancer Institute Human PAC library) complete sequence. | Homo sapiens | 37,389 | Jun. 2, 1998 |
| rxa02472 | 414 | GB_GSS12:AQ413964 | 550 | AQ413964 | RPCI-11-207C17.TV RPCI-11 Homo sapiens genomic clone RPCI-11-207C17, genomic survey sequence. | Homo sapiens | 37,870 | Mar. 23, 1999 |
| | | GB_IN2:CELR09H3 | 10687 | U58740 | Caenorhabditis elegans cosmid R09H3. | Caenorhabditis elegans | 37,408 | May 26, 1999 |
| | | GB_GSS13:AQ488397 | 734 | AQ488397 | RPCI-11-243H14.TV RPCI-11 Homo sapiens genomic clone RPCI-11-243H14, genomic survey sequence. | Homo sapiens | 37,569 | Apr. 24, 1999 |
| rxa02473 | 864 | GB_HTG1:CEY7A5 | 235922 | AL021576 | Caenorhabditis elegans chromosome X clone Y7A5, *SEQUENCING IN PROGRESS*, in unordered pieces. | Caenorhabditis elegans | 38,561 | Aug. 19, 1999 |
| | | GB_HTG1:CEY7A5 | 235922 | AL021576 | Caenorhabditis elegans chromosome X clone Y7A5, *SEQUENCING IN PROGRESS*, in unordered pieces. | Caenorhabditis elegans | 38,561 | Aug. 19, 1999 |
| rxa02475 | 1278 | GB_IN1:CEY7A5A | 68270 | AL034489 | Caenorhabditis elegans cosmid Y7A5A, complete sequence. | Caenorhabditis elegans | 38,081 | Dec. 18, 1998 |
| | | GB_BA1:AB009078 | 2686 | AB009078 | Brevibacterium saccharolyticum gene for L-2,3-butanediol dehydrogenase, complete cds. | Brevibacterium saccharolyticum | 99,217 | Feb. 13, 1999 |
| | | GB_PH:AF074945 | 15644 | AF074945 | Mycoplasma arthritidis bacteriophage MAV1, complete genome. | Mycoplasma arthritidis bacteriophage MAV1 | 36,876 | Jul. 27, 1999 |
| | | GB_BA1:MTV008 | 63033 | AL021246 | Mycobacterium tuberculosis H37Rv complete genome; segment 108/162. | Mycobacterium tuberculosis | 37,520 | Jun. 17, 1998 |
| rxa02478 | 1338 | GB_HTG1:AC002419 | 128340 | AC002419 | Homo sapiens chromosome X clone bWXD40, *SEQUENCING IN PROGRESS*, 2 unordered pieces. | Homo sapiens | 34,700 | Aug. 12, 1997 |
| | | GB_PR3:AC004073 | 79612 | AC004073 | Human Chromosome X, complete sequence. | Homo sapiens | 34,700 | Jan. 29, 1998 |
| | | GB_HTG1:AC002419 | 128340 | AC002419 | Homo sapiens chromosome X clone bWXD40, *SEQUENCING IN PROGRESS*, 2 unordered pieces. | Homo sapiens | 34,700 | Aug. 12, 1997 |
| rxa02482 | 933 | GB_OV:AF077329 | 1645 | AF077329 | Coturnix coturnix pro-alpha2(I) collagen mRNA, partial cds. | Coturnix coturnix | 40,202 | Feb. 3, 1999 |
| | | GB_PL2:SFU59150 | 2854 | U59150 | Sartorya fumigate nucleolar protein AfCbf5p (AfCBF5p) mRNA, complete cds. | Aspergillus fumigatus | 36,789 | Jan. 1, 1998 |
| | | GB_BA2:AE000106 | 12554 | AE000106 | Rhizobium sp. NGR234 plasmid pNGR234a, section 43 of 46 of the complete plasmid sequence. | Rhizobium sp. NGR234 | 36,630 | Dec. 12, 1997 |
| rxa02483 | 936 | GB_HTG1:AC002345 | 132645 | AC002345 | Homo sapiens chromosome 17 clone 20D5, *SEQUENCING IN PROGRESS*, 10 unordered pieces. | Homo sapiens | 37,942 | Aug. 25, 1997 |
| | | GB_HTG1:AC002345 | 132645 | AC002345 | Homo sapiens chromosome 17 clone 20D5, *SEQUENCING IN PROGRESS*, 10 unordered pieces. | Homo sapiens | 37,942 | Aug. 25, 1997 |
| | | GB_PR4:AF118569 | 24070 | AF118569 | Homo sapiens angiotensin I converting enzyme precursor (DCP1) gene, alternative splice products, complete cds. | Homo sapiens | 37,352 | Oct. 28, 1999 |
| rxa02484 | 624 | GB_BA1:RLSPRLVCP | 3696 | Y09534 | R. leguminosarum Symbiosis Plasmid DNA, rlvCP gene. | Rhizobium leguminosarum | 38,003 | Feb. 26, 1997 |
| | | GB_BA2:RLU23040 | 3931 | U23040 | Rhizobium leguminosarum bv. viciae putative glycerol-3-phosphate transport protein (ugpC) gene, partial cds, and chemoreceptor protein (mcpA), putative 2-hydroxychromene-2-carboxylate isomerase, and putative alcohol dehydrogenase genes, complete cds. | Rhizobium leguminosarum bv. viciae | 38,003 | Aug. 26, 1996 |
| | | GB_BA1:NGORBKGME | 1580 | L07845 | Neisseria gonorrhoeae ribokinase (rbk) gene, 3' end; ADP-L-glycero-D-mannoheptose epimerase (gme) gene, complete cds. | Neisseria gonorrhoeae | 46,939 | Oct. 11, 1995 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02486 | 759 | GB_IN1:CELM02D8 | 40876 | U41034 | *Caenorhabditis elegans* cosmid M02D8. | *Caenorhabditis elegans* | 38,358 | Nov. 30, 1995 |
| | | GB_IN2:CELC36C5 | 41596 | AF016444 | *Caenorhabditis elegans* cosmid C36C5. | *Caenorhabditis elegans* | 38,482 | Oct. 8, 1999 |
| | | GB_HTG3:AC011467 | 188118 | AC011467 | *Homo sapiens* chromosome 19 clone CIT-HSPC_457E21, *SEQUENCING IN PROGRESS*, 59 unordered pieces. | *Homo sapiens* | 37,954 | Oct. 7, 1999 |
| rxa02488 | 392 | GB_HTG2:AC006765 | 274498 | AC006765 | *Caenorhabditis elegans* clone Y43H11, **SEQUENCING IN PROGRESS*, 7 unordered pieces. | *Caenorhabditis elegans* | 38,961 | Feb. 23, 1999 |
| | | GB_HTG2:AC006765 | 274498 | AC006765 | *Caenorhabditis elegans* clone Y43H11, **SEQUENCING IN PROGRESS*, 7 unordered pieces. | *Caenorhabditis elegans* | 38,961 | Feb. 23, 1999 |
| | | GB_HTG4:AC010035 | 173152 | AC010035 | *Drosophila melanogaster* chromosome 3L/74B2 clone RPC098-6H1, *SEQUENCING IN PROGRESS*, 60 unordered pieces. | *Drosophila melanogaster* | 38,010 | Oct. 16, 1999 |
| rxa02489 | 724 | GB_GSS8:AQ050210 | 796 | AQ050210 | nbxb0003cD08r CUGI Rice BAC Library *Oryza sativa* genomic clone nbxb0003H15r, genomic survey sequence. | *Oryza sativa* | 40,201 | Mar. 24, 1999 |
| | | GB_PL1:D87819 | 2036 | D87819 | *Oryza sativa* mRNA for sucrose transporter, complete cds. | *Oryza sativa* | 39,356 | Dec. 26, 1997 |
| | | GB_STS:G53565 | 627 | G53565 | SHGC-83995 Human *Homo sapiens* STS genomic, sequence tagged site. | *Homo sapiens* | 40,237 | Jun. 25, 1999 |
| rxa02495 | 2691 | GB_BA1:MTCY19H9 | 20679 | Z83857 | *Mycobacterium tuberculosis* H37Rv complete genome; segment 129/162. | *Mycobacterium tuberculosis* | 40,853 | Jun. 18, 1998 |
| | | GB_BA1:MTCY19H9 | 20679 | Z83857 | *Mycobacterium tuberculosis* H37Rv complete genome; segment 129/162. | *Mycobacterium tuberculosis* | 40,358 | Jun. 18, 1998 |
| | | GB_HTG1:HSDJ901O8 | 114599 | AL078461 | *Homo sapiens* chromosome 20 clone RP5-901O8 map q11.1-11.23, *SEQUENCING IN PROGRESS*, in unordered pieces. | *Homo sapiens* | 34,059 | Nov. 25, 1999 |
| rxa02496 | 930 | GB_EST36:AV201062 | 373 | AV201062 | AV201062 Yuji Kohara unpublished cDNA *Caenorhabditis elegans* cDNA clone yk250f11 5′, mRNA sequence. | *Caenorhabditis elegans* | 41,287 | Jul. 26, 1999 |
| | | GB_IN1:CELC10F3 | 40172 | AF022968 | *Caenorhabditis elegans* cosmid C10F3. | *Caenorhabditis elegans* | 35,217 | Sep. 10, 1997 |
| | | GB_EST29:AI612578 | 357 | AI612578 | TENG0372 T. Cruzi epimastigote normalised cDNA Library *Trypanosoma cruzi* cDNA clone n715.r 5′, mRNA sequence. | *Trypanosoma cruzi* | 39,474 | Jul. 7, 1999 |
| rxa02498 | 927 | GB_BA2:CGU31225 | 1817 | U31225 | *Corynebacterium glutamicum* L-proline:NADP+ 5-oxidoreductase (proC) gene, complete cds. | *Corynebacterium glutamicum* | 92,580 | Aug. 2, 1996 |
| rxa02500 | 222 | GB_PR2:AP000197 | 100000 | AP000197 | *Homo sapiens* genomic DNA, chromosome 21q22.1, D21S226-AML region, clone B355D16-T1073, segment 3/8, complete sequence. | *Homo sapiens* | 36,344 | Nov. 20, 1999 |
| | | GB_PR2:AP000093 | 100000 | AP000093 | *Homo sapiens* genomic DNA of 21q22.1, GART and AML related, B335D16-P10G11 region, segment 3/7, complete sequence. | *Homo sapiens* | 36,344 | Sep. 25, 1999 |
| | | GB_BA1:MTCY20G9 | 37218 | Z77162 | *Mycobacterium tuberculosis* H37Rv complete genome; segment 25/162. | *Mycobacterium tuberculosis* | 58,257 | Jun. 17, 1998 |
| rxa02505 | 294 | GB_BA1:U00018 | 42991 | U00018 | *Mycobacterium leprae* cosmid B2168. | *Mycobacterium leprae* | 44,776 | Mar. 1, 1994 |
| | | GB_BA1:SCF68 | 38084 | AL079345 | *Streptomyces coelicolor* cosmid E68. | *Streptomyces coelicolor* A3(2) | 37,624 | Jul. 16, 1999 |
| | | GB_RO:MM2B4J | 289 | X00621 | Mouse hybridome 2B4 gene fragment (J-region) for T-cell receptor. | *Mus musculus* | 36,364 | Nov. 10, 1995 |
| | | GB_RO:MUSTCBJB1 | 2276 | K02802 | Mouse T-cell receptor germline beta-chain J-beta-2-gene cluster, including J-beta-[2.1, 2.2, 2.3, 2.4, 2.5, 2.psi, 2.6] genes. | *Mus musculus* | 32,862 | Apr. 27, 1993 |
| | | GB_RO:MMAE000665 | 199101 | AE000665 | *Mus musculus* TCR beta locus from bases 501860 to 700960 (section 3 of 3) of the complete sequence. | *Mus musculus* | 36,879 | Sep. 4, 1997 |
| rxa02506 | | | | | | | | |
| rxa02510 | 759 | GB_OM:PIGMTNADP | 1585 | M86719 | Pig mitochondrial NADP-isocitrate dehydrogenase mRNA, 3′ end. | *Sus scrofa* | 36,963 | Jun. 12, 1993 |
| | | GB_EST17:AA629042 | 359 | AA629042 | zu77d08.s1 Soares_testis_NHT *Homo sapiens* cDNA clone IMAGE:744015 3′, mRNA sequence. | *Homo sapiens* | 37,184 | Oct. 16, 1997 |
| | | GB_EST20:AA837524 | 528 | AA837524 | oe31d07.s1 NCI_CGAP_Pr25 *Homo sapiens* cDNA clone IMAGE:1410157 similar to | *Homo sapiens* | 40,039 | Feb. 26, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02514 | 857 | GB_PR2:CNS01DS9 | 175148 | AL121694 | gb:X69391 60S RIBOSOMAL PROTEIN L6 (HUMAN); mRNA sequence. Human chromosome 14 DNA sequence **IN PROGRESS** BAC R-701B16 of RPCI-11 library from chromosome 14 of Homo sapiens (Human), complete sequence. | Homo sapiens | 35,185 | Nov. 8, 1999 |
| | | GB_PR4:AC006222 | 165643 | AC006222 | Homo sapiens, clone hRPK.12_A_1, complete sequence. | Homo sapiens | 33,411 | Jan. 15, 1999 |
| | | GB_PR4:AC006222 | 165643 | AC006222 | Homo sapiens, clone hRPK.12_A_1, complete sequence. | Homo sapiens | 35,629 | Jan. 15, 1999 |
| rxa02518 | 634 | GB_BA1:MTV007 | 32806 | AL021184 | Mycobacterium tuberculosis H37Rv complete genome; segment 64/162. | Mycobacterium tuberculosis | 57,965 | Jun. 17, 1998 |
| | | GB_EST16:AA576027 | 231 | AA576027 | nm57e05.s1 NCI_CGAP_Br3 Homo sapiens cDNA clone IMAGE:1072352 3' similar to TR:G1001455 G1001455 HYPOTHETICAL 141.7 KD PROTEIN; mRNA sequence. | Homo sapiens | 47,674 | Sep. 9, 1997 |
| rxa02519 | 1752 | GB_BA2:AE000226 | 10466 | AE000226 | Escherichia coli K-12 MG1655 section 116 of 400 of the complete genome. | Escherichia coli | 38,447 | Nov. 12, 1998 |
| | | GB_IN2:DMNRG2 | 8574 | AF050085 | Drosophila melanogaster neuroglian (nrg) gene, exons 3–6, 7a, 7b and alternatively spliced products, complete cds. | Drosophila melanogaster | 38,498 | Aug. 5, 1998 |
| | | GB_IN2:AC004322 | 32480 | AC004322 | Drosophila melanogaster DNA sequence (P1 DS01962 (D216), complete sequence. | Drosophila melanogaster | 36,126 | Aug. 29, 1998 |
| | | GB_HTG2:AC008188 | 129128 | AC008188 | Drosophila melanogaster chromosome 2 clone BACR08I18 (D660) RPCI-98 08.I.18 map 56A2- 56B1 strain y; cn bw sp, *SEQUENCING IN PROGRESS**, 72 unordered pieces. | Drosophila melanogaster | 35,660 | Aug. 2, 1999 |
| rxa02520 | 807 | GB_GSS3:B68449 | 228 | B68449 | CIT-HSP-2025P8.TF CIT-HSP Homo sapiens genomic clone 2025P8, genomic survey sequence. | Homo sapiens | 42,544 | Jun. 21, 1998 |
| | | GB_HTG3:AC010642 | 45982 | AC010642 | Homo sapiens chromosome 19 clone LLNL-R_245B6, **SEQUENCING IN PROGRESS**, 26 unordered pieces. | Homo sapiens | 34,543 | Sep. 16, 1999 |
| | | GB_HTG3:AC010642 | 45982 | AC010642 | Homo sapiens chromosome 19 clone LLNL-R_245B6, **SEQUENCING IN PROGRESS**, 26 unordered pieces. | Homo sapiens | 34,543 | Sep. 16, 1999 |
| rxa02521 | 1566 | GB_BA1:SCC22 | 22115 | AL1096839 | Streptomyces coelicolor cosmid C22. | Streptomyces coelicolor | 40,885 | Jul. 12, 1999 |
| | | GB_BA1:BSUB0017 | 217420 | Z99120 | Bacillus subtilis complete genome (section 17 of 21), from 3197001 to 3414420. | Bacillus subtilis | 38,441 | Nov. 26, 1997 |
| | | GB_BA1:MLCL536 | 36224 | Z99125 | Mycobacterium leprae cosmid L536. | Mycobacterium leprae | 37,233 | Dec. 4, 1998 |
| rxa02524 | 813 | GB_IN1:CELF42H10 | 28687 | U02289 | C. elegans cosmid F42H10. | Caenorhabditis elegans | 32,878 | Oct. 22, 1993 |
| | | GB_IN1:CEU02289 | 4824 | U02289 | Caenorhabditis elegans Bristol N2 GTPase-activating protein (CEGAP) mRNA, partial cds. | Caenorhabditis elegans | 34,457 | Jun. 11, 1994 |
| | | GB_IN1:CELF42H10 | 28687 | L08403 | C. elegans cosmid F42H10. | Caenorhabditis elegans | 34,243 | Oct. 22, 1993 |
| rxa02525 | 501 | GB_EST36:AU076280 | 416 | AU076280 | AU076280 Rice green shoot Oryza sativa cDNA clone S10896_IIA, mRNA sequence. | Oryza sativa | 42,671 | Jul. 27, 1999 |
| | | GB_EST1:D34202 | 355 | D34202 | CELK042E5R Yuji Kohara unpublished cDNA Caenorhabditis elegans cDNA clone yk42e5 3', mRNA sequence. | Caenorhabditis elegans | 42,553 | Aug. 8, 1994 |
| | | GB_EST1:D34202 | 355 | D34202 | CELK042E5R Yuji Kohara unpublished cDNA Caenorhabditis elegans cDNA clone yk42e5 3', mRNA sequence. | Caenorhabditis elegans | 37,892 | Aug. 8, 1994 |
| rxa02534 | 927 | GB_EST15:AA490533 | 426 | AA490533 | aa51h04.r1 NCI_CGAP_GCB1 Homo sapiens cDNA clone IMAGE:824503 5', mRNA sequence. | Homo sapiens | 41,176 | Aug. 15, 1997 |
| | | GB_PL2:ATFCA3 | 200252 | Z97338 | Arabidopsis thaliana DNA chromosome 4, ESSA I FCA contig fragment No. 3. | Arabidopsis thaliana | 35,568 | Aug. 27, 1999 |
| | | GB_PL2:ATFCA3 | 200252 | Z97338 | Arabidopsis thaliana DNA chromosome 4, ESSA I FCA contig fragment No. 3. | Arabidopsis thaliana | 37,376 | Aug. 27, 1999 |
| rxa02537 | 585 | GB_HTG4:AC009732 | 165576 | AC009732 | Drosophila melanogaster chromosome 2 clone BACR05E17 (D1059) RPCI-98 05.E.17 map 57F-57F strain y; cn bw sp, *SEQUENCING IN PROGRESS**, 83 unordered pieces. | Drosophila melanogaster | 30,727 | Oct. 26, 1999 |
| | | GB_HTG4:AC009732 | 165576 | AC009732 | Drosophila melanogaster chromosome 2 clone BACR05E17 (D1059) RPCI-98 05.E.17 map 57F-57F strain y; cn bw sp, *SEQUENCING IN PROGRESS**, 83 unordered pieces. | Drosophila melanogaster | 30,727 | Oct. 26, 1999 |
| | | GB_HTG4:AC009732 | 165576 | AC009732 | Drosophila melanogaster chromosome 2 clone BACR05E17 (D1059) RPCI-98 05.E.17 map 57F-57F strain y; cn bw sp, *SEQUENCING IN PROGRESS**, 83 unordered pieces. | Drosophila melanogaster | 36,460 | Oct. 26, 1999 |
| rxa02538 | 795 | GB_GSS15:AQ606090 | 658 | AQ806090 | HS_5392_A1_E12_T7A RPCI-11 Human Male BAC Library Homo sapiens genomic clone Plate = 968 Col = 23 Row = I, genomic survey sequence. | Homo sapiens | 39,369 | Jun. 10, 1999 |
| | | GB_BA1:AXACE | 5323 | X94981 | A. xylinum aceB, aceC, aceD, and aceE genes. | Acetobacter xylinus | 37,009 | Feb. 12, 1997 |
| | | GB_BA1:AXACE | 5323 | X94981 | A. xylinum aceB, aceC, aceD, and aceE genes. | Acetobacter xylinus | 37,879 | Feb. 12, 1997 |
| rxa02540 | 561 | GB_BA1:MTY13E10 | 35019 | Z95324 | Mycobacterium tuberculosis H37Rv complete genome; segment 18/162. | Mycobacterium | 51,002 | Jun. 17, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_BA1:MTDNAGRP | 4644 | X58406 | M. tuberculosis dnaK, grpE, and dnaJ genes. | Mycobacterium tuberculosis | 51,002 | Oct. 21, 1992 |
| rxa02544 | 1521 | GB_BA1:AB007847 | 2400 | AB007847 | Rhodococcus rhodochrous gene for 3-ketosteroid-delta1-dehydrogenase, complete cds. | Rhodococcus rhodochrous | 53,723 | Feb. 13, 1999 |
| | | GB_PAT:E14041 | 2776 | E14041 | gDNA encoding laminaripentaose forming enzyme (LPHase). | Streptomyces sp. | 47,351 | Jul. 28, 1999 |
| | | GB_HTG3:AC010592 | 45971 | AC010592 | Homo sapiens chromosome 5 clone CIT-HSPC_459H20, *SEQUENCING IN PROGRESS*, 38 unordered pieces. | Homo sapiens | 37,689 | Sep. 16, 1999 |
| rxa02545 | 681 | GB_HTG3:AC010592 | 45971 | AC010592 | Homo sapiens chromosome 5 clone CIT-HSPC_459H20, *SEQUENCING IN PROGRESS*, 38 unordered pieces. | Homo sapiens | 37,689 | Sep. 16, 1999 |
| | | GB_HTG3:AC009016 | 128095 | AC009016 | Homo sapiens chromosome 5 clone P1_889E7, *SEQUENCING IN PROGRESS*, 67 unordered pieces. | Homo sapiens | 34,763 | Aug. 3, 1999 |
| | | GB_HTG3:AC009016 | 128095 | AC009016 | Homo sapiens chromosome 5 clone P1_889E7, *SEQUENCING IN PROGRESS*, 67 unordered pieces. | Homo sapiens | 34,763 | Aug. 3, 1999 |
| | | GB_HTG3:AC009010 | 72817 | AC009010 | Homo sapiens chromosome 5 clone P1_1352A1, *SEQUENCING IN PROGRESS*, 19 unordered pieces. | Homo sapiens | 34,763 | Aug. 3, 1999 |
| rxa02546 | 1227 | GB_HTG3:AC006519 | 134365 | AC006519 | Homo sapiens clone RPCI5-951N9, *SEQUENCING IN PROGRESS*, 41 unordered pieces. | Homo sapiens | 32,868 | Sep. 16, 1999 |
| | | GB_BA1:D90738 | 17528 | D90738 | Escherichia coli genomic DNA. (23.0–23.4 min). | Escherichia coli | 38,674 | Feb. 7, 1999 |
| | | GB_HTG3:AC006519 | 134365 | AC006519 | Homo sapiens clone RPCI5-951N9, *SEQUENCING IN PROGRESS*, 41 unordered pieces. | Homo sapiens | 32,868 | Sep. 16, 1999 |
| rxa02549 | 2826 | GB_BA1:CGBPHI16 | 962 | Y12472 | C. glutamicum DNA, attachment site bacteriophage Phi-16. | Corynebacterium glutamicum | 41,702 | Mar. 5, 1999 |
| | | GB_BA2:AE001095 | 10592 | AE001095 | Archaeoglobus fulgidus section 12 of 172 of the complete genome. | Archaeoglobus fulgidus | 36,817 | Dec. 15, 1997 |
| | | GB_EST20:AA887411 | 587 | AA887411 | oj37d06.s1 NCI_CGAP_Lu5 Homo sapiens cDNA clone IMAGE:1500491 3' similar to gb:X69908_mal ATP SYNTHASE LIPID-BINDING PROTEIN P2 PRECURSOR (HUMAN); mRNA sequence. | Homo sapiens | 41,738 | Jun. 9, 1998 |
| rxa02552 | 918 | GB_GSS9:AQ129371 | 377 | AQ129371 | HS_3045_A2_B07_MR CIT Approved Human Genomic Sperm Library D Homo sapiens genomic clone Plate = 3045 Col = 14 Row = C, genomic survey sequence. | Homo sapiens | 42,857 | Sep. 23, 1998 |
| | | GB_GSS14:AQ566979 | 600 | AQ566979 | HS_2105_A2_D12_MR CIT Approved Human Genomic Sperm Library D Homo sapiens genomic clone Plate = 2105 Col = 24 Row = G, genomic survey sequence. | Homo sapiens | 35,443 | May 29, 1999 |
| rxa02554 | 747 | GB_IN1:MEPAP | 4636 | X54422 | M. edulis gene for polyphenolic adhesive protein. | Mytilus edulis | 35,619 | May 27, 1992 |
| | | GB_PR4:AC004882 | 171878 | AC004882 | Homo sapiens PAC clone DJ076B20 from 22, complete sequence. | Homo sapiens | 37,346 | Oct. 22, 1999 |
| | | GB_PR4:AC004882 | 171878 | AC004882 | Homo sapiens PAC clone DJ076B20 from 22, complete sequence. | Homo sapiens | 38,440 | Oct. 22, 1999 |
| | | GB_BA2:U32830 | 16388 | U32830 | Haemophilus influenzae Rd section 145 of 163 of the complete genome. | Haemophilus influenzae Rd | 33,514 | May 29, 1998 |
| rxa02555 | 726 | GB_GSS1:FR0020618 | 468 | AL013501 | F. rubripes GSS sequence, clone 042H13bD8, genomic survey sequence. | Fugu rubripes | 40,215 | Dec. 10, 1997 |
| | | GB_GSS1:FR0020576 | 555 | AL013459 | F. rubripes GSS sequence, clone 042H13aE5, genomic survey sequence. | Fugu rubripes | 35,379 | Dec. 10, 1997 |
| | | GB_GSS1:FR0020585 | 431 | AL013468 | F. rubripes GSS sequence, clone 042H13aH5, genomic survey sequence. | Fugu rubripes | 39,718 | Dec. 10, 1997 |
| rxa02564 | 1125 | GB_PR3:AC004976 | 127425 | AC004976 | Homo sapiens PAC clone DJ1143H19 from 7p14-p15, complete sequence. | Homo sapiens | 37,364 | Nov. 5, 1998 |
| | | GB_PR2:HUAC002038 | 161973 | AC002038 | Homo sapiens chromosome 2 clone 101B6 map 2p11, complete sequence. | Homo sapiens | 36,404 | Jun. 30, 1997 |
| | | GB_HTG3:AC010791 | 111643 | AC010791 | Homo sapiens chromosome 17 clone 6_M_14 map 17, *SEQUENCING IN PROGRESS*, 8 unordered pieces. | Homo sapiens | 34,293 | Sep. 22, 1999 |
| rxa02568 | 1753 | GB_BA1:FT16SRNAA | 1521 | Z1931 | F. tularensis 16S rRNA. | Francisella tularensis | 39,065 | Jun. 5, 1997 |
| | | GB_BA1:FT16SRNAB | 1520 | Z1932 | F. tularensis 16S rRNA. | Francisella tularensis | 37,607 | Dec. 16, 1997 |
| | | GB_BA1:FP16SRNAA | 1518 | Z1933 | F. philomiragia 16S rRNA. | Francisella philomiragia | 36,380 | Jun. 5, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02569 | 873 | GB_GSS13:AQ469518 | 553 | AQ469518 | CITBI-E1-2596J20.TR CITBI-E1 *Homo sapiens* genomic clone 2596J20, genomic survey sequence. | *Homo sapiens* | 39,201 | Apr. 23, 1999 |
| | | GB_GSS12:AQ403903 | 495 | AQ403903 | HS_5058_B1_F07_T7A RPCI-11 Human Male BAC Library *Homo sapiens* genomic clone Plate = 634 Col = 13 Row = L, genomic survey sequence. | *Homo sapiens* | 36,049 | Mar. 13, 1999 |
| rxa02570 | 765 | GB_PR2:AF004715 | 2889 | AF004715 | *Homo sapiens* jerky gene product homolog mRNA, complete cds. | *Homo sapiens* | 35,689 | Aug. 6, 1997 |
| | | GB_BA1:CGU43535 | 2531 | U43535 | *Corynebacterium glutamicum* multidrug resistance protein (cmr) gene, complete cds. | *Corynebacterium glutamicum* | 38,165 | Apr. 9, 1997 |
| | | GB_EST33:AI776398 | 499 | AI776398 | EST257498 tomato resistant, Cornell *Lycopersicon esculentum* cDNA clone cLER18I10, mRNA sequence. | *Lycopersicon esculentum* | 42,084 | Jun. 29, 1999 |
| | | GB_EST23:AI119807 | 431 | AI119807 | uc21a06.r1 Soares mouse mammary gland NbMMG *Mus musculus* cDNA clone IMAGE:1398610 5', mRNA sequence. | *Mus musculus* | 40,281 | Sep. 2, 1998 |
| rxa02573 | | | | | | | | |
| rxa02575 | 1258 | GB_BA1:SCGD3 | 33779 | AL096822 | *Streptomyces coelicolor* cosmid GD3. | *Streptomyces coelicolor* | 39,742 | Jul. 8, 1999 |
| | | GB_RO:AC002108 | 41125 | AC002108 | Genomic sequence from Mouse 4, complete sequence. | *Mus musculus* | 36,100 | May 29, 1997 |
| | | GB_PR1:HUMIDS | 36845 | L35485 | *Homo sapiens* iduronate sulphatase (IDS) gene, complete cds. | *Homo sapiens* | 34,183 | Aug. 16, 1994 |
| rxa02576 | 1545 | GB_GSS15:AQ618143 | 582 | AQ618143 | HS_5168_B1_H08_T7A RPCI-11 Human Male BAC Library *Homo sapiens* genomic clone Plate = 744 Col = 15 Row = P, genomic survey sequence. | *Homo sapiens* | 34,874 | Jun. 15, 1999 |
| | | GB_OV:XLFB1A1 | 2172 | X64750 | *X. laevis* mRNA for transcription factor (clone XLFB1a1). | *Xenopus laevis* | 38,589 | Jan. 26, 1993 |
| | | GB_PR4:AC005039 | 151316 | AC005039 | *Homo sapiens* clone NH0512E16, complete sequence. | *Homo sapiens* | 33,575 | Jan. 14, 1999 |
| rxa02577 | 1008 | GB_PL2:AF034976 | 7130 | AF034976 | *Pilayella littoralis* ribosomal protein S14 (rps14) gene, partial cds; ATPase subunit 8 (atp8) gene, complete cds; tRNA-Ser gene, complete sequence; ribosomal protein S10 (rps10) and ribosomal protein L31 (rpl31) genes, complete cds; tRNA-Ser gene, complete sequence, T7-like RNA polymerase (rpox) gene, complete cds; and unknown genes, mitochondrial genes for mitochondrial products. | *Mitochondrion Pilayella littoralis* | 34,690 | Jun. 22, 1998 |
| | | GB_EST30:AI655188 | 456 | AI655188 | wb67g02.x1 NCI_CGAP_GC6 *Homo sapiens* cDNA clone IMAGE:2310770 3', mRNA sequence. | *Homo sapiens* | 39,198 | May 4, 1999 |
| | | GB_PL2:AF034976 | 7130 | AF034976 | *Pilayella littoralis* ribosomal protein S14 (rps14) gene, partial cds; ATPase subunit 8 (atp8) gene, complete cds; tRNA-Ser gene, complete sequence; ribosomal protein S10 (rps10) and ribosomal protein L31 (rpl31) genes, complete cds; tRNA-Ser gene, complete sequence, T7-like RNA polymerase (rpox) gene, complete cds; and unknown genes, mitochondrial genes for mitochondrial products. | *Mitochondrion Pilayella littoralis* | 39,959 | Jun. 22, 1998 |
| rxa02584 | 474 | GB_PR2:AP000191 | 100000 | AP000191 | *Homo sapiens* genomic DNA, chromosome 21q22.1, D21S226-AML region, clone Q78C10-f32E9, segment 18/21, complete sequence. | *Homo sapiens* | 37,199 | Nov. 20, 1999 |
| | | GB_EST13:AA349881 | 293 | AA349881 | EST56832 Infant brain *Homo sapiens* cDNA 5' end similar to EST containing Alu repeat, mRNA sequence. | *Homo sapiens* | 42,466 | Apr. 21, 1997 |
| | | GB_EST23:AI078215 | 404 | AI078215 | oz12h12.x1 Soares_fetal_liver_spleen_1NFLS_S1 *Homo sapiens* cDNA clone IMAGE:1675175 3' similar to contains Alu repetitive element; contains element THR repetitive element; mRNA sequence. | *Homo sapiens* | 48,780 | Sep. 29, 1998 |
| rxa02585 | 1104 | GB_PR2:AP000115 | 100000 | AP000115 | *Homo sapiens* genomic DNA of 21q22.1, GART and AML related, Q78C10-149C3 region, segment 18/20, complete sequence. | *Homo sapiens* | 35,502 | Sep. 25, 1999 |
| | | GB_PR2:AP000191 | 100000 | AP000191 | *Homo sapiens* genomic DNA, chromosome 21q22.1, D21S226-AML region, clone Q78C10-f32E9, segment 18/21, complete sequence. | *Homo sapiens* | 35,502 | Nov. 20, 1999 |
| | | GB_PR2:AP000047 | 50188 | AP000047 | *Homo sapiens* genomic DNA, chromosome 21q22.1, segment 18/26, complete sequence. | *Homo sapiens* | 35,502 | Nov. 20, 1999 |
| rxa02588 | 807 | GB_BA1:MTCY8D5 | 39730 | Z92669 | *Mycobacterium tuberculosis* H37Rv complete genome; segment 12/162. | *Mycobacterium* | 38,354 | Jun. 18, 1998 |

TABLE 4-continued
ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_BA1:MTCY349 | 43523 | Z83018 | Mycobacterium tuberculosis H37Rv complete genome; segment 131/162. | Mycobacterium tuberculosis | 39,949 | Jun. 17, 1998 |
| rxa02591 | 1953 | GB_HTG2:AC007879 | 158841 | AC007879 | Homo sapiens clone NH0309L06, **SEQUENCING IN PROGRESS**, 2 unordered pieces. | Homo sapiens | 36,835 | Jul. 31, 1999 |
| | | GB_BA1:MTCY8D5 | 39730 | Z92669 | Mycobacterium tuberculosis H37Rv complete genome; segment 12/162. | Mycobacterium tuberculosis | 65,398 | Jun. 18, 1998 |
| | | GB_BA1:MLCL622 | 42498 | Z95398 | Mycobacterium leprae cosmid L622. | Mycobacterium leprae | 63,875 | Jun. 24, 1997 |
| | | GB_BA1:CHBATP2OP | 5477 | L08777 | Chlorobium limicola atp2 operon. | Chlorobium limicola | 37,979 | Apr. 26, 1993 |
| rxa02593 | 720 | GB_GSS1:CNS0056G | 994 | AL057090 | Drosophila melanogaster genome survey sequence T7 end of BAC # BACR11M23 of RPCI-98 library from Drosophila melanogaster (fruit fly), genomic survey sequence. | Drosophila melanogaster | 27,206 | Jun. 3, 1999 |
| | | GB_GSS1:CNS0056G | 994 | AL057090 | Drosophila melanogaster genome survey sequence T7 end of BAC # BACR11M23 of RPCI-98 library from Drosophila melanogaster (fruit fly), genomic survey sequence. | Drosophila melanogaster | 30,270 | Jun. 3, 1999 |
| rxa02598 | 714 | GB_IN1:PFMAL3P5 | 86829 | AL034556 | Plasmodium falciparum MAL3P5, complete sequence. | Plasmodium falciparum | 40,057 | Oct. 4, 1999 |
| | | GB_PL1:AB024026 | 23026 | AB024026 | Arabidopsis thaliana genomic DNA, chromosome 5, TAC clone: K15O15, complete sequence. | Arabidopsis thaliana | 38,865 | Nov. 20, 1999 |
| | | GB_BA2:AE000930 | 15553 | AE000930 | Methanobacterium thermoautotrophicum from bases 1592014 to 1607566 (section 136 of 148) of the complete genome. | Methanobacterium thermoautotrophicum | 36,804 | Nov. 15, 1997 |
| rxa02600 | 1521 | GB_IN2:AC004301 | 66620 | AC004301 | Drosophila melanogaster DNA sequence (P1 DS07134 (D192)), complete sequence. | Drosophila melanogaster | 36,063 | May 29, 1998 |
| | | GB_PL2:AC007504 | 125021 | AC007504 | Arabidopsis thaliana chromosome I BAC F13F21 genomic sequence, complete sequence. | Arabidopsis thaliana | 37,074 | Jul. 9, 1999 |
| | | GB_PH:AF125520 | 61670 | AF125520 | Bacteriophage 933W, complete genome. | Bacteriophage 933W | 35,396 | Apr. 16, 1999 |
| rxa02601 | 2112 | GB_BA1:MTV026 | 23740 | AL022076 | Mycobacterium tuberculosis H37Rv complete genome, segment 157/162. | Mycobacterium tuberculosis | 38,676 | Jun. 24, 1999 |
| | | GB_BA2:SSU73126 | 2331 | U73126 | Sphingomonas sp. A8AN3 catechol 2,3-dioxygenase gene, complete cds and 2-hydroxymuconic semialdehyde hydrolase and 2-hydroxymuconic semialdehyde dehydrogenase genes, partial cds. | Sphingomonas sp. A8AN3 | 40,020 | Feb. 1, 1999 |
| | | GB_BA2:SSU73126 | 2331 | U73126 | Sphingomonas sp. A8AN3 catechol 2,3-dioxygenase gene, complete cds and 2-hydroxymuconic semialdehyde hydrolase and 2-hydroxymuconic semialdehyde dehydrogenase genes, partial cds. | Sphingomonas sp. A8AN3 | 40,101 | Feb. 1, 1999 |
| rxa02602 | 627 | GB_PR3:AF006751 | 3106 | AF006751 | Homo sapiens ES/130 mRNA, complete cds. | Homo sapiens | 37,582 | Jul. 10, 1998 |
| | | GB_PR3:AF006751 | 3106 | AF006751 | Homo sapiens ES/130 mRNA, complete cds. | Homo sapiens | 38,462 | Jul. 10, 1998 |
| | | GB_GSS9:AQ090116 | 404 | AQ090116 | HS_3000_B1_E09_MF CIT Approved Human Genomic Sperm Library D Homo sapiens genomic clone Plate = 3000 Col = 17 Row = J, genomic survey sequence. | Homo sapiens | 39,481 | Aug. 26, 1998 |
| rxa02604 | 2199 | GB_PL1:CREHHH3G | 4358 | L41841 | Chlamydomonas reinhardtii histone H3, histone H4, histone H2B, and histone H2A genes, complete cds. | Chlamydomonas reinhardtii | 37,500 | May 16, 1996 |
| | | GB_GSS13:AQ455681 | 621 | AQ455681 | HS_5068_B1_E01_T7A RPCI-11 Human Male BAC Library Homo sapiens genomic clone Plate = 644 Col = 1 Row = J, genomic survey sequence. | Homo sapiens | 36,246 | Apr. 21, 1999 |
| | | GB_GSS6:AQ829471 | 392 | AQ829471 | HS_5442_A2_F11_SP6E RPCI-11 Human Male BAC Library Homo sapiens genomic clone Plate = 1018 Col = 22 Row = K, genomic survey sequence. | Homo sapiens | 42,347 | Aug. 27, 1999 |
| rxa02606 | 1494 | GB_PAT:A26027 | 2547 | A26027 | C. melassecola gene for extracellular antigen PS1. | Corynebacterium melassecola | 42,857 | Apr. 2, 1995 |
| | | GB_BA1:CGCOP1G | 2547 | X66078 | C. glutamicum cop1 gene for PS1. | Corynebacterium glutamicum | 42,857 | Jun. 30, 1993 |
| | | GB_PR2:AP000134 | 100000 | AP000134 | Homo sapiens genomic DNA of 21q22.1, GART and AML, f43D11-119B8 region, segment 9/10, complete sequence. | Homo sapiens | 36,145 | Sep. 25, 1999 |
| rxa02609 | 372 | GB_HTG3:AC009212 | 125452 | AC009212 | Drosophila melanogaster chromosome 3 clone BACR01A18 (D669) RPCI-98 01.A.18 map 82E–82F strain y; cn bw sp, **SEQUENCING IN PROGRESS**, 119 unordered pieces. | Drosophila melanogaster | 35,753 | Aug. 23, 1999 |
| | | GB_HTG3:AC009212 | 125452 | AC009212 | Drosophila melanogaster chromosome 3 clone BACR01A18 (D669) RPCI-98 01.A.18 map 82E–82F strain y; cn bw sp, **SEQUENCING IN PROGRESS**, 119 unordered pieces. | Drosophila melanogaster | 35,753 | Aug. 23, 1999 |
| | | GB_HTG2:AC007589 | 134659 | AC007589 | Drosophila melanogaster chromosome 3 clone BACR20D10 (D667) RPCI-98 20.D.10 map | Drosophila melanogaster | 35,484 | Aug. 2, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02610 | 1050 | GB_BA2:AF073776 | 5138 | AF073776 | 82D–82E strain y; cn bw sp, *SEQUENCING IN PROGRESS*, 73 unordered pieces. | | 38,323 | Oct. 19, 1998 |
| | | GB_BA1:AB015853 | 5461 | AB015853 | Pseudomonas aeruginosa MexZ (mexZ), complete cds; and mexGH operon, complete sequence. | Pseudomonas aeruginosa | 38,447 | Nov. 13, 1998 |
| | | GB_VI:HIM237805 | 2400 | AJ237805 | Pseudomonas aeruginosa gene for MexX and MexY, complete cds. | Pseudomonas aeruginosa | 37,928 | Jun. 15, 1999 |
| | | | | | Human immunodeficiency virus type 1 partial envelope gene (gp160), isolate MP255. | Human immunodeficiency virus type 1 | | |
| rxa02617 | 630 | GB_PR2:HSL81781 | 4041 | L81781 | Homo sapiens (subclone 7_e4 from P1 H25) DNA sequence, complete sequence. | Homo sapiens | 38,835 | Apr. 9, 1997 |
| | | GB_HTG3:AC011430 | 106902 | AC011430 | Homo sapiens chromosome 5 clone P1_660D11, *SEQUENCING IN PROGRESS*, 28 unordered pieces. | Homo sapiens | 38,662 | Oct. 6, 1999 |
| | | GB_HTG3:AC011430 | 106902 | AC011430 | Homo sapiens chromosome 5 clone P1_660D11, *SEQUENCING IN PROGRESS*, 28 unordered pieces. | Homo sapiens | 38,662 | Oct. 6, 1999 |
| rxa02619 | 1023 | GB_BA1:CGL133719 | 1839 | AJ133719 | Corynebacterium glutamicum yjcc gene, amtR gene and citE gene, partial. | Corynebacterium glutamicum | 100,000 | Aug. 12, 1999 |
| | | GB_BA1:CGL133719 | 1839 | AJ133719 | Corynebacterium glutamicum yjcc gene, amtR gene and citE gene, partial. | Corynebacterium glutamicum | 100,000 | Aug. 12, 1999 |
| | | GB_EST18:AA734344 | 378 | AA734344 | vv24f02.r1 Stratagene mouse heart (#937316) Mus musculus cDNA clone IMAGE:1223355 5', mRNA sequence. | Mus musculus | 37,968 | Jan. 7, 1998 |
| rxa02620 | 789 | GB_BA1:CGL133719 | 1839 | AJ133719 | Corynebacterium glutamicum yjcc gene, amtR gene and citE gene, partial. | Corynebacterium glutamicum | 100,000 | Aug. 12, 1999 |
| | | GB_BA1:CGL133719 | 1839 | AJ133719 | Corynebacterium glutamicum yjcc gene, amtR gene and citE gene, partial. | Corynebacterium glutamicum | 100,000 | Aug. 12, 1999 |
| | | GB_EST16:C27457 | 252 | C27457 | C27457 Rice callus cDNA Oryza sativa cDNA clone C51917_1A, mRNA sequence. | Oryza sativa | 39,044 | Aug. 6, 1997 |
| rxa02624 | 1419 | GB_HTG2:AC005995 | 170023 | AC005995 | Homo sapiens clone DJ0042M02, *SEQUENCING IN PROGRESS*, 13 unordered pieces. | Homo sapiens | 38,533 | Apr. 23, 1999 |
| | | GB_HTG2:AC005995 | 170023 | AC005995 | Homo sapiens clone DJ0042M02, *SEQUENCING IN PROGRESS*, 13 unordered pieces. | Homo sapiens | 38,533 | Apr. 23, 1999 |
| | | GB_PR4:AC004895 | 152927 | AC004895 | Homo sapiens clone DJ0810E06, complete sequence. | Homo sapiens | 38,533 | May 29, 1999 |
| rxa02639 | 957 | GB_BA1:MSGY409 | 41321 | AD000017 | Mycobacterium tuberculosis sequence from clone y409. | Mycobacterium tuberculosis | 50,370 | Dec. 10, 1996 |
| | | GB_BA1:MTCY409 | 30352 | Z97186 | Mycobacterium tuberculosis H37Rv complete genome; segment 158/162. | Mycobacterium tuberculosis | 38,039 | Jun. 17, 1998 |
| | | GB_HTG2:AC006765 | 274498 | AC006765 | Caenorhabditis elegans clone Y43H11, *SEQUENCING IN PROGRESS*, 7 unordered pieces. | Caenorhabditis elegans | 35,225 | Feb. 23, 1999 |
| rxa02647 | 585 | GB_PAT:A45577 | 1925 | A45577 | Sequence 1 from Patent WO9519442. | Corynebacterium glutamicum | 37,545 | Mar. 7, 1997 |
| | | GB_PAT:A45579 | 1925 | A45579 | Sequence 3 from Patent WO9519442. | Corynebacterium glutamicum | 37,545 | Mar. 7, 1997 |
| | | GB_PAT:A45581 | 1925 | A45581 | Sequence 5 from Patent WO9519442. | Corynebacterium glutamicum | 37,545 | Mar. 7, 1997 |
| rxa02649 | 1125 | GB_BA1:D90904 | 150894 | D90904 | Synechocystis sp. PCC6803 complete genome, 6/27, 630555-781448. | Synechocystis sp. | 37,772 | Feb. 7, 1999 |
| | | GB_PR3:HS941F9 | 127587 | Z95331 | Human DNA sequence from BAC 941F9 on chromosome 22q11.2-qter. Contains ESTs, STSs and 3' part of FIBULIN-1 D PRECURSOR like gene, part of a Brain Protein E46 like gene and a CpG island, complete sequence. | Homo sapiens | 38,748 | Nov. 23, 1999 |
| rxa02652 | 702 | GB_BA1:D90904 | 150894 | D90904 | Synechocystis sp. PCC6803 complete genome, 6/27, 630555-781448. | Synechocystis sp. | 36,364 | Feb. 7, 1999 |
| | | GB_BA2:AF048749 | 24454 | AF048749 | Bacteroides fragilis capsular polysaccharide biosynthesis operon, complete sequence. | Bacteroides fragilis | 37,464 | Jun. 25, 1999 |
| | | GB_HTG4:AC009244 | 318775 | AC009244 | Homo sapiens chromosome 7, *SEQUENCING IN PROGRESS*, 36 unordered pieces. | Homo sapiens | 35,447 | Oct. 26, 1999 |
| | | GB_HTG4:AC009244 | 318775 | AC009244 | Homo sapiens chromosome 7, *SEQUENCING IN PROGRESS*, 36 unordered pieces. | Homo sapiens | 35,447 | Oct. 26, 1999 |
| rxa02655 | 1107 | GB_EST10:AA185699 | 290 | AA185699 | mt62d11.r1 Soares 2NbMT Mus musculus cDNA clone IMAGE:634485 5' similar to | Mus musculus | 39,510 | Feb. 19, 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | | | | TR:G300372 G300372 CELL GROWTH REGULATING NUCLEOLAR PROTEIN; mRNA sequence. | | | |
| | | GB_GSS13:AQ429764 | 439 | AQ429764 | HS_5079_A2_C12_SP6F RPCI-11 Human Male BAC Library *Homo sapiens* genomic clone Plate = 655 Col = 24 Row = E, genomic survey sequence. | *Homo sapiens* | 37,701 | Mar. 31, 1999 |
| rxa02662 | 387 | GB_GSS8:AQ012380 | 646 | AQ012380 | CIT-HSP-2300L9.TF CIT-HSP *Homo sapiens* genomic clone 2300L9, genomic survey sequence. | *Homo sapiens* | 38,874 | Jun. 6, 1998 |
| | | GB_HTG2:AC007802 | 118569 | AC007802 | *Drosophila melanogaster* chromosome 2 clone BACR07I11 (D648) RPCI-98 07.I.11 map 58A1- 58A2 strain y; cn bw sp, **SEQUENCING IN PROGRESS**, 70 unordered pieces. | *Drosophila melanogaster* | 37,696 | Aug. 2, 1999 |
| | | GB_HTG2:AC007802 | 118569 | AC007802 | *Drosophila melanogaster* chromosome 2 clone BACR07I11 (D648) RPCI-98 07.I.11 map 58A1- 58A2 strain y; cn bw sp, **SEQUENCING IN PROGRESS**, 70 unordered pieces. | *Drosophila melanogaster* | 37,696 | Aug. 2, 1999 |
| | | GB_HTG2:AC007802 | 118569 | AC007802 | *Drosophila melanogaster* chromosome 2 clone BACR07I11 (D648) RPCI-98 07.I.11 map 58A1- 58A2 strain y; cn bw sp, **SEQUENCING IN PROGRESS**, 70 unordered pieces. | *Drosophila melanogaster* | 35,616 | Aug. 2, 1999 |
| rxa02669 | 603 | GB_HTG1:AC002419 | 128340 | AC002419 | *Homo sapiens* chromosome X clone bWXD40, **SEQUENCING IN PROGRESS**, 2 unordered pieces. | *Homo sapiens* | 32,941 | Aug. 12, 1997 |
| | | GB_HTG1:AC002419 | 128340 | AC002419 | *Homo sapiens* chromosome X clone bWXD40, **SEQUENCING IN PROGRESS**, 2 unordered pieces. | *Homo sapiens* | 32,941 | Aug. 12, 1997 |
| | | GB_GSS15:AQ655091 | 630 | AQ655091 | Sheared DNA-21B5.TF Sheared DNA *Trypanosoma brucei* genomic clone Sheared DNA-21B5, genomic survey sequence. | *Trypanosoma brucei* | 41,794 | Jun. 22, 1999 |
| rxa02670 | 705 | GB_HTG2:AC006450 | 177555 | AC006450 | *Homo sapiens* chromosome 9 clone hRPK.85_O_21 map 9, **SEQUENCING IN PROGRESS**, 2 ordered pieces. | *Homo sapiens* | 41,374 | Jul. 15, 1999 |
| | | GB_HTG2:AC006450 | 177555 | AC006450 | *Homo sapiens* chromosome 9 clone hRPK.85_O_21 map 9, **SEQUENCING IN PROGRESS**, 2 ordered pieces. | *Homo sapiens* | 41,374 | Jul. 15, 1999 |
| | | GB_BA1:SPU86147 | 2266 | U86147 | *Synechococcus* PCC7942 UDP-N-acetylenolpyruvylglucosamine reductase (murB), and merceuric resistance operon regulatory protein (merR) genes, complete cds. UDP-N-acetylmuramate-alanine ligase (murC) gene, partial cds, | *Synechococcus* PCC7942 | 40,177 | Feb. 15, 1997 |
| rxa02672 | 1221 | GB_BA1:MTV024 | 8189 | AL022075 | *Mycobacterium tuberculosis* H37Rv complete genome, segment 151/162. | *Mycobacterium tuberculosis* | 53,197 | Jun. 17, 1998 |
| | | GB_BA1:MSGY23 | 40806 | AD000016 | *Mycobacterium tuberculosis* sequence from clone y23. | *Mycobacterium tuberculosis* | 37,500 | Dec. 10, 1996 |
| | | GB_EST38:AW029724 | 534 | AW029724 | EST272979 tomato callus, TAMU *Lycopersicon esculentum* cDNA clone cLEC28I17 similar to beta-ketoacyl-ACP synthase, putative, mRNA sequence. | *Lycopersicon esculentum* | 40,000 | Sep. 15, 1999 |
| rxa02673 | 756 | GB_GSS12:AQ356661 | 518 | AQ356661 | CITBI-E1-2531G11.TF CITBI-E1 *Homo sapiens* genomic clone 2531G11, genomic survey sequence. | *Homo sapiens* | 33,022 | Jan. 24, 1999 |
| | | GB_IN1:CELC50A2 | 36582 | AF036689 | *Caenorhabditis elegans* cosmid C50A2. | *Caenorhabditis elegans* | 35,443 | Dec. 5, 1997 |
| | | GB_HTG2:AC006702 | 299864 | AC006702 | *Caenorhabditis elegans* clone Y104H12b, **SEQUENCING IN PROGRESS**, 3 unordered pieces. | *Caenorhabditis elegans* | 35,443 | Feb. 23, 1999 |
| rxa02678 | 1041 | GB_HTG1:AP000452 | 83103 | AP000452 | *Homo sapiens* chromosome 11 clone PAC2 map 11q11, **SEQUENCING IN PROGRESS**, in unordered pieces. | *Homo sapiens* | 35,098 | Sep. 13, 1999 |
| | | GB_HTG1:AP000452 | 83103 | AP000452 | *Homo sapiens* chromosome 11 clone PAC2 map 11q11, **SEQUENCING IN PROGRESS**, in unordered pieces. | *Homo sapiens* | 35,098 | Sep. 13, 1999 |
| | | GB_PR3:HS498I24 | 58190 | AL031057 | Human DNA sequence from clone 498I24 on chromosome 6p22.1-22.3 Contains STS, GSS and a CpG island, complete sequence. | *Homo sapiens* | 35,328 | Nov. 23, 1999 |
| rxa02680 | 1407 | GB_BA1:MLCB268 | 38859 | AL022602 | *Mycobacterium leprae* cosmid B268. | *Mycobacterium leprae* | 37,797 | Aug. 27, 1999 |
| | | GB_BA1:MSGB1554CS | 36548 | L78814 | *Mycobacterium leprae* cosmid B1554 DNA sequence. | *Mycobacterium leprae* | 36,900 | Jun. 15, 1996 |
| | | GB_BA1:MSGB1551CS | 36548 | L78813 | *Mycobacterium leprae* cosmid B1551 DNA sequence. | *Mycobacterium leprae* | 36,900 | Jun. 15, 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02683 | | | | | | | | |
| rxa02685 | 780 | GB_HTG3:AC008640 | 198483 | AC008640 | Homo sapiens chromosome 5 clone CIT978SKB_17P2, *SEQUENCING IN PROGRESS*, 70 unordered pieces. | Homo sapiens | 37,299 | Aug. 3, 1999 |
| | | GB_HTG3:AC008640 | 198483 | AC008640 | Homo sapiens chromosome 5 clone CIT978SKB_17P2, *SEQUENCING IN PROGRESS*, 70 unordered pieces. | Homo sapiens | 37,299 | Aug. 3, 1999 |
| rxa02688 | 792 | GB_BA2:AE000945 | 11317 | AE000945 | Archaeoglobus fulgidus section 162 of 172 of the complete genome. | Archaeoglobus fulgidus | 38,760 | Dec. 15, 1997 |
| | | GB_BA1:CORPHEA | 1088 | M13774 | C. glutamicum pheA gene encoding prephenate dehydratase, complete cds. | Corynebacterium glutamicum | 100,000 | Apr. 26, 1993 |
| | | GB_HTG2:AC007554 | 167095 | AC007554 | Homo sapiens clone hRPK.74_A_1, *SEQUENCING IN PROGRESS*, 10 unordered pieces. | Homo sapiens | 35,226 | May 14, 1999 |
| | | GB_HTG2:AC007554 | 167095 | AC007554 | Homo sapiens clone hRPK.74_A_1, *SEQUENCING IN PROGRESS*, 10 unordered pieces. | Homo sapiens | 35,226 | May 14, 1999 |
| rxa02689 | 465 | GB_GSS9:AQ110873 | 414 | AQ110873 | CIT-HSP-2378K10.TR CIT-HSP Homo sapiens genomic clone 2378K10, genomic survey sequence. | Homo sapiens | 34,768 | Aug. 29, 1998 |
| | | GB_OV:DUKFASA | 9138 | M21635 | Duck (A. platyrhynchos) S-acyl fatty acid synthase thioesterase gene, complete cds. | Anas platyrhynchos | 39,177 | Apr. 28, 1993 |
| | | GB_OV:DUKFASA | 9138 | M21635 | Duck (A. platyrhynchos) S-acyl fatty acid synthase thioesterase gene, complete cds. | Anas platyrhynchos | 35,022 | Apr. 28, 1993 |
| rxa02690 | 1221 | GB_HTG4:AC010096 | 223607 | AC010096 | Homo sapiens chromosome unknown clone NH0364A16, WORKING DRAFT SEQUENCE, in unordered pieces. | Homo sapiens | 39,301 | Oct. 29, 1999 |
| | | GB_HTG4:AC010096 | 223607 | AC010096 | Homo sapiens chromosome unknown clone NH0364A16, WORKING DRAFT SEQUENCE, in unordered pieces. | Homo sapiens | 39,301 | Oct. 29, 1999 |
| rxa02693 | 1899 | GB_BA2:AF132788 | 1411 | AF132788 | Fischerella muscicola small subunit ribosomal RNA gene, partial sequence. | Fischerella muscicola | 36,156 | Sep. 1, 1999 |
| | | GB_GSS5:AQ784372 | 542 | AQ784372 | HS_3181_A2_H12_T7C CIT Approved Human Genomic Sperm Library D Homo sapiens genomic clone Plate = 3181 Col = 24 Row = O, genomic survey sequence. | Homo sapiens | 41,546 | Aug. 3, 1999 |
| rxa02690 | | GB_HTG4:AC010573 | 80511 | AC010573 | Drosophila melanogaster chromosome 3L/70C12 clone RPCI98-2M13, *SEQUENCING IN PROGRESS*, 45 unordered pieces. | Drosophila melanogaster | 36,839 | Oct. 16, 1999 |
| | | GB_EST18:AA696238 | 640 | AA696238 | GM05354 5prime GM Drosophila melanogaster ovary BlueScript Drosophila melanogaster cDNA clone GM05354 5prime, mRNA sequence. | Drosophila melanogaster | 39,523 | Nov. 28, 1998 |
| rxa02696 | 579 | GB_BA1:AB003132 | 4116 | AB003132 | Corynebacterium glutamicum gene for MurC, FtsQ, FtsZ, complete cds. | Corynebacterium glutamicum | 100,000 | Aug. 4, 1997 |
| | | GB_PR4:AC006024 | 90583 | AC006024 | Homo sapiens PAC clone DJ1166G19 from 7p12-p11.2, complete sequence. | Homo sapiens | 36,049 | Feb. 20, 1999 |
| | | GB_HTG1:HSJ657D12 | 315458 | AL109943 | Homo sapiens chromosome X clone RP4-657D12 map q22.1-24, *SEQUENCING IN PROGRESS*, in unordered pieces. | Homo sapiens | 36,475 | Nov. 24, 1999 |
| rxa02697 | 1650 | GB_EST20:AA874010 | 365 | AA874010 | vw87b05.r1 Stratagene mouse skin (#937313) Mus musculus cDNA clone IMAGE:1261905 5', mRNA sequence. | Mus musculus | 39,452 | Mar. 19, 1998 |
| | | GB_EST30:AI658486 | 599 | AI658486 | tu17a09.x1 NCI_CGAP_Pr26 Homo sapiens cDNA clone IMAGE:2251288 3', mRNA sequence. | Homo sapiens | 37,324 | May 10, 1999 |
| | | GB_EST20:AA874010 | 365 | AA874010 | vw87b05.r1 Stratagene mouse skin (#937313) Mus musculus cDNA clone IMAGE:1261905 5', mRNA sequence. | Mus musculus | 39,452 | Mar. 19, 1998 |
| rxa02700 | 1359 | GB_BA1:SCF85 | 21420 | AL110470 | Streptomyces coelicolor cosmid F85. | Streptomyces coelicolor A3(2) | 39,497 | Sep. 1, 1999 |
| | | GB_HTG5:AC011629 | 69344 | AC011629 | Homo sapiens chromosome 15 clone 334_M_8 map 15, LOW-PASS SEQUENCE SAMPLING. | Homo sapiens | 37,462 | Nov. 13, 1999 |
| rxa02701 | 1431 | GB_HTG3:AC010106 | 157581 | AC010106 | Homo sapiens clone NH0575J05, *SEQUENCING IN PROGRESS*, 1 unordered pieces. | Homo sapiens | 36,220 | Sep. 11, 1999 |
| | | GB_BA1:MTCI65 | 34331 | Z95584 | Mycobacterium tuberculosis H37Rv complete genome; segment 50/162. | Mycobacterium tuberculosis | 41,867 | Jun. 17, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_BA1:MSGY348 | 40056 | AD000020 | *Mycobacterium tuberculosis* sequence from clone y348. | *Mycobacterium tuberculosis* | 43,338 | Dec. 10, 1996 |
| | | GB_PR2:AP000117 | 151516 | AP000117 | *Homo sapiens* genomic DNA of 21q22.1, GART and AML related, Q78C10-149C3 region, segment 20/20, complete sequence. | *Homo sapiens* | 36,037 | Sep. 25, 1999 |
| rxa02712 | 918 | GB_BA2:AF124600 | 4115 | AF124600 | *Corynebacterium glutamicum* chorismate synthase (aroC), shikimate kinase (aroK), and 3-dehydroquinate synthase (aroB) genes, complete cds; and putative cytoplasmic peptidase (pepQ) gene, partial cds. | *Corynebacterium glutamicum* | 37,294 | May 4, 1999 |
| | | GB_BA2:AF053071 | 1063 | AF053071 | *Corynebacterium glutamicum* dehydroquinate synthetase (aroB) gene, complete cds. | *Corynebacterium glutamicum* | 39,675 | Sep. 12, 1998 |
| | | GB_BA1:BSTHRZ | 19861 | Z80360 | *B. subtilis* thrZ downstream chromosomal region. | *Bacillus subtilis* | 34,002 | Jun. 24, 1998 |
| rxa02714 | 552 | GB_PL2:ATF9F13 | 109936 | AL080253 | *Arabidopsis thaliana* DNA chromosome 4, BAC clone F9F13 (ESSA project). | *Arabidopsis thaliana* | 39,252 | Aug. 16, 1999 |
| | | GB_PL2:ATT29H11 | 87011 | AL049659 | *Arabidopsis thaliana* DNA chromosome 3, BAC clone T29H11. | *Arabidopsis thaliana* | 34,249 | Jun. 9, 1999 |
| | | GB_EST4:H37460 | 489 | H37460 | 15589 Lambda-PRL2 *Arabidopsis thaliana* cDNA clone 18IN17T7, mRNA sequence. | *Arabidopsis thaliana* | 45,869 | Dec. 30, 1997 |
| rxa02715 | 513 | GB_GSS13:AQ454067 | 534 | AQ454067 | HS_5176_B1_A09_T7A RPCI-11 Human Male BAC Library *Homo sapiens* genomic clone Plate = 752 Col = 17 Row = B, genomic survey sequence. | *Homo sapiens* | 40,854 | Apr. 21, 1999 |
| | | GB_PR3:AC005495 | 185254 | AC005495 | *Homo sapiens* chromosome 17, clone hRPK.293_K_20, complete sequence. | *Homo sapiens* | 33,200 | Oct. 30, 1998 |
| | | GB_PR3:AC005495 | 185254 | AC005495 | *Homo sapiens* chromosome 17, clone hRPK.293_K_20, complete sequence. | *Homo sapiens* | 36,273 | Oct. 30, 1998 |
| rxa02720 | 825 | GB_BA1:AB003132 | 4116 | AB003132 | *Corynebacterium glutamicum* gene for MurC, FtsQ, FtsZ, complete cds. | *Corynebacterium glutamicum* | 98,788 | Aug. 4, 1997 |
| | | GB_BA1:BLFTSZ | 5546 | Y08964 | *B. lactofermentum* murC, ftsQ or divD & ftsZ genes. | *Corynebacterium glutamicum* | 100,000 | Oct. 8, 1998 |
| | | GB_HTG4:AC009764 | 213581 | AC009764 | *Homo sapiens* chromosome 11 clone 381_O_22 map 11, *SEQUENCING IN PROGRESS*, 40 unordered pieces. | *Homo sapiens* | 35,504 | Oct. 21, 1999 |
| rxa02721 | 861 | GB_BA1:BLFTSZ | 5546 | Y08964 | *B. lactofermentum* murC, ftsQ or divD & ftsZ genes. | *Corynebacterium glutamicum* | 98,606 | Oct. 8, 1998 |
| | | GB_BA1:AB003132 | 4116 | AB003132 | *Corynebacterium glutamicum* gene for MurC, FtsQ, FtsZ, complete cds. | *Corynebacterium glutamicum* | 97,561 | Aug. 4, 1997 |
| | | GB_BA1:SCI51 | 40745 | AL109848 | *Streptomyces coelicolor* cosmid I51. | *Streptomyces coelicolor* A3(2) | 39,110 | Aug. 16, 1999 |
| rxa02725 | 735 | GB_BA1:CGU43535 | 2531 | U43535 | *Corynebacterium glutamicum* multidrug resistance protein (cmr) gene, complete cds. | *Corynebacterium glutamicum* | 42,043 | Apr. 9, 1997 |
| | | GB_EST1:D40448 | 361 | D40448 | RICS2437A Rice shoot *Oryza sativa* cDNA, mRNA sequence. | *Oryza sativa* | 41,944 | Nov. 11, 1994 |
| | | GB_BA2:AF038430 | 8330 | AF038430 | *Thiobacillus neapolitanus* carboxysome operon, complete sequence. | *Thiobacillus neapolitanus* | 39,202 | Aug. 21, 1998 |
| rxa02727 | 1035 | GB_BA1:MTCY270 | 37586 | Z95388 | *Mycobacterium tuberculosis* H37Rv complete genome, segment 96/162. | *Mycobacterium tuberculosis* | 37,427 | Feb. 10, 1999 |
| | | GB_BA1:MTAG84 | 1458 | X77129 | *M. tuberculosis* Ag84 (CIE) gene. | *Mycobacterium tuberculosis* | 49,339 | Jul. 21, 1995 |
| | | GB_BA1:AP000064 | 247695 | AP000064 | *Aeropyrum pernix* genomic DNA, section 7/7. | *Aeropyrum pernix* | 38,790 | Jun. 22, 1999 |
| rxa02735 | 828 | GB_BA1:TVCPT | 1923 | X56901 | *T. vulgaris* cpT gene for carboxypeptidase T. | *Thermoactinomyces vulgaris* | 37,688 | Oct. 30, 1991 |
| | | GB_GSS4:AQ682162 | 355 | AQ682162 | HS_5503_B2_C11_SP6F RPCI-11 Human Male BAC Library *Homo sapiens* genomic clone Plate = 1079 Col = 22 Row = F, genomic survey sequence. | *Homo sapiens* | 35,294 | Jun. 28, 1999 |
| | | GB_EST21:AA915356 | 456 | AA915356 | vz29a08.r1 Soares 2NbMT *Mus musculus* cDNA clone IMAGE:1327862 5', mRNA sequence. | *Mus musculus* | 42,609 | Apr. 14, 1998 |
| rxa02736 | 1080 | GB_PAT1:E13655 | 2260 | E13655 | gDNA encoding glucose-6-phosphate dehydrogenase. | *Corynebacterium glutamicum* | 99,620 | Jun. 24, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_GSS13:AQ447106 | 711 | AQ447106 | mgxb0004P18f CUGI Rice Blast BAC Library *Magnaporthe grisea* genomic clone mgxb0004P18f, genomic survey sequence. | *Magnaporthe grisea* | 38,158 | Apr. 8, 1999 |
| | | GB_EST36:AI900650 | 670 | AI900650 | sb95c03.y1 Gm-c1012 *Glycine max* cDNA clone GENOME SYSTEMS CLONE ID: Gm-c1012-413 5' similar to SW:IF4Z_TOBAC Q40468 EUKARYOTIC INITIATION FACTOR 4A-15; mRNA sequence. | *Glycine max* | 37,479 | Dec. 6, 1999 |
| rxa02744 | 927 | GB_PR1:AB026898 | 270000 | AB026898 | *Homo sapiens* DNA, DLEC1 to ORCTL4 gene region, section 1/2 (DLEC1, ORCTL3, ORCTL4 genes, complete cds). | *Homo sapiens* | 39,364 | May 15, 1999 |
| | | GB_PR1:AB026898 | 270000 | AB026898 | *Homo sapiens* DNA, DLEC1 to ORCTL4 gene region, section 1/2 (DLEC1, ORCTL3, ORCTL4 genes, complete cds). | *Homo sapiens* | 36,275 | May 15, 1999 |
| | | GB_PR2:AP000498 | 100000 | AP000498 | *Homo sapiens* genomic DNA, chromosome 3p21.3, clone:603 to 320, anti-oncogene region, section 1/3. | *Homo sapiens* | 39,364 | Sep. 28, 1999 |
| rxa02751 | 597 | GB_HTG4:AC010127 | 189552 | AC010127 | *Homo sapiens* chromosome unknown clone NH0002108, WORKING DRAFT SEQUENCE, in unordered pieces. | *Homo sapiens* | 36,149 | Oct. 29, 1999 |
| | | GB_HTG4:AC010127 | 189552 | AC010127 | *Homo sapiens* chromosome unknown clone NH0002108, WORKING DRAFT SEQUENCE, in unordered pieces. | *Homo sapiens* | 36,149 | Oct. 29, 1999 |
| | | GB_HTG4:AC010127 | 189552 | AC010127 | *Homo sapiens* chromosome unknown clone NH0002108, WORKING DRAFT SEQUENCE, in unordered pieces. | *Homo sapiens* | 35,924 | Oct. 29, 1999 |
| rxa02756 | 1014 | GB_RO:CRUGIPR | 2785 | D38103 | Hamster mRNA for GIP (gastric inhibitory polypeptide) receptor, complete cds. | *Cricetulus sp.* | 38,501 | Feb. 8, 1999 |
| | | GB_HTG1:CNS01DRV | 224372 | AL118558 | *Homo sapiens* chromosome 14 clone R-1017G21, *SEQUENCING IN PROGRESS*, in unordered pieces. | *Homo sapiens* | 38,667 | Oct. 15, 1999 |
| | | GB_HTG1:CNS01DRV | 224372 | AL118558 | *Homo sapiens* chromosome 14 clone R-1017G21, *SEQUENCING IN PROGRESS*, in unordered pieces. | *Homo sapiens* | 38,667 | Oct. 15, 1999 |
| rxa02757 | 669 | GB_RO:RNU35245 | 2051 | U35245 | Rat vacuolar protein sorting homolog r-vps33b mRNA, complete cds. | *Rattus norvegicus* | 39,058 | Jan. 15, 1997 |
| | | GB_RO:RNU35245 | 2051 | U35245 | Rat vacuolar protein sorting homolog r-vps33b mRNA, complete cds. | *Rattus norvegicus* | 37,481 | Jan. 15, 1997 |
| rxa02765 | 882 | GB_EST4:H46883 | 459 | H46883 | yo19f06.r1 Soares adult brain N2b5HB55Y *Homo sapiens* cDNA clone IMAGE:178403 5', mRNA sequence. | *Homo sapiens* | 40,132 | Jul. 31, 1995 |
| | | GB_PL1:NTA6235 | 3931 | AJ006235 | *Nicotiana tabacum* DNA fragment for K-alpha right T-DNA border. | *Nicotiana tabacum* | 34,247 | Feb. 6, 1999 |
| | | GB_HTG3:AC011519 | 57287 | AC011519 | *Homo sapiens* chromosome 19 clone LLNL-F_192H5, *SEQUENCING IN PROGRESS*, 36 unordered pieces. | *Homo sapiens* | 38,497 | Oct. 7, 1999 |
| rxa02766 | 518 | GB_GSS13:AQ489419 | 554 | AQ489419 | RPCI-11-246A3.TV RPCI-11 *Homo sapiens* genomic clone RPCI-11-246A3, genomic survey sequence. | *Homo sapiens* | 37,821 | Apr. 24, 1999 |
| | | GB_PR3:HS90L6 | 190837 | Z97353 | Human DNA sequence from clone 90L6 on chromosome 22q11.21-11.23. Contains an RPL15 (60S Ribosomal Protein L15) pseudogene, ESTs, STSs and GSSs, complete sequence. | *Homo sapiens* | 38,160 | Nov. 23, 1999 |
| | | GB_BA1:MTCY373 | 35516 | Z73419 | *Mycobacterium tuberculosis* H37Rv complete genome; segment 57/162. | *Mycobacterium tuberculosis* | 36,701 | Jun. 17, 1998 |
| rxa02770 | 1689 | GB_BA2:AF038651 | 4077 | AF038651 | *Corynebacterium glutamicum* dipeptide-binding protein (dciAE) gene, partial cds; adenine phosphoribosyltransferase (apt) and GTP pyrophosphokinase (rel) genes, complete cds; and unknown gene. | *Corynebacterium glutamicum* | 100,000 | Sep. 14, 1998 |
| | | GB_OV:AF061275 | 6756 | AF061275 | *Ictalurus punctatus* estrogen receptor type alpha mRNA, complete cds. | *Ictalurus punctatus* | 37,117 | Oct. 31, 1998 |
| | | GB_RO:MMSCSELN4 | 3840 | X61756 | *M. musculus* rearranged T-cell receptor beta variable region (Vb17a). | *Mus musculus* | 37,933 | Dec. 3, 1991 |
| rxa02774 | 494 | GB_HTG2:AF129408 | 138685 | AF129408 | *Homo sapiens* chromosome 21 clone PAC 31K18 map 21q22.3, *SEQUENCING IN PROGRESS*, in unordered pieces. | *Homo sapiens* | 38,241 | Mar. 4, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG2:AF129408 | 138685 | AF129408 | *Homo sapiens* chromosome 21 clone PAC 31K18 map 21q22.3, **SEQUENCING IN PROGRESS*, in unordered pieces. | *Homo sapiens* | 38,241 | Mar. 4, 1999 |
| | | GB_PR3:AF064859 | 122571 | AF064859 | *Homo sapiens* chromosome 21q22.3 PAC 141B3, complete sequence, containing ribosomal protein homologue pseudogene L23a. | *Homo sapiens* | 37,910 | Jun. 2, 1998 |
| rxa02775 | 348 | GB_PR3:HSU19F10 | 31474 | Z81145 | Human DNA sequence from cosmid U19F10, between markers DXS366 and DXS87 on chromosome X contains ESTs. | *Homo sapiens* | 36,443 | Nov. 23, 1999 |
| | | GB_EST11:AA211850 | 293 | AA211850 | zr90e04.s1 NCI_CGAP_GCB1 *Homo sapiens* cDNA clone IMAGE:682974 3′ similar to TR:G1224065 G1224065 MER37. TRANSPOSABLE ELEMENT, COMPLETE CONSENSUS SEQUENCE; mRNA sequence. | *Homo sapiens* | 30,479 | Aug. 13, 1997 |
| | | GB_EST13:AA372532 | 400 | AA372532 | EST84441 Colon adenocarcinoma IV *Homo sapiens* cDNA 5′ end, mRNA sequence. | *Homo sapiens* | 40,104 | Apr. 21, 1997 |
| rxa02776 | 465 | GB_GSS9:AQ096114 | 383 | AQ096114 | HS_3030_A2_D11_MF CIT Approved Human Genomic Sperm Library D *Homo sapiens* genomic clone Plate = 3030 Col = 22 Row = G, genomic survey sequence. | *Homo sapiens* | 44,643 | Aug. 27, 1998 |
| | | GB_RO:AF139518 | 8827 | AF139518 | *Rattus norvegicus* A-kinase anchor protein mRNA, complete cds. | *Rattus norvegicus* | 39,722 | Jun. 16, 1999 |
| | | GB_EST32:AI728295 | 564 | AI728295 | BNLGHi10386 Six-day Cotton fiber *Gossypium hirsutum* cDNA 5′ similar to (AF076274) contains similarity to rat p47 protein (GB:AB002086) [*Arabidopsis thaliana*], mRNA sequence. | *Gossypium hirsutum* | 37,049 | Jun. 11, 1999 |
| rxa02777 | 1230 | GB_HTG3:AC009407 | 207973 | AC009407 | *Homo sapiens* clone NH0223I10, *SEQUENCING IN PROGRESS*, 16 unordered pieces. | *Homo sapiens* | 39,784 | Aug. 21, 1999 |
| | | GB_HTG3:AC009407 | 207973 | AC009407 | *Homo sapiens* clone NH0223I10, *SEQUENCING IN PROGRESS*, 16 unordered pieces. | *Homo sapiens* | 39,784 | Aug. 21, 1999 |
| | | GB_BA2:AE001137 | 44380 | AE001137 | *Borrelia burgdorferi* (section 23 of 70) of the complete genome. | *Borrelia burgdorferi* | 39,105 | Dec. 15, 1997 |
| rxa02778 | 348 | GB_EST37:AI940900 | 668 | AI940900 | sb79d08.y1 Gm-c1010 *Glycine max* cDNA clone GENOME SYSTEMS CLONE ID:Gm-c1010-1192 5′ similar to SW:ITRA_SOYBN P01070 TRYPSIN INHIBITORS A AND C PRECURSOR; mRNA sequence. | *Glycine max* | 35,036 | Aug. 3, 1999 |
| | | GB_HTG4:AC008940 | 131864 | AC008940 | *Homo sapiens* chromosome 5 clone CITB-H1_2319M24, **SEQUENCING IN PROGRESS*, 3 ordered pieces. | *Homo sapiens* | 33,043 | Oct. 31, 1999 |
| | | GB_HTG4:AC008940 | 131864 | AC008940 | *Homo sapiens* chromosome 5 clone CITB-H1_2319M24, **SEQUENCING IN PROGRESS*, 3 ordered pieces. | *Homo sapiens* | 33,043 | Oct. 31, 1999 |
| rxa02779 | 402 | GB_PR1:AB020876 | 100000 | AB020876 | *Homo sapiens* genomic DNA of 9q32 anti-oncogene of flat epitherium cancer, segment 8/10. | *Homo sapiens* | 35,000 | May 21, 1999 |
| | | GB_EST26:AI339126 | 415 | AI339126 | qt06d03.x1 NCI_CGAP_GC4 *Homo sapiens* cDNA clone IMAGE:1946789 3′ similar to gb:L25444 60S RIBOSOMAL PROTEIN L35A (HUMAN), mRNA sequence. | *Homo sapiens* | 35,876 | Dec. 29, 1998 |
| | | GB_PR1:AB020876 | 100000 | AB020876 | *Homo sapiens* genomic DNA of 9q32 anti-oncogene of flat epitherium cancer, segment 8/10. | *Homo sapiens* | 35,678 | May 21, 1999 |
| rxa02780 | 450 | GB_GSS14:AQ524732 | 591 | AQ524732 | HS_5238_A1_D09_SP6E RPCI-11 Human Male BAC Library *Homo sapiens* genomic clone Plate = 812 Col = 17 Row = G, genomic survey sequence. | *Homo sapiens* | 39,726 | May 11, 1999 |
| | | GB_PR4:AC006051 | 38903 | AC006051 | *Homo sapiens* 12p13.3 PAC RPCI5-1103G8 (Roswell Park Cancer Institute Human PAC Library) complete sequence. | *Homo sapiens* | 35,068 | Nov. 26, 1998 |
| | | GB_PR4:AC006051 | 38903 | AC006051 | *Homo sapiens* 12p13.3 PAC RPCI5-1103G8 (Roswell Park Cancer Institute Human PAC Library) complete sequence. | *Homo sapiens* | 37,273 | Nov. 26, 1998 |
| rxa02781 | 1314 | GB_VI:BHV1CGEN | 135301 | AJ004801 | Bovine herpesvirus 1 complete genome. | Bovine herpesvirus type 1.1 | 41,053 | Jan. 11, 1999 |
| | | GB_BA1:SHGCPIR | 107379 | X86780 | *S. hygroscopicus* gene cluster for polyketide immunosuppressant rapamycin. | *Streptomyces hygroscopicus* | 40,551 | Aug. 16, 1996 |
| | | GB_BA1:SHGCPIR | 107379 | X86780 | *S. hygroscopicus* gene cluster for polyketide immunosuppressant rapamycin. | *Streptomyces hygroscopicus* | 39,598 | Aug. 16, 1996 |
| rxa02782 | 1422 | GB_IN1:DSV28T23 | 5218 | X60176 | *D. silvestris* clone U28T2 non-LTR retrotransposon DNA (5218 bp). | *Drosophila silvestris* | 38,695 | Mar. 25, 1992 |
| | | GB_IN1:DSV28T24 | 7779 | X60177 | *D. silvestris* clone U28T2 non-LTR retrotransposon DNA (7779 bp). | *Drosophila silvestris* | 38,844 | Nov. 30, 1993 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02783 | 672 | GB_BA2:MPU34795 | 24888 | U34795 | *Mycoplasma pneumoniae* cosmid pcos MPGT9 25kb EcoRi fragment. | *Mycoplasma pneumoniae* | 37,832 | Mar. 6, 1996 |
| | | GB_EST2:R13483 | 481 | R13483 | yf77g03.r1 Soares infant brain 1NIB *Homo sapiens* cDNA clone IMAGE:28494 5′, mRNA sequence. | *Homo sapiens* | 36,243 | Apr. 12, 1995 |
| | | GB_HTG3:AC011333 | 159160 | AC011333 | *Homo sapiens* chromosome 5 clone CIT-HSPC_229L21, *SEQUENCING IN PROGRESS*, 23 unordered pieces. | *Homo sapiens* | 38,246 | Oct. 6, 1999 |
| | | GB_HTG3:AC011333 | 159160 | AC011333 | *Homo sapiens* chromosome 5 clone CIT-HSPC_229L21, *SEQUENCING IN PROGRESS*, 23 unordered pieces. | *Homo sapiens* | 38,246 | Oct. 6, 1999 |
| rxa02734 | 309 | GB_PR3:HS474A14 | 107352 | AL023285 | Human DNA sequence from clone 474A14 on chromosome 1q24.1-25.2 Contains EST, CA repeat 5′ UTR (tenascin-R), GSS, complete sequence. | *Homo sapiens* | 37,868 | Nov. 23, 1999 |
| | | GB_GSS12:AQ374565 | 441 | AQ374565 | RPCI11-159P12.TV RPCI-11 *Homo sapiens* genomic clone RPCI-11-159P12, genomic survey sequence. | *Homo sapiens* | 36,522 | May 20, 1999 |
| | | GB_GSS5:AQ780184 | 688 | AQ780184 | HS_3138_B1_F11_MR CIT Approved Human Genomic Sperm Library D *Homo sapiens* genomic clone Plate = 3138 Col = 21 Row = L, genomic survey sequence. | *Homo sapiens* | 44,186 | Aug. 2, 1999 |
| rxa02786 | 830 | GB_PL1:SCYBL033C | 1794 | Z35794 | *S. cerevisiae* chromosome II reading frame ORF YBL033c. | *Saccharomyces cerevisiae* | 39,264 | Mar. 11, 1998 |
| | | GB_PL1:ECRIB1GN | 1747 | Z21617 | *S. cerevisiae* RIB1 gene encoding GTP cyclohydrolase II. | *Saccharomyces cerevisiae* | 37,118 | Jan. 28, 1995 |
| | | GB_PAT:A38763 | 1747 | A38763 | Sequence 1 from Patent WO9411515. | *Saccharomyces cerevisiae* | 37,118 | Mar. 5, 1997 |
| rxa02789 | 669 | GB_EST34:AV146372 | 295 | AV146372 | AV146372 *Mus musculus* C57BL/6J 10-11 day embryo *Mus musculus* cDNA clone 2810453K19, mRNA sequence. | *Mus musculus* | 65,432 | Jul. 3, 1999 |
| | | GB_GSS5:AQ785226 | 524 | AQ785226 | HS_2025_B2_A07_T7C CIT Approved Human Genomic Sperm Library D *Homo sapiens* genomic clone Plate = 2025 Col = 14 Row = B, genomic survey sequence. | *Homo sapiens* | 40,342 | Aug. 3, 1999 |
| | | GB_BA1:SCE94 | 38532 | AL049628 | *Streptomyces coelicolor* cosmid E94. | *Streptomyces coelicolor* | 35,346 | Apr. 12, 1999 |
| rxa02793 | 825 | GB_HTG2:AC006514 | 247029 | AC006514 | *Homo sapiens* clone RPCI11-656E20, *SEQUENCING IN PROGRESS*, 90 unordered pieces. | *Homo sapiens* | 33,742 | Apr. 1, 1999 |
| | | GB_HTG2:AC006514 | 247029 | AC006514 | *Homo sapiens* clone RPCI11-656E20, *SEQUENCING IN PROGRESS*, 90 unordered pieces. | *Homo sapiens* | 33,742 | Apr. 1, 1999 |
| | | GB_EST22:AI033150 | 384 | AI033150 | ow94b01.s1 Soares_fetal_liver_spleen_1NFLS_S1 *Homo sapiens* cDNA clone IMAGE:1654441 3′ similar to TR:O02711 O02711 PRO-POL-DUTPASE POLYPROTEIN; mRNA sequence. | *Homo sapiens* | 38,951 | Aug. 28, 1998 |
| rxa02796 | 672 | GB_OV:AF172144 | 1101 | AF172144 | *Xenopus laevis* potassium channel beta 2 subunit mRNA, partial cds. | *Xenopus laevis* | 40,000 | Sep. 25, 1999 |
| | | GB_HTG1:AP000572 | 84439 | AP000572 | *Homo sapiens* chromosome 11 clone P28D2 map 11q13, *SEQUENCING IN PROGRESS*, in unordered pieces. | *Homo sapiens* | 35,725 | Oct. 9, 1999 |
| | | GB_HTG1:AP000572 | 84439 | AP000572 | *Homo sapiens* chromosome 11 clone P28D2 map 11q13, *SEQUENCING IN PROGRESS*, in unordered pieces. | *Homo sapiens* | 35,725 | Oct. 9, 1999 |
| rxa02798 | 1548 | GB_EST10:AA155097 | 322 | AA155097 | mr24h12.r1 Soares mouse 3NbMS *Mus musculus* cDNA clone IMAGE:598439 5′, mRNA sequence. | *Mus musculus* | 41,195 | Feb. 16, 1997 |
| | | GB_GSS9:AQ150317 | 489 | AQ150317 | HS_3178_B1_F12_T7 CIT Approved Human Genomic Sperm Library D *Homo sapiens* genomic clone Plate = 3178 Col = 23 Row = L, genomic survey sequence. | *Homo sapiens* | 39,549 | Oct. 8, 1998 |
| rxa02799 | 396 | GB_BA2:AE001731 | 10186 | AE001731 | *Thermotoga maritima* section 43 of 136 of the complete genome. | *Thermotoga maritima* | 35,747 | Jun. 2, 1999 |
| | | GB_IN2:AF139876 | 1562 | AF139876 | *Giardia intestinalis* histone H4 gene, complete cds. | *Giardia intestinalis* | 34,848 | Oct. 2, 1999 |
| | | GB_HTG5:AC011614 | 176606 | AC011614 | *Drosophila melanogaster* chromosome X clone BACR48L05 (D1142) RPCI-98 48.L.5 map 16F-17A strain y; cn bw sp, **SEQUENCING IN PROGRESS**, 114 unordered pieces. | *Drosophila melanogaster* | 38,817 | Nov. 19, 1999 |
| | | GB_GSS10:AQ254726 | 565 | AQ254726 | EP(3)3517 *Drosophila melanogaster* EP line *Drosophila melanogaster* genomic Sequence recovered from Both 5′ and 3′ ends of P element, genomic survey sequence. | *Drosophila melanogaster* | 38,798 | Jun. 28, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02812 | | | | | | | | |
| rxa02815 | 552 | GB_BA2:PAU32853 | 1961 | U32853 | Pseudomonas aeruginosa mucC and mucD genes, complete cds. | Pseudomonas aeruginosa | 39,925 | Mar. 6, 1996 |
| | | GB_BA2:PAU49151 | 4587 | U49151 | Pseudomonas aeruginosa alternate sigma factor (algU), mucA, mucB, mucC and mucD genes, complete cds. | Pseudomonas aeruginosa | 39,925 | Mar. 13, 1996 |
| | | GB_BA2:PAU49151 | 4587 | U49151 | Pseudomonas aeruginosa alternate sigma factor (algU), mucA, mucB, and mucC and mucD genes, complete cds. | Pseudomonas aeruginosa | 35,922 | Mar. 13, 1996 |
| rxa02817 | 499 | GB_BA1:CORAIA | 4705 | L09232 | Corynebacterium glutamicum acetohydroxy acid synthase (ilvB) and (ilvN) genes, and acetohydroxy acid isomeroreductase (ilvC) gene, complete cds. | Corynebacterium glutamicum | 38,554 | Feb. 23, 1995 |
| | | GB_EST22:AI004214 | 475 | AI004214 | ot94h01.x1 Soares_total_fetus_Nb2HF8_9w Homo sapiens cDNA clone IMAGE:1624465 3′, mRNA sequence. | Homo sapiens | 51,092 | Aug. 27, 1998 |
| | | GB_EST27:AI457904 | 455 | AI457904 | tj48b08.x1 Soares_NSF_F6_9W_OT_PA_P_S1 Homo sapiens cDNA clone IMAGE:2144727 3′, mRNA sequence. | Homo sapiens | 37,381 | Apr. 13, 1999 |
| rxa02818 | 606 | GB_PL1:MZEADH1CM | 6167 | M32984 | Z. mays alcohol dehydrogenase (ADH-1 C-m allele) gene, complete cds. | Zea mays | 33,111 | Apr. 27, 1993 |
| | | GB_PL1:ZMADH1ALL | 6158 | X17556 | Z. mays DNA for Adh1-Cm allele. | Zea mays | 33,111 | Jan. 23, 1992 |
| | | GB_PL1:MZEADH1CM | 6167 | M32984 | Z. mays alcohol dehydrogenase (ADH-1 C-m allele) gene, complete cds. | Zea mays | 36,065 | Apr. 27, 1993 |
| rxa02823 | 370 | GB_PL2:AF077130 | 4392 | AF077130 | Oryza sativa receptor-like protein kinase gene, complete cds. | Oryza sativa | 33,243 | Jul. 25, 1998 |
| | | GB_HTG1:CNS00M8S | 214599 | AL079302 | Homo sapiens chromosome 14 clone R-1089B7, **SEQUENCING IN PROGRESS*, in ordered pieces. | Homo sapiens | 38,420 | Oct. 15, 1999 |
| | | GB_HTG1:CNS00M8S | 214599 | AL079302 | Homo sapiens chromosome 14 clone R-1089B7, **SEQUENCING IN PROGRESS*, in ordered pieces. | Homo sapiens | 38,420 | Oct. 15, 1999 |
| rxa02825 | 1962 | GB_PL1:ZMU17350 | 1289 | U17350 | Zea mays thiamine biosynthetic enzyme (thi1-1) mRNA, complete cds. | Zea mays | 40,710 | Apr. 12, 1998 |
| | | GB_GSS13:AQ440082 | 432 | AQ440082 | HS_5080_B1_B12_SP6E RPCI-11 Human Male BAC Library Homo sapiens genomic clone Plate = 656 Col = 23 Row = D, genomic survey sequence. | Homo sapiens | 41,121 | Mar. 31, 1999 |
| rxa02827 | 523 | GB_EST10:AA141278 | 579 | AA141278 | CK01542.3prime CK Drosophila melanogaster embryo BlueScript Drosophila melanogaster cDNA clone CK01542 3prime, mRNA sequence. | Drosophila melanogaster | 42,424 | Nov. 29, 1998 |
| | | GB_BA2:AF054624 | 6984 | AF054624 | Lactobacillus sakei transcription-repair coupling factor (mfd) gene, partial cds; L-lactate dehydrogenase (ldhL) gene, complete cds; and unknown genes. | Lactobacillus sakei | 37,241 | Jan. 12, 1999 |
| | | GB_BA2:AF023181 | 6616 | AF023181 | Listeria monocytogenes transcription-repair coupling factor (mfdL), low temperature requirement B protein (ltrB), and DivIC homolog (divL) genes, complete cds. | Listeria monocytogenes | 61,228 | Jan. 1, 1999 |
| | | GB_HTG3:AC009213 | 114735 | AC009213 | Drosophila melanogaster chromosome 3 clone BACR09F18 (D812) RPCI-98 09.F18 map 98D—98D strain y; cn bw sp, **SEQUENCING IN PROGRESS*, 109 unordered pieces. | Drosophila melanogaster | 32,427 | Aug. 23, 1999 |
| rxa02838 | 528 | GB_BA2:AE000069 | 12230 | AE000069 | Rhizobium sp. NGR234 plasmid pNGR234a, section 6 of 46 of the complete plasmid sequence. | Rhizobium sp. NGR234 | 57,803 | Dec. 12, 1997 |
| | | GB_OM:SSU19994 | 2004 | U19994 | Sus scrofa p55 TNF receptor mRNA, complete cds. | Sus scrofa | 34,848 | Jan. 30, 1996 |
| | | GB_BA2:AE000069 | 12230 | AE000069 | Rhizobium sp. NGR234 plasmid pNGR234a, section 6 of 46 of the complete plasmid sequence. | Rhizobium sp. NGR234 | 36,505 | Dec. 12, 1997 |
| rxa02840 | 273 | GB_BA2:ECU73857 | 128824 | U73857 | Escherichia coli chromosome minutes 6–8. | Escherichia coli | 100,000 | Jul. 14, 1999 |
| | | GB_BA2:AE000145 | 11448 | AE000145 | Escherichia coli K-12 MG1655 section 35 of 400 of the complete genome. | Escherichia coli | 100,000 | Nov. 12, 1998 |
| | | GB_BA1:ECORFABC | 3044 | X76979 | E. coli orf302, 0rf303 and orf101 sequence. | Escherichia coli | 40,672 | Aug. 28, 1996 |
| rxa02841 | 558 | GB_GSS4:AQ724171 | 407 | AQ724171 | HS_5380_B1_H09_SP6E RPCI-11 Human Male BAC Library Homo sapiens genomic clone Plate = 956 Col = 17 Row = P, genomic survey sequence. | Homo sapiens | 35,135 | Jul. 14, 1999 |
| | | GB_PL1:PSFERR | 1023 | X64417 | P. sativum mRNA for ferritin. | Pisum sativum | 41,985 | Jun. 30, 1993 |
| | | GB_PL1:PSFERRI | 1023 | X73369 | P. sativum mRNA for ferritin. | Pisum sativum | 41,985 | Jul. 21, 1995 |
| rxa02842 | 365 | GB_EST32:AI723928 | 435 | AI723928 | RHIZ1_35_B10.y1_A001 Rhizome1 Sorghum halepense cDNA, mRNA sequence. | Sorghum halepense | 32,616 | Jun. 11, 1999 |
| | | GB_PR2:HS212A2 | 212753 | Z95114 | Human DNA sequence from clone 212A2 on chromosome 22q12. Contains gene for TNF-inducible protein CG12-1, 3′ end of a gene similar to apolipoprotein L, ESTs, STSs, CA repeat, GSSs and CpG islands, complete sequence. | Homo sapiens | 38,279 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_OV:AF116856 | 4634 | AF116856 | Gallus gallus neurocan core protein precursor, mRNA, complete cds. | Gallus gallus | 41,176 | May 20, 1999 |
| rxa02845 | 615 | GB_PR3:AC005934 | 43699 | AC005934 | Homo sapiens chromosome 19, cosmid R30813, complete sequence. | Homo sapiens | 35,225 | Nov. 5, 1998 |
| | | GB_PR3:AC005340 | 36705 | AC005340 | Homo sapiens chromosome 19, cosmid F19544, complete sequence. | Homo sapiens | 35,225 | Jul. 30, 1998 |
| | | GB_PR3:AC005934 | 43699 | AC005934 | Homo sapiens chromosome 19, cosmid R30813, complete sequence. | Homo sapiens | 39,153 | Nov. 5, 1998 |
| rxa02846 | 873 | GB_GSS5:AQ749564 | 838 | AQ749564 | HS_5575_A1_B11_SP6 RPCI-11 Human Male BAC Library Homo sapiens genomic clone Plate = 1151 Col = 21 Row = C, genomic survey sequence. | Homo sapiens | 36,286 | Jul. 19, 1999 |
| | | GB_GSS5:AQ749564 | 838 | AQ749564 | HS_5575_A1_B11_SP6 RPCI-11 Human Male BAC Library Homo sapiens genomic clone Plate = 1151 Col = 21 Row = C, genomic survey sequence. | Homo sapiens | 38,591 | Jul. 19, 1999 |
| rxa02847 | 1135 | GB_BA1:MSGB13GS | 42923 | L78823 | Mycobacterium leprae cosmid B13 DNA sequence. | Mycobacterium leprae | 47,559 | Jun. 15, 1996 |
| | | GB_HTG4:AC009557 | 128590 | AC009557 | Homo sapiens chromosome 15 clone 76_D_16 map 15, LOW-PASS SEQUENCE SAMPLING. | Homo sapiens | 36,289 | Oct. 25, 1999 |
| | | GB_HTG4:AC009557 | 128590 | AC009557 | Homo sapiens chromosome 15 clone 76_D_16 map 15, LOW-PASS SEQUENCE SAMPLING. | Homo sapiens | 36,289 | Oct. 25, 1999 |
| rxa02848 | 499 | GB_BA1:AB018531 | 4961 | AB018531 | Corynebacterium glutamicum dtsR1 and dtsR2 genes, complete cds. | Corynebacterium glutamicum | 98,397 | Oct. 19, 1998 |
| | | GB_PAT:E17019 | 4961 | E17019 | Brevibacterium lactofermentum dtsR and dtsR2 genes. | Corynebacterium glutamicum | 98,397 | Jul. 28, 1999 |
| rxa02849 | 305 | GB_OM:CFU8596 | 1780 | U08596 | Canis familiaris delayed rectifier K+ channel mRNA, partial cds. | Canis familiaris | 43,265 | Dec. 21, 1994 |
| | | GB_VI:AF121950 | 9395 | AF121950 | Hepatitis G virus strain iowan, complete genome. | Hepatitis G virus | 33,110 | May 24, 1999 |
| | | GB_PAT:AR049304 | 9327 | AR049304 | Sequence 234 from U.S. Pat. No. 5824507. | Unknown. | 31,803 | Sep. 29, 1999 |
| | | GB_PAT:AR026878 | 9327 | AR026878 | Sequence 234 from U.S. Pat. No. 5856134. | Unknown. | 31,803 | Sep. 29, 1999 |

SEQUENCE LISTING (2934 sequences)

SEQ ID NO: 1 - DNA, 1023 bp, Corynebacterium glutamicum
  CDS (101)..(1000): RXN01638
aggcatcaaacccacagcacaaccaccaggacgtgccacgatgtccatccgtggtgaaaacatcggtgttgcacagatggcaccgcataggtgatgactcatgagcacccaaacaatcaccatcacagtcctagaaaccgccaccatctttgacggccctgaaaccatctaccgctatgacctggctgccgaaggcatccttgatggatgggctcactctgctgtgctggatcaagtgaaacaaatagcaggtgaaaactggccgactgttgagatcgtggtggatggcaccgacaacgtagtcaatgcactcacctccatgtttgcttccaaaggcgtgacctgcggtggggttggagtagaagcacctcccgttgcggaggaaccaccgaaaattaaacggcccacgagtggaaaacaagtccgccagttctacggcatcaagccactacacctgttgttggtcagcatattggttggttctattgctggtatttgggtgatttcgggtttcactgggccagtggactcacggccggtagataaggtggcggagatttcaacgcagggggagacgtcgataagcaatcaaccccaaccccagcccaccgtgctcgtgaccgaggacctgcttattgaggcgccatttggttttgaaatgcgaagcgacgaacagtcgcgctacctggaaggccccgacccgaatctgcgcatccacgtgggcgtcgatccgctgcacggcgcggacgccgcgctggttgccgaagagctgcgccgcctgatcaccgaggatccttcgctggaggaaattcccgcaggggagtggggcgagaaaaccaccatcgactaccgcgaaacacccggcgatggctctcatgtgctgtgggtgacctggtttgacaccgaccgacaactcaacgttgggtgccatagcaaagccgccgaaacccttgttcacaaggcacaatgccgaaatgtgattgagcatctgacgctgaaatgatgccggtttctatccggaat

SEQ ID NO: 2 - protein, 300 aa, Corynebacterium glutamicum
MSTQTITITVLETATIFDGPETIYRYDLAAEGILDGWAHSAVLDQVKQIAGENWPTVEIVVDGTDNVVNALTSMFASKGVTCGGVGVEAPPVAEEPPKIKRPTSGKQVRQFYGIKPLHLLLVSILVGSIAGIWVISGFTGPVDSRPVDKVAEISTQGETSISNQPQPQPTVLVTEDLLIEAPFGFEMRSDEQSRYLEGPDPNLRIHVGVDPLHGADAALVAEELRRLITEDPSLEEIPAGEWGEKTTIDYRETPGDGSHVLWVTWFDTDRQLNVGCHSKAAETLVHKAQCRNVIEHLTLK

SEQ ID NO: 3 - DNA, 513 bp, Corynebacterium glutamicum
  CDS (101)..(490): FRXA01638
tttcactgggccagtggactcacggccggtagataaggtggcggagatttcaacgcagggggagacgtcgataagcaatcaaccccaaccccagcccaccgtgctcgtgaccgaggacctgcttattgaggcgccatttggttttgaaatgcgaagcgacgaacagtcgcgctacctggaaggccccgacccgaatctgcgcatccacgtgggcgtcgatccgctgcacggcgcggacgccgcgctggttgccgaagagctgcgccgcctgatcaccgaggatccttcgctggaggaaattcccgcaggggagtggggcgagaaaaccaccatcgactaccgcgaaacacccggcgatggctctcatgtgctgtgggtgacctggtttgacaccgaccgacaactcaacgttgggtgccatagcaaagccgccgaaacccttgttcacaaggcacaatgccgaaatgtgattgagcatctgacgctgaaatgatgccggtttctatccggaat

SEQ ID NO: 4 - protein, 130 aa, Corynebacterium glutamicum
VLVTEDLLIEAPFGFEMRSDEQSRYLEGPDPNLRIHVGVDPLHGADAALVAEELRRLITEDPSLEEIPAGEWGEKTTIDYRETPGDGSHVLWVTWFDTDRQLNVGCHSKAAETLVHKAQCRNVIEHLTLK

SEQ ID NO: 5 - DNA, 561 bp, Corynebacterium glutamicum
  CDS (101)..(538): FRXA01639
aggcatcaaacccacagcacaaccaccaggacgtgccacgatgtccatccgtggtgaaaacatcggtgttgcacagatggcaccgcataggtgatgactcatgagcacccaaacaatcaccatcacagtcctagaaaccgccaccatctttgacggccctgaaaccatctaccgctatgacctggctgccgaaggcatccttgatggatgggctcactctgctgtgctggatcaagtgaaacaaatagcaggtgaaaactggccgactgttgagatcgtggtggatggcaccgacaacgtagtcaatgcactcacctccatgtttgcttccaaaggcgtgacctgcggtggggttggagtagaagcacctcccgttgcggaggaaccaccgaaaattaaacggcccacgagtggaaaacaagtccgccagttctacggcatcaagccactacacctgttgttggtcagcatattggttggttctattgctggtatttggggatttcgggtttcactgggccagtggactcacggccggtagataaggtggcggagatttca

SEQ ID NO: 6 - protein, 146 aa, Corynebacterium glutamicum
MSTQTITITVLETATIFDGPETIYRYDLAAEGILDGWAHSAVLDQVKQIAGENWPTVEIVVDGTDNVVNALTSMFASKGVTCGGVGVEAPPVAEEPPKIKRPTSGKQVRQFYGIKPLHLLLVSILVGSIAGIWGFRVSLGQWTHGR

SEQ ID NO: 7 - DNA, 6470 bp, Corynebacterium glutamicum
  CDS (1)..(6447): RXN01590
tggggtcaaaaagatcactggggcaaagctccactgggtgatcacgatgctgtgcgtatctataggcaagcagaagccttgatgaaacagcgcgcagcaaacaataagggcttagacctcaatgatgaagcgacctatggcgccatcatgtttgcgtctttcgatgatgccttcgccgctgatgccgaagctcatggctgtgtacaccgaccacagttcgcgaaggtaactaggcgaaatattcttaattcaccgcaatacacggcgattaagtcatcttatgacgcgctggtgcagcaggatctcgtggcccaacagcagcaggcacaagcgctacagcaagctgcttatgagcaagagcaggcagctattttccaggcacgtgatcaagcaacattccaggctgaacaaacgctcgcgcaagagtccgttcgccaatcagagggtgtgggtttacctgtcattgatccgatggagagctatttccgggagtacgccttctatgaaggtgtcgagatgtttggtacctggggtacgcacgttgatgctggtgtgtcgcagtttagcacctctgatggccgtgcgatccgagcgcttgttgatgagcatctcgcaacctatgaaccagtagagcagcgggggagtactcaggcattcttcgcctctgtcaatgctgcctttgctgaggtggcacctcacgcagcacccatgtttagtgcgattgctcgcgagggtgagggttcaaaggggtaccaggcgctgcgtcaccgtttcgacaagatggtcggcactgcaattggacctaatggtttgcctgagggacctgatctgggtggtcgtcgtttacctatttcgccttatgatccacgctggtcagaccgcgaagtagtccgtgtgcacggtaccaagctgctatcactgtccgaagagagtgttggcatgatcagggaccttgatctagcaacgatccacctacaagataatgatgtttacgagggcactcatcgagaagacgacactaaaggcggtgtgcgaccgttgactcaatgggtcaatggtgaagctattgcctggcgcactatcaccgagaatgaccagatgcgactgcccaatattggtcagtttatgacggctaaagaataccgtgccgcagcgtcatggctgcgtgctggactcattgataccgcagatgttgcgagtcagaaaattgaccccaacaaggtcatgtctgatgagggtatcgcgcgctcggaagctattttgacgtatctgtcggatgagggtgtggattttaggatcgagccagatcgtgagccgggacagcttaaagtgcgtattgagggcacccgtattgatattcgtctcactgatactcgcgccaatgaacagtgggtgggtcgtgtctatgattctggcactgtgattaagtattccgccgaacaaacagcggaagaacgtctacgagctcgtgagcgcatggagaacggtgatggaacgtggacaccggctactgattatgaaccaagcccaactgaagttgtcgatctcgtgaaatttgctctcggtcgagaggttgagcgacaggatggcaaaggtcttgttggtgtgcctaatgctcgacacccacgtgctttagagcaggcacaggatgcatatttcactaagaatcgttccgcattcatggtgcgtgaagggctctcgatcgttcaggatgcacgtgatcgaagtgctggtcctggaaagtggtttgataatgaagcgaaagcatcggagtggcttggtaacaatatcgcccttactcgtgcgcgtgtggccgaagagctcggcgttgaagaactgattgcgctttctgcacagtacgccgatgatcctgacttcatgccggcttttgctggtgaggatgagctcatggcgataaagcaggactattgggcgatgctgcgaggtgaggaaaccgatctgcttaaccctggggttaaccgcgatgattatatggctgctatccgcgatggtgatcatgagcagattgctgcgatgacctcagcaatgaatgctgtgaccgtggaggatcgtgtgcgtcagcacgcggcccttgttcttgatgattatgtcggcacggtggagcctgatcctgttaccggcttgcgttttaatccggtgacagttgctcagcacatgccgagtgctaaatccctgtggtcaaaccatgacgatattattgccgcgttgcgagcgacttcgattactggcgatgaactgcgcggtgacgaattctataacgatgttattaatcaacagttgctcaaatttaatcctgagaccgcgcagaaaatggttaataaccctgatcttgacccgcagttggctcgatttggcactgtcattgccgagactatttcccgcaatggtgctgatgtggtcgatattgctgttgacgataacggtgtggtgcggtggaccgcacagcgacgtgttggtgcgaaggatagtcgtgcagtagatagtaaggggcaggttcgcggtgaacgcacccgtcatgtgcagggtgagataggtcagatttttactcgcggtgagcatggtgaaattgtcaccaaatttaatggtggcgagaactatatgtttgcccctggctacaccgcgtctgtggtaccacaaaagcctggtgagacaaagagtttagaagagcgtaccaagctcaaaggctatgagcaggtgatgtcagaggcgttggtgtaccgtgtgcgagaagatttgatgttcactgagcgatcccgagtgggtgctacaaccagcatcaacagtgcatataagcgactgtatgacaatcgcttccctgtggacttcttcgagcgcagcgccgaagaaggtttgagcgatgagtggcgtgctgcgttgcttgagactgcgagtttgcgtgtgcgctacgacaactctattcgtgatggtgcgaatgtgatggaggatattcgagcacagcagcgtggttttgatgcgcgtaatgataactcccgtgatgcgctggtgcttaccggtgggcgtaacatttctgtacttgatgttgatgcgggtaaaggtttctttgatcccatgatgactggtatggcggcgaaccagggttctgttcgctatttgttgccttctgcgaaggtgggcgctgatggcatgattacccctggtgatccggctgatcgagtacctgttgcagcgcatccagaatcatgggcgatgggctttgacccacatgaccgtcagaacatgactttctcgaacatcatgcaggctagcgctgtgactggtggtgcacgcactgcgatgatacagctgggcggttggaactttgaagatggcattattgtctctgccgattttgcgaatacccatgttattcgcgatacggaagatgagatgcgccccttggttgccggcgataagctgtctgattttcacggtaataagggtgtgaccgctcttgttgttgatccagcgatgagtgatgctgatgcacgtgcagcagggctggaatcagaggtggcgtttttccgagacaaccctgatctagaggttgtcatgagtccgttttctgccatttctcgttttaatggtggcacggcacgtgagctcatgaccaacccgcaggatgtggtgttcaggaataatgatggttctactcgtgttcaaccaggtgcctctggtgatctcaacttcatcgtcacgcatatggctgttgatgcgaaaaccaatgtctatgatgaagaagctgttcgtgagggccaaggacgtaaagcgtcttctcagctggcgtgggtgctccaagcccaggaatgtcatgagattatggagcacttttatggcaacaacgtctctgcattggctaacttccaggaatatcttcgcgtcacggggcttgatgtcaccccgtatggtgagttgcgcgaggggttcagcgagtccaatgagcagcgcaatatcatcgagatgccaagcatttacgatgagaacggtgagctgaataatcgtgttaatcgtgcacaggtgcgcgaagcttttgttgagcagatcagtcgcgctggtggtgttatggagattcctttccagttacagttgcgcaatggtgcacagctagaagagtcacctaataatccagacatgtatcagttgccactactgagcccgcatttgcgcagtgatgaggatttagcggacggtagtacctctcgacatgagtacaccacgcggtatatggctatttttgatacgtgctacaagctggcagaagagcaagccaagattgacgcattgcgccaggaggaagcgcagcacggcacgttgcctcgtgctgcggaaaagcgactgagcgagtcacagaagtttgttgatcaagcacagaaaaaggtgcaggcaagctttgatggaattgctaatgatattgtcgccagccggatcgagaccaagaacaatgtgttcaaggacggctttatgtcggcgcgacagtcacactccgctactgctgtgtggacaggtgatccacgcctgtcagttgatgaagtagccatgaactcttcgatggcacgtgaactcggcgttctcgataacggttatgcaatggtgtggcgtgatccggtgatccgcgatggtggtgtgcgctatttgcgtgtggttattaatgatgatctgcacggtgtggcagtcaaccctgtgtcggtgaagagctttgacggtgacttcgatggtgactctgtaggtctggtcggcaatctgccgaaaaaggcgcatgaggaggcattgtccaggctcacagttgaggcaaacatgcttgatcttggtgatggtaagcgtatggaggacggcactatgttttatgggctaactctgcatgacagcctcgatgtacaggtagcgcagcaccatgatccggcaatggccgagaacatgaaggttattgtctctgagcttaaccgctaccagcgtgaatacgaggccggcgagattagccgcgaagaattgctagaggtcaaccgtgcacacatggatgatctcaatgagcactatgcacaggcttttgccaaccgcgatggtttggtgaccttgcgttttgacggtatggaaaaccatatggcttctgttgcgcagtgcttcgagacgggtgcgaaaggttcgcctggcaagctgaaggaatatgccacctatatcggcgctgatccggcgcagggttttaaagacgtaggtcaaccaacgccagaagcgctgcgtagccactatgagggttcgcagaaggcgactgcaattaaggtgctctttaccggtgtggctggtaaaaaagagcaggaaatggtggcattgtgccgcaatcttggtctgaccaaggaagctatggctgcatcagcaccggcacagcagtcgattctgcaggcgaagcacgacccgattgacgcgctctatcgtgcagaaactcttatgggaccagtaggtgatctctaccaaggtcgcaagatgcgtcgtggtgagaatgagcaaggtcgctatgagtgggaagtcgttagggacgagaaccaccagcctatccaggccaccaaggatgaatgggtacagcagtacatggagatgtacgccgatgacaagggtatgggtgtctcggttggcgttgaccaggtggagaagatcgcggaagaattctctgatgagcagggttatatgcgtgtgcttagccatgatgagctacccactgagattaagccactagcacttgatcagcttgcctatggcgataagaagaaccgctttgatttgttgtgcgagatggcaaagcagcaggtcaacatctacgacggtgatgcttatgactttgcccctcgtgtggtgcgcgccaatatgaaggcaatggaggatgcagcgcgttttggtatccctgatgtggagattcagtcgatttctgcacagcagtcattggcgagctttgagcgagtcccacaacgttctggtttccgtattgagcgtcgtgtgccggcagaagtaggtacagggattgctgcaccagcaccgttacctgatgcaggtgtacaggggaattatgttcagcagcaggtgcctgcgaccccgccagttatgcctgtcacacctccggcacagcaacctgtttcgcctgctcagacggacttccggggcgttggtcagccactcgaccagggcggaaaaatcgggaattatggacatcagggacctgcaatgggggcgcaacagccagttgtgcctcagcagcagaatattccgcctgtgcataatccggtaccacagaattctgttccgcctactccggttgtgccgaagccaggtacaggaaacccgtttactcatggtggtgcgaacaatcagtttatgggtcgatttgatacaagccgttacaaccaacaggaaccaccacaacgacaggatggcgggtttgagctctaaataatggcagtagatttcag

SEQ ID NO: 8 - protein, 2149 aa, Corynebacterium glutamicum
WGQKDHWGKAPLGDHDAVRIYRQAEALMKQRAANNKGLDLNDEATYGAIMFASFDDAFAADAEAHGCVHRPQFAKVTRRNILNSPQYTAIKSSYDALVQQDLVAQQQQAQALQQAAYEQEQAAIFQARDQATFQAEQTLAQESVRQSEGVGLPVIDPMESYFREYAFYEGVEMFGTWGTHVDAGVSQFSTSDGRAIRALVDEHLATYEPVEQRGSTQAFFASVNAAFAEVAPHAAPMFSAIAREGEGSKGYQALRHRFDKMVGTAIGPNGLPEGPDLGGRRLPISPYDPRWSDREVVRVHGTKLLSLSEESVGMIRDLDLATIHLQDNDVYEGTHREDDTKGGVRPLTQWVNGEAIAWRTITENDQMRLPNIGQFMTAKEYRAAASWLRAGLIDTADVASQKIDPNKVMSDEGIARSEAILTYLSDEGVDFRIEPDREPGQLKVRIEGTRIDIRLTDTRANEQWVGRVYDSGTVIKYSAEQTAEERLRARERMENGDGTWTPATDYEPSPTEVVDLVKFALGREVERQDGKGLVGVPNARHPRALEQAQDAYFTKNRSAFMVREGLSIVQDARDRSAGPGKWFDNEAKASEWLGNNIALTRARVAEELGVEELIALSAQYADDPDFMPAFAGEDELMAIKQDYWAMLRGEETDLLNPGVNRDDYMAAIRDGDHEQIAAMTSAMNAVTVEDRVRQHAALVLDDYVGTVEPDPVTGLRFNPVTVAQHMPSAKSLWSNHDDIIAALRATSITGDELRGDEFYNDVINQQLLKFNPETAQKMVNNPDLDPQLARFGTVIAETISRNGADVVDIAVDDNGVVRWTAQRRVGAKDSRAVDSKGQVRGERTRHVQGEIGQIFTRGEHGEIVTKFNGGENYMFAPGYTASVVPQKPGETKSLEERTKLKGYEQVMSEALVYRVREDLMFTERSRVGATTSINSAYKRLYDNRFPVDFFERSAEEGLSDEWRAALLETASLRVRYDNSIRDGANVMEDIRAQQRGFDARNDNSRDALVLTGGRNISVLDVDAGKGFFDPMMTGMAANQGSVRYLLPSAKVGADGMITPGDPADRVPVAAHPESWAMGFDPHDRQNMTFSNIMQASAVTGGARTAMIQLGGWNFEDGIIVSADFANTHVIRDTEDEMRPLVAGDKLSDFHGNKGVTALVVDPAMSDADARAAGLESEVAFFRDNPDLEVVMSPFSAISRFNGGTARELMTNPQDVVFRNNDGSTRVQPGASGDLNFIVTHMAVDAKTNVYDEEAVREGQGRKASSQLAWVLQAQECHEIMEHFYGNNVSALANFQEYLRVTGLDVTPYGELREGFSESNEQRNIIEMPSIYDENGELNNRVNRAQVREAFVEQISRAGGVMEIPFQLQLRNGAQLEESPNNPDMYQLPLLSPHLRSDEDLADGSTSRHEYTTRYMAIFDTCYKLAEEQAKIDALRQEEAQHGTLPRAAEKRLSESQKFVDQAQKKVQASFDGIANDIVASRIETKNNVFKDGFMSARQSHSATAVWTGDPRLSVDEVAMNSSMARELGVLDNGYAMVWRDPVIRDGGVRYLRVVINDDLHGVAVNPVSVKSFDGDFDGDSVGLVGNLPKKAHEEALSRLTVEANMLDLGDGKRMEDGTMFYGLTLHDSLDVQVAQHHDPAMAENMKVIVSELNRYQREYEAGEISREELLEVNRAHMDDLNEHYAQAFANRDGLVTLRFDGMENHMASVAQCFETGAKGSPGKLKEYATYIGADPAQGFKDVGQPTPEALRSHYEGSQKATAIKVLFTGVAGKKEQEMVALCRNLGLTKEAMAASAPAQQSILQAKHDPIDALYRAETLMGPVGDLYQGRKMRRGENEQGRYEWEVVRDENHQPIQATKDEWVQQYMEMYADDKGMGVSVGVDQVEKIAEEFSDEQGYMRVLSHDELPTEIKPLALDQLAYGDKKNRFDLLCEMAKQQVNIYDGDAYDFAPRVVRANMKAMEDAARFGIPDVEIQSISAQQSLASFERVPQRSGFRIERRVPAEVGTGIAAPAPLPDAGVQGNYVQQQVPATPPVMPVTPPAQQPVSPAQTDFRGVGQPLDQGGKIGNYGHQGPAMGAQQPVVPQQQNIPPVHNPVPQNSVPPTPVVPKPGTGNPFTHGGANNQFMGRFDTSRYNQQEPPQRQDGGFEL

SEQ ID NO: 9 - DNA, 1307 bp, Corynebacterium glutamicum
  CDS (1)..(1284): FRXA01590
ggcaagttgaaggaatatgccacctatatcggcgctgatccggcgcagggttttaaagacgtaggtcaaccaacgccagaagcgctgcgtagccactatgagggttcgcagaaggcgactgcaattaaggtgctctttaccggtgtggctggtaaaaaagagcaggaaatggtggcattgtgccgcaatcttggtctgaccaaggaagctatggctgcatcagcaccggcacagcagtcgattctgcaggcgaagcacgacccgattgacgcgctctatcgtgcagaaactcttatgggaccagtaggtgatctctaccaaggtcgcaagatgcgtcgtggtgagaatgagcaaggtcgctatgagtgggaagtcgttagggacgagaaccaccagcctatccaggccaccaaggatgaatgggtacagcagtacatggagatgtacgccgatgacaagggtatgggtgtctcggttggcgttgaccaggtggagaagatcgcggaagaattctctgatgagcagggttatatgcgtgtgcttagccatgatgagctacccactgagattaagccactagcacttgatcagcttgcctatggcgataagaagaaccgctttgatttgttgtgcgagatggcaaagcagcaggtcaacatctacgacggtgatgcttatgactttgcccctcgtgtggtgcgcgccaatatgaaggcaatggaggatgcagcgcgttttggtatccctgatgtggagattcagtcgatttctgcacagcagtcattggcgagctttgagcgagtcccacaacgttctggtttccgtattgagcgtcgtgtgccggcagaagtaggtacagggattgctgcaccagcaccgttacctgatgcaggtgtacaggggaattatgttcagcagcaggtgcctgcgaccccgccagttatgcctgtcacacctccggcacagcaacctgtttcgcctgctcagacggacttccggggcgttggtcagccactcgaccagggcggaaaaatcgggaattatggacatcagggacctgcaatgggggcgcaacagccagttgtgcctcagcagcagaatattccgcctgtgcataatccggtaccacagaattctgttccgcctactccggttgtgccgaagccaggtacaggaaacccgtttactcatggtggtgcgaacaatcagtttatgggtcgatttgatacaagccgttacaaccaacaggaaccaccacaacgacaggatggcgggtttgagctctaaataatggcagtagatttcag

SEQ ID NO: 10 - protein, 428 aa, Corynebacterium glutamicum
GKLKEYATYIGADPAQGFKDVGQPTPEALRSHYEGSQKATAIKVLFTGVAGKKEQEMVALCRNLGLTKEAMAASAPAQQSILQAKHDPIDALYRAETLMGPVGDLYQGRKMRRGENEQGRYEWEVVRDENHQPIQATKDEWVQQYMEMYADDKGMGVSVGVDQVEKIAEEFSDEQGYMRVLSHDELPTEIKPLALDQLAYGDKKNRFDLLCEMAKQQVNIYDGDAYDFAPRVVRANMKAMEDAARFGIPDVEIQSISAQQSLASFERVPQRSGFRIERRVPAEVGTGIAAPAPLPDAGVQGNYVQQQVPATPPVMPVTPPAQQPVSPAQTDFRGVGQPLDQGGKIGNYGHQGPAMGAQQPVVPQQQNIPPVHNPVPQNSVPPTPVVPKPGTGNPFTHGGANNQFMGRFDTSRYNQQEPPQRQDGGFEL

SEQ ID NO: 11 - DNA, 5061 bp, Corynebacterium glutamicum
  CDS (1)..(5061): FRXA01542
tggggtcaaaaagatcactggggcaaagctccactgggtgatcacgatgctgtgcgtatctataggcaagcagaagccttgatgaaacagcgcgcagcaaacaataagggcttagacctcaatgatgaagcgacctatggcgccatcatgtttgcgtctttcgatgatgccttcgccgctgatgccgaagctcatggctgtgtacaccgaccacagttcgcgaaggtaactaggcgaaatattcttaattcaccgcaatacacggcgattaagtcatcttatgacgcgctggtgcagcaggatctcgtggcccaacagcagcaggcacaagcgctacagcaagctgcttatgagcaagagcaggcagctattttccaggcacgtgatcaagcaacattccaggctgaacaaacgctcgcgcaagagtccgttcgccaatcagagggtgtgggtttacctgtcattgatccgatggagagctatttccgggagtacgccttctatgaaggtgtcgagatgtttggtacctggggtacgcacgttgatgctggtgtgtcgcagtttagcacctctgatggccgtgcgatccgagcgcttgttgatgagcatctcgcaacctatgaaccagtagagcagcgggggagtactcaggcattcttcgcctctgtcaatgctgcctttgctgaggtggcacctcacgcagcacccatgtttagtgcgattgctcgcgagggtgagggttcaaaggggtaccaggcgctgcgtcaccgtttcgacaagatggtcggcactgcaattggacctaatggtttgcctgagggacctgatctgggtggtcgtcgtttacctatttcgccttatgatccacgctggtcagaccgcgaagtagtccgtgtgcacggtaccaagctgctatcactgtccgaagagagtgttggcatgatcagggaccttgatctagcaacgatccacctacaagataatgatgtttacgagggcactcatcgagaagacgacactaaaggcggtgtgcgaccgttgactcaatgggtcaatggtgaagctattgcctggcgcactatcaccgagaatgaccagatgcgactgcccaatattggtcagtttatgacggctaaagaataccgtgccgcagcgtcatggctgcgtgctggactcattgataccgcagatgttgcgagtcagaaaattgaccccaacaaggtcatgtctgatgagggtatcgcgcgctcggaagctattttgacgtatctgtcggatgagggtgtggattttaggatcgagccagatcgtgagccgggacagcttaaagtgcgtattgagggcacccgtattgatattcgtctcactgatactcgcgccaatgaacagtgggtgggtcgtgtctatgattctggcactgtgattaagtattccgccgaacaaacagcggaagaacgtctacgagctcgtgagcgcatggagaacggtgatggaacgtggacaccggctactgattatgaaccaagcccaactgaagttgtcgatctcgtgaaatttgctctcggtcgagaggttgagcgacaggatggcaaaggtcttgttggtgtgcctaatgctcgacacccacgtgctttagagcaggcacaggatgcatatttcactaagaatcgttccgcattcatggtgcgtgaagggctctcgatcgttcaggatgcacgtgatcgaagtgctggtcctggaaagtggtttgataatgaagcgaaagcatcggagtggcttggtaacaatatcgcccttactcgtgcgcgtgtggccgaagagctcggcgttgaagaactgattgcgctttctgcacagtacgccgatgatcctgacttcatgccggcttttgctggtgaggatgagctcatggcgataaagcaggactattgggcgatgctgcgaggtgaggaaaccgatctgcttaaccctggggttaaccgcgatgattatatggctgctatccgcgatggtgatcatgagcagattgctgcgatgacctcagcaatgaatgctgtgaccgtggaggatcgtgtgcgtcagcacgcggcccttgttcttgatgattatgtcggcacggtggagcctgatcctgttaccggcttgcgttttaatccggtgacagttgctcagcacatgccgagtgctaaatccctgtggtcaaaccatgacgatattattgccgcgttgcgagcgacttcgattactggcgatgaactgcgcggtgacgaattctataacgatgttattaatcaacagttgctcaaatttaatcctgagaccgcgcagaaaatggttaataaccctgatcttgacccgcagttggctcgatttggcactgtcattgccgagactatttcccgcaatggtgctgatgtggtcgatattgctgttgacgataacggtgtggtgcggtggaccgcacagcgacgtgttggtgcgaaggatagtcgtgcagtagatagtaaggggcaggttcgcggtgaacgcacccgtcatgtgcagggtgagataggtcagatttttactcgcggtgagcatggtgaaattgtcaccaaatttaatggtggcgagaactatatgtttgcccctggctacaccgcgtctgtggtaccacaaaagcctggtgagacaaagagtttagaagagcgtaccaagctcaaaggctatgagcaggtgatgtcagaggcgttggtgtaccgtgtgcgagaagatttgatgttcactgagcgatcccgagtgggtgctacaaccagcatcaacagtgcatataagcgactgtatgacaatcgcttccctgtggacttcttcgagcgcagcgccgaagaaggtttgagcgatgagtggcgtgctgcgttgcttgagactgcgagtttgcgtgtgcgctacgacaactctattcgtgatggtgcgaatgtgatggaggatattcgagcacagcagcgtggttttgatgcgcgtaatgataactcccgtgatgcgctggtgcttaccggtgggcgtaacatttctgtacttgatgttgatgcgggtaaaggtttctttgatcccatgatgactggtatggcggcgaaccagggttctgttcgctatttgttgccttctgcgaaggtgggcgctgatggcatgattacccctggtgatccggctgatcgagtacctgttgcagcgcatccagaatcatgggcgatgggctttgacccacatgaccgtcagaacatgactttctcgaacatcatgcaggctagcgctgtgactggtggtgcacgcactgcgatgatacagctgggcggttggaactttgaagatggcattattgtctctgccgattttgcgaatacccatgttattcgcgatacggaagatgagatgcgccccttggttgccggcgataagctgtctgattttcacggtaataagggtgtgaccgctcttgttgttgatccagcgatgagtgatgctgatgcacgtgcagcagggctggaatcagaggtggcgtttttccgagacaaccctgatctagaggttgtcatgagtccgttttctgccatttctcgttttaatggtggcacggcacgtgagctcatgaccaacccgcaggatgtggtgttcaggaataatgatggttctactcgtgttcaaccaggtgcctctggtgatctcaacttcatcgtcacgcatatggctgttgatgcgaaaaccaatgtctatgatgaagaagctgttcgtgagggccaaggacgtaaagcgtcttctcagctggcgtgggtgctccaagcccaggaatgtcatgagattatggagcacttttatggcaacaacgtctctgcattggctaacttccaggaatatcttcgcgtcacggggcttgatgtcaccccgtatggtgagttgcgcgaggggttcagcgagtccaatgagcagcgcaatatcatcgagatgccaagcatttacgatgagaacggtgagctgaataatcgtgttaatcgtgcacaggtgcgcgaagcttttgttgagcagatcagtcgcgctggtggtgttatggagattcctttccagttacagttgcgcaatggtgcacagctagaagagtcacctaataatccagacatgtatcagttgccactactgagcccgcatttgcgcagtgatgaggatttagcggacggtagtacctctcgacatgagtacaccacgcggtatatggctatttttgatacgtgctacaagctggcagaagagcaagccaagattgacgcattgcgccaggaggaagcgcagcacggcacgttgcctcgtgctgcggaaaagcgactgagcgagtcacagaagtttgttgatcaagcacagaaaaaggtgcaggcaagctttgatggaattgctaatgatattgtcgccagccggatcgagaccaagaacaatgtgttcaaggacggctttatgtcggcgcgacagtcacactccgctactgctgtgtggacaggtgatccacgcctgtcagttgatgaagtagccatgaactcttcgatggcacgtgaactcggcgttctcgataacggttatgcaatggtgtggcgtgatccggtgatccgcgatggtggtgtgcgctatttgcgtgtggttattaatgatgatctgcacggtgtggcagtcaaccctgtgtcggtgaagagctttgacggtgacttcgatggtgactctgtaggtctggtcggcaatctgccgaaaaaggcgcatgaggaggcattgtccaggctcacagttgaggcaaacatgcttgatcttggtgatggtaagcgtatggaggacggcactatgttttatgggctaactctgcatgacagcctcgatgtacaggtagcgcagcaccatgatccggcaatggccgagaacatgaaggttattgtctctgagcttaaccgctaccagcgtgaatacgaggccggcgagattagccgcgaagaattgctagaggtcaaccgtgcacacatggatgatctcaatgagcactatgcacaggct

SEQ ID NO: 12 - protein, 1687 aa, Corynebacterium glutamicum
WGQKDHWGKAPLGDHDAVRIYRQAEALMKQRAANNKGLDLNDEATYGAIMFASFDDAFAADAEAHGCVHRPQFAKVTRRNILNSPQYTAIKSSYDALVQQDLVAQQQQAQALQQAAYEQEQAAIFQARDQATFQAEQTLAQESVRQSEGVGLPVIDPMESYFREYAFYEGVEMFGTWGTHVDAGVSQFSTSDGRAIRALVDEHLATYEPVEQRGSTQAFFASVNAAFAEVAPHAAPMFSAIAREGEGSKGYQALRHRFDKMVGTAIGPNGLPEGPDLGGRRLPISPYDPRWSDREVVRVHGTKLLSLSEESVGMIRDLDLATIHLQDNDVYEGTHREDDTKGGVRPLTQWVNGEAIAWRTITENDQMRLPNIGQFMTAKEYRAAASWLRAGLIDTADVASQKIDPNKVMSDEGIARSEAILTYLSDEGVDFRIEPDREPGQLKVRIEGTRIDIRLTDTRANEQWVGRVYDSGTVIKYSAEQTAEERLRARERMENGDGTWTPATDYEPSPTEVVDLVKFALGREVERQDGKGLVGVPNARHPRALEQAQDAYFTKNRSAFMVREGLSIVQDARDRSAGPGKWFDNEAKASEWLGNNIALTRARVAEELGVEELIALSAQYADDPDFMPAFAGEDELMAIKQDYWAMLRGEETDLLNPGVNRDDYMAAIRDGDHEQIAAMTSAMNAVTVEDRVRQHAALVLDDYVGTVEPDPVTGLRFNPVTVAQHMPSAKSLWSNHDDIIAALRATSITGDELRGDEFYNDVINQQLLKFNPETAQKMVNNPDLDPQLARFGTVIAETISRNGADVVDIAVDDNGVVRWTAQRRVGAKDSRAVDSKGQVRGERTRHVQGEIGQIFTRGEHGEIVTKFNGGENYMFAPGYTASVVPQKPGETKSLEERTKLKGYEQVMSEALVYRVREDLMFTERSRVGATTSINSAYKRLYDNRFPVDFFERSAEEGLSDEWRAALLETASLRVRYDNSIRDGANVMEDIRAQQRGFDARNDNSRDALVLTGGRNISVLDVDAGKGFFDPMMTGMAANQGSVRYLLPSAKVGADGMITPGDPADRVPVAAHPESWAMGFDPHDRQNMTFSNIMQASAVTGGARTAMIQLGGWNFEDGIIVSADFANTHVIRDTEDEMRPLVAGDKLSDFHGNKGVTALVVDPAMSDADARAAGLESEVAFFRDNPDLEVVMSPFSAISRFNGGTARELMTNPQDVVFRNNDGSTRVQPGASGDLNFIVTHMAVDAKTNVYDEEAVREGQGRKASSQLAWVLQAQECHEIMEHFYGNNVSALANFQEYLRVTGLDVTPYGELREGFSESNEQRNIIEMPSIYDENGELNNRVNRAQVREAFVEQISRAGGVMEIPFQLQLRNGAQLEESPNNPDMYQLPLLSPHLRSDEDLADGSTSRHEYTTRYMAIFDTCYKLAEEQAKIDALRQEEAQHGTLPRAAEKRLSESQKFVDQAQKKVQASFDGIANDIVASRIETKNNVFKDGFMSARQSHSATAVWTGDPRLSVDEVAMNSSMARELGVLDNGYAMVWRDPVIRDGGVRYLRVVINDDLHGVAVNPVSVKSFDGDFDGDSVGLVGNLPKKAHEEALSRLTVEANMLDLGDGKRMEDGTMFYGLTLHDSLDVQVAQHHDPAMAENMKVIVSELNRYQREYEAGEISREELLEVNRAHMDDLNEHYAQA

SEQ ID NO: 13 - DNA, 2289 bp, Corynebacterium glutamicum
  CDS (101)..(2266): RXN01539
gaacagcacggttgggtgccgcagaattgttgcgtcgttttgaacgcacaggtgcagcagctcagaataatcagtttgacgatatggacttttaaggagtgtggtgacagtggctgggaatgagaagaataagatacgagaagagcgggtggctcggcgtgcccaggcagtcgtagaggcggagattagtcttgctgcacaagcaagtgagcaggtgcgtgaacaagcagaggcgcctgatgtaaatgaacaggtagaagaggttagtgtcgaggtatcttctgtccagtcattaacccagcctaagacgttggggcagctgcatgacccaaggaaaaatgtcatgagtagcagcgacttggcttctattattggtgtagagcaacagcctgttgcttatggtgagtctgaggaaccagaaacactgcgtgatgtgttgcctcggcgaaagcttcacccatctgagataacaccgagttatgaggttgctgatggtgaacagcgcagcatttttggtgaatcagctccgtctgattttgatgacctcagtgatgtcgaagaatttgataccagtcattgggtgcgtgctggacaagatgatcgtagtgatgatgatcgactcgctgatgaggctggtgtaccgcgtagtggcgcacaagatgtagctgataatgaggctaatctttctggtgtggatgagcagctgcacatgcgtgaagtccatgcacagagttttgaccctattgacgttgccaaaaaggaacgcaaagcagcggaaaagaagtatgccaagccaccaaaaagtgataatccgtacctagcacgggatgccaaagatgcagctgctcgtaagcggaagatcaatgcagctcatgataattttgcccaagagatggcacaggctgcgatgggaccactgcgcaaaggggtcaacactcaaacggtgatggccgcgtgtacgactgctgcggtgatgtggtgcatgagcccacgtatgaccggtgtgaacgtggatatgaagcgcaagtttaacaaggatctggaacaggctaaagacactaagttgtcgaagtatgtgtccaaagatttttggaagtcaaagctgacgcgcgataagacggagaaggaagcgaagtcgctctctgatgcgttcatgcagcagaaaacagcgatcatcagcaaccgtgaacgaatccccatgagtgttgcttctgccgcgcagaccgtggttcggttgtctgatcaagcgtatgaggcgatgcgtgaagtagatacggatggtcaagcgatagtggatgcgaaggatgtctctgcacaggtggcagaagatattgacatggtggtcaagcagggtgaagagcatggcctgaagtcgaaggatatttatggcgctgcccgcgatattgtgggtcgtcgcatggagcgcgatccaggctatgctgcccggtttaatgagacggcttttggcaccgtgcgcctgggtgaacaacgacgtggcatggtgatttcaaagaccccgacatggcaattccctgatggtgcaggtttgagtaaaaacgccggctggtttagtgttcgtgagccgatgggtaatgcgcagaacttcgctgacaacctggctgcgactttggcgacagaaatgcgggtagctggtgagcagtacggttccgatggcgttcgtgatgtagttgccggcttcatgacagcgactgatgtctcagaaagtggcctcgcctctgcgaagaaactgttacctgactttgatacacgtggtcgcagtgcttctcgggtgcgccagattgctatggcacagcgcacacaggcagcgatcaaggtgttgcaggatgatggtaatcagaccgcgatgacgactgagcaggtcaaggaggttcaggtatgggcgatggatcaggctgagaaggtgatgcagcgtgatcatccagcgattctggataagtttgtgcgcaaacatgggcagacatttgggcaggatgcggacgcttttgttaaatccataactatggaaaaagacacgagcagcgagtacactgatgctatggttcgacctcaagaaaatcgtggatcaggtcgagaactggcagctcgtcgtcgtgtacaagcagcgcaaatcaatcaggcagcacagctggatatgaatgttcatgatttccgtgaatcgaatctgccagaggaacgacccgcgaatccttatgaagcgtatgttcgtgagactgaagcgaaaaccaatgatccgcagtacggttattaatagaaaatgatagaaagaag

SEQ ID NO: 14 - protein, 722 aa, Corynebacterium glutamicum
VVTVAGNEKNKIREERVARRAQAVVEAEISLAAQASEQVREQAEAPDVNEQVEEVSVEVSSVQSLTQPKTLGQLHDPRKNVMSSSDLASIIGVEQQPVAYGESEEPETLRDVLPRRKLHPSEITPSYEVADGEQRSIFGESAPSDFDDLSDVEEFDTSHWVRAGQDDRSDDDRLADEAGVPRSGAQDVADNEANLSGVDEQLHMREVHAQSFDPIDVAKKERKAAEKKYAKPPKSDNPYLARDAKDAAARKRKINAAHDNFAQEMAQAAMGPLRKGVNTQTVMAACTTAAVMWCMSPRMTGVNVDMKRKFNKDLEQAKDTKLSKYVSKDFWKSKLTRDKTEKEAKSLSDAFMQQKTAIISNRERIPMSVASAAQTVVRLSDQAYEAMREVDTDGQAIVDAKDVSAQVAEDIDMVVKQGEEHGLKSKDIYGAARDIVGRRMERDPGYAARFNETAFGTVRLGEQRRGMVISKTPTWQFPDGAGLSKNAGWFSVREPMGNAQNFADNLAATLATEMRVAGEQYGSDGVRDVVAGFMTATDVSESGLASAKKLLPDFDTRGRSASRVRQIAMAQRTQAAIKVLQDDGNQTAMTTEQVKEVQVWAMDQAEKVMQRDHPAILDKFVRKHGQTFGQDADAFVKSITMEKDTSSEYTDAMVRPQENRGSGRELAARRRVQAAQINQAAQLDMNVHDFRESNLPEERPANPYEAYVRETEAKTNDPQYGY

SEQ ID NO: 15 - DNA, 2046 bp, Corynebacterium glutamicum
  CDS (101)..(2023): FRXA01539
aaatgaacaggtagaagaggttagtgtcgaggtatcttctgtccagtcattaacccagcctaagacgttggggcagctgcatgacccaaggaaaaatgtcatgagtagcagcgacttggcttctattattggtgtagagcaacagcctgttgcttatggtgagtctgaggaaccagaaacactgcgtgatgtgttgcctcggcgaaagcttcacccatctgagataacaccgagttatgaggttgctgatggtgaacagcgcagcatttttggtgaatcagctccgtctgattttgatgacctcagtgatgtcgaagaatttgataccagtcattgggtgcgtgctggacaagatgatcgtagtgatgatgatcgactcgctgatgaggctggtgtaccgcctagtggcgcacaagatgtagctgataatgaggctaatctttctggtgtggatgagcagctgcacatgcgtgaagtccatgcacagagttttgaccctattgacgttgccaaaaaggaacgcaaagcagcggaaaagaagtatgccaagccaccaaaaagtgataatccgtacctagcacgggatgccaaagatgcagctgctcgtaagcggaagatcaatgcagctcatgataattttgcccaagagatggcacaggctgcgatgggaccactgcgcaaaggggtcaacactcaaacggtgatggccgcgtgtacgactgctgcggtgatgtggtgcatgagcccacgtatgaccggtgtgaacgtggatatgaagcgcaagtttaacaaggatctggaacaggctaaagacactaagttgtcgaagtatgtgtccaaagatttttggaagtcaaagctgacgcgcgataagacggagaaggaagcgaagtcgctctctgatgcgttcatgcagcagaaaacagcgatcatcagcaaccgtgaacgaatccccatgagtgttgcttctgccgcgcagaccgtggttcggttgtctgatcaagcgtatgaggcgatgcgtgaagtagatacggatggtcaagcgatagtggatgcgaaggatgtctctgcacaggtggcagaagatattgacatggtggtcaagcagggtgaagagcatggcctgaagtcgaaggatatttatggcgctgcccgcgatattgtgggtcgtcgcatggagcgcgatccaggctatgctgcccggtttaatgagacggcttttggcaccgtgcgcctgggtgaacaacgacgtggcatggtgatttcaaagaccccgacatggcaattccctgatggtgcaggtttgagtaaaaacgccggctggtttagtgttcgtgagccgatgggtaatgcgcagaacttcgctgacaacctggctgcgactttggcgacagaaatgcgggtagctggtgagcagtacggttccgatggcgttcgtgatgtagttgccggcttcatgacagcgactgatgtctcagaaagtggcctcgcctctgcgaagaaactgttacctgactttgatacacgtggtcgcagtgcttctcgggtgcgccagattgctatggcacagcgcacacaggcagcgatcaaggtgttgcaggatgatggtaatcagaccgcgatgacgactgagcaggtcaaggaggttcaggtatgggcgatggatcaggctgagaaggtgatgcagcgtgatcatccagcgattctggataagtttgtgcgcaaacatgggcagacatttgggcaggatgcggacgcttttgttaaatccataactatggaaaaagacacgagcagcgagtacactgatgctatggttcgacctcaagaaaatcgtggatcaggtcgagaactggcagctcgtcgtcgtgtacaagcagcgcaaatcaatcaggcagcacagctggatatgaatgttcatgatttccgtgaatcgaatctgccagaggaacgacccgcgaatccttatgaagcgtatgttcgtgagactgaagcgaaaaccaatgatccgcagtacggttattaatagaaaatgatagaaagaag

SEQ ID NO: 16 - protein, 641 aa, Corynebacterium glutamicum
MSSSDLASIIGVEQQPVAYGESEEPETLRDVLPRRKLHPSEITPSYEVADGEQRSIFGESAPSDFDDLSDVEEFDTSHWVRAGQDDRSDDDRLADEAGVPPSGAQDVADNEANLSGVDEQLHMREVHAQSFDPIDVAKKERKAAEKKYAKPPKSDNPYLARDAKDAAARKRKINAAHDNFAQEMAQAAMGPLRKGVNTQTVMAACTTAAVMWCMSPRMTGVNVDMKRKFNKDLEQAKDTKLSKYVSKDFWKSKLTRDKTEKEAKSLSDAFMQQKTAIISNRERIPMSVASAAQTVVRLSDQAYEAMREVDTDGQAIVDAKDVSAQVAEDIDMVVKQGEEHGLKSKDIYGAARDIVGRRMERDPGYAARFNETAFGTVRLGEQRRGMVISKTPTWQFPDGAGLSKNAGWFSVREPMGNAQNFADNLAATLATEMRVAGEQYGSDGVRDVVAGFMTATDVSESGLASAKKLLPDFDTRGRSASRVRQIAMAQRTQAAIKVLQDDGNQTAMTTEQVKEVQVWAMDQAEKVMQRDHPAILDKFVRKHGQTFGQDADAFVKSITMEKDTSSEYTDAMVRPQENRGSGRELAARRRVQAAQINQAAQLDMNVHDFRESNLPEERPANPYEAYVRETEAKTNDPQYGY

SEQ ID NO: 17 - DNA, 1095 bp, Corynebacterium glutamicum
  CDS (101)..(1072): RXN01422
aatgcattgaaatcgtgatcgcctgttattgttttgtacgtcgaataacagtcccacaacagttccccaaaaggtgcgagcgggaaaaggagaagcaaacatggctcagcgaaaactggcctctgtgatcggtgcagcattggcagcatctgctgtactggttggattaatgacacccgcaacagcacaaagtagtggcagctcatcaacagacatcactcgagcactcacctcaagtggtggtgtggctgatagccgtgctcctgaaggtggcgcaaaggtcgttgttttcggtgactcccacacctctggcaccaatgctccattccgtaccgatgagcgtggctgcctcaagggtgcaaacaactgggcagatcagctgcagtctcagctgggacttggcgcgggagacctcattgatgtctcctgctccggtgcatcgatcaactctgatggattccacttctctgatgaagtccgccatgctgaagctcgtggcgcaatcggcccaaacaccaccgatatttttgttcagttgggcaagaatgatcagtggggcctttccaatgtgaaccttctgcagtctgttcagacctgcttgactgatgtgttcgctggttgtggcgatgctgcggttgctgctggcaagatgcaggatccaaatgcagttactgctgaaaactatgcagagcgcatgaagccagtcattgactacttgaagtactacgcaccaaacgcagagatcaccttggttggttaccaggaatacaccgctcgcagcggaagtcaggtatgtgttcgccttggtggaaccccactggtgaaaaatgatgcacctgcgctggtttcgttcatgaacaagttggacatggcgattgatggtgctgctggaatcctcggcgtcagccacgttgatctgcgtagcgcgactgaagggcacgacagctgctccaacgatccttgggtcaacggtgtctttgatgcacgtgcagaaatcgtcggcggtccgtggcacccatctgttaagggagactcggttactgcagggatcctgcgagatcgagtaaacgcctaaagatgacgtcgaaaagcatt

SEQ ID NO: 18 - protein, 324 aa, Corynebacterium glutamicum
MAQRKLASVIGAALAASAVLVGLMTPATAQSSGSSSTDITRALTSSGGVADSRAPEGGAKVVVFGDSHTSGTNAPFRTDERGCLKGANNWADQLQSQLGLGAGDLIDVSCSGASINSDGFHFSDEVRHAEARGAIGPNTTDIFVQLGKNDQWGLSNVNLLQSVQTCLTDVFAGCGDAAVAAGKMQDPNAVTAENYAERMKPVIDYLKYYAPNAEITLVGYQEYTARSGSQVCVRLGGTPLVKNDAPALVSFMNKLDMAIDGAAGILGVSHVDLRSATEGHDSCSNDPWVNGVFDARAEIVGGPWHPSVKGDSVTAGILRDRVNA

SEQ ID NO: 19 - DNA, 806 bp, Corynebacterium glutamicum
  CDS (1)..(783): FRXA01422
ttcggtgactcccacacctctggcaccaatgctccattccgtaccgatgagcgtggctgcctcaagggtgcaaacaactgggcagatcagctgcagtctcagctgggacttggcgcgggagacctcattgatgtctcctgctccggtgcatcgatcaactctgatggattccacttctctgatgaagtccgccatgctgaagctcgtggcgcaatcggcccaaacaccaccgatatttttgttcagttgggcaagaatgatcagtggggcctttccaatgtgaaccttctgcagtctgttcagacctgcttgactgatgtgttcgctggttgtggcgatgctgcggttgctgctggcaagatgcaggatccaaatgcagttactgctgaaaactatgcagagcgcatgaagccagtcattgactacttgaagtactacgcaccaaacgcagagatcaccttggttggttaccaggaatacaccgctcgcagcggaagtcaggtatgtgttcgccttggtggaaccccactggtgaaaaatgatgcacctgcgctggtttcgttcatgaacaagttggacatggcgattgatggtgctgctggaatcctcggcgtcagccacgttgatctgcgtagcgcgactgaagggcacgacagctgctccaacgatccttgggtcaacggtgtctttgatgcacgtgcagaaatcgtcggcggtccgtggcacccatctgttaagggagactcggttactgcagggatcctgcgagatcgagtaaacgcctaaagatgacgtcgaaaagcatt

SEQ ID NO: 20 - protein, 261 aa, Corynebacterium glutamicum
FGDSHTSGTNAPFRTDERGCLKGANNWADQLQSQLGLGAGDLIDVSCSGASINSDGFHFSDEVRHAEARGAIGPNTTDIFVQLGKNDQWGLSNVNLLQSVQTCLTDVFAGCGDAAVAAGKMQDPNAVTAENYAERMKPVIDYLKYYAPNAEITLVGYQEYTARSGSQVCVRLGGTPLVKNDAPALVSFMNKLDMAIDGAAGILGVSHVDLRSATEGHDSCSNDPWVNGVFDARAEIVGGPWHPSVKGDSVTAGILRDRVNA

SEQ ID NO: 21 - DNA, 771 bp, Corynebacterium glutamicum
  CDS (101)..(748): RXN01403
gtgcgtcgcatacggtgaattatctttcggcggatcgtttccgcacggtgtcgagtttcgtagagtttgcggccgatcgcggtattcaggaattcagccattggtgcgcggtcggggctatttcaatgcggtggatatttatgagacctccacgcaacctgaccaggaatttcctttcgattttgacactttttcagccgaccccacgccgtttcaactctctgcggtgcgtgccgataccggcgagaccgttttttggggcagggaagacaccccggatttgagcgctctgatgaagcgggttcgcgcgtcgtcgaccatgcctggtttcatgccgatcacctacatcgacggccatccatatgtcgatggcgcggtcggggagaccggcggtttgatgctacagccggccatcgatgcgggcttcacccgctttttcgttatcgcctcccgtccgcgcgattattggcgcaaggagatcgggcgcccgggtttcatcaaagctgctttacgacgtttccccacaatcgccgacctcaccatcgcgcgtcctgcactgtataactcggtaaagcaacagatcctcgacctagagaaacaaggcagcgcctatgtgttctttgcggacaacatgaacatccagaacacggaaatcaatctgaagaaactccgtgcatctttcgatgcaggcatgcagcagacccgcaaagattggccggagatcatgagcttcctgaaccaaaccagataatgaaggtttttagtccaact

SEQ ID NO: 22 - protein, 216 aa, Corynebacterium glutamicum
LVRGRGYFNAVDIYETSTQPDQEFPFDFDTFSADPTPFQLSAVRADTGETVFWGREDTPDLSALMKRVRASSTMPGFMPITYIDGHPYVDGAVGETGGLMLQPAIDAGFTRFFVIASRPRDYWRKEIGRPGFIKAALRRFPTIADLTIARPALYNSVKQQILDLEKQGSAYVFFADNMNIQNTEINLKKLRASFDAGMQQTRKDWPEIMSFLNQTR

SEQ ID NO: 23 - DNA, 437 bp, Corynebacterium glutamicum
  CDS (1)..(414): FRXA01403
ccgatcacctacatcgacggccatccatatgtcgatggcgcggtcggggagaccggcggtttgatgctacagccggccatcgatgcgggcttcacccgctttttcgttatcgcctcccgtccgcgcgattattggcgcaaggagatcgggcgcccgggtttcatcaaagctgctttacgacgtttccccacaatcgccgacctcaccatcgcgcgtcctgcactgtataactcggtaaagcaacagatcctcgacctagagaaacaaggcagcgcctatgtgttctttgcggacaacatgaacatccagaacacggaaatcaatctgaagaaactccgtgcatctttcgatgcaggcatgcagcagacccgcaaagattggccggagatcatgagcttcctgaaccaaaccagataatgaaggtttttagtccaact

SEQ ID NO: 24 - protein, 138 aa, Corynebacterium glutamicum
PITYIDGHPYVDGAVGETGGLMLQPAIDAGFTRFFVIASRPRDYWRKEIGRPGFIKAALRRFPTIADLTIARPALYNSVKQQILDLEKQGSAYVFFADNMNIQNTEINLKKLRASFDAGMQQTRKDWPEIMSFLNQTR

SEQ ID NO: 25 - DNA, 489 bp, Corynebacterium glutamicum
  CDS (101)..(466): RXN01326
gtccttgaggctgcttacactctacttattgtagaaatgggagggtcgtggcgtcgaaaagcaaacatcttttaacgcttttggcccgtattatggtggcatggctttccccgtgacagaagacaaaatcctggcagctgaggaaacccttggcaggcgcctccccgaaactttgcgcgaacgactacttcaaaacaatggtggcgaagtcatcgacaatgaaaacaacgactggattctccatccagttcgtgatgacagcgaccgaaaaaggcttgtccgaactgccaacgacatcatccgcgagaccgaatctgcacgtgaatgggacaatttccccgaaaatgcgatcgcaattgcaaatgacggaacgggcgacttaataattctgcttcccgacgatgatgctttctacatctggtcgcacgaagatgaacccctgatcgaaactgaacttgaggatgcctaaaacagctggacagaattcga

SEQ ID NO: 26 - protein, 122 aa, Corynebacterium glutamicum
MAFPVTEDKILAAEETLGRRLPETLRERLLQNNGGEVIDNENNDWILHPVRDDSDRKRLVRTANDIIRETESAREWDNFPENAIAIANDGTGDLIILLPDDDAFYIWSHEDEPLIETELEDA

SEQ ID NO: 27 - DNA, 361 bp, Corynebacterium glutamicum
  CDS (45)..(338): FRXA01326
ccggctggcgctgaggaaaccttggcaggcgcctccccgaaactttgcgcgaacgactacttcaaaacaatggtggcgaagtcatcgacaatgaaaacaacgactggattctccatccagttcgtgatgacagcgaccgaaaaaggcttgtccgaactgccaacgacatcatccgcgagaccgaatctgcacgtgaatgggacaatttccccgaaaatgcgatcgcaattgcaaatgacggaacgggcgacttaataattctgcttcccgacgatgatgctttctacatctggtcgcacgaagatgaacccctgatcgaaactgaacttgaggatgcctaaaacagctggacagaattcga

SEQ ID NO: 28 - protein, 98 aa, Corynebacterium glutamicum
LRERLLQNNGGEVIDNENNDWILHPVRDDSDRKRLVRTANDIIRETESAREWDNFPENAIAIANDGTGDLIILLPDDDAFYIWSHEDEPLIETELEDA

SEQ ID NO: 29 - DNA, 648 bp, Corynebacterium glutamicum
  CDS (101)..(625): RXN01301
aggcaagaacgcaaagttctagtacgctgctaaagtatgcagcttggcccgcacggtttccgcgtgcgggacgtgttcatttctgtataggaaaactaccttgatcgttgatacccagtttgagaagatccctgctcacgacgtcgtgggcatccgggtaatcctttcctctgaggatctccctgagctctttaaacgcggctacgcggaagtaaagaaattcctccgcctagaaggcatcgaacctaaaggtcctgcccgcgcctactactttggcgatgtctctgacaccgtagacatcctgattggtttccccgtcagccccgcgcaagcagaatccctgcgccgcggcgcattgagccaatccggtggcgacatcgatgacgttgtcctccaccacttccgcgacatgaaaaccatgcacagccgccactccggccccttcgatggagtcgagcgcgtctgggacgaaatcctcgatgaagtcgaagacctcggatgcactctgccatccagcagcatcggttgggaagaatacatcgagggcccagccaccgctgatacctgcgaccaactggcctctgaagtttatgttcaggtgtgccaagcaccggtgaagtctgcataaagattcacccggaatttccc

SEQ ID NO: 30 - protein, 175 aa, Corynebacterium glutamicum
LIVDTQFEKIPAHDVVGIRVILSSEDLPELFKRGYAEVKKFLRLEGIEPKGPARAYYFGDVSDTVDILIGFPVSPAQAESLRRGALSQSGGDIDDVVLHHFRDMKTMHSRHSGPFDGVERVWDEILDEVEDLGCTLPSSSIGWEEYIEGPATADTCDQLASEVYVQVCQAPVKSA

SEQ ID NO: 31 - DNA, 428 bp, Corynebacterium glutamicum
  CDS (1)..(405): FRXA01301
ttcctccgcctagaaggcatcgaacctaaaggtcctgcccgcgcctactactttggcgatgtctctgacaccgtagacatcctgattggtttccccgtcagccccgcgcaagcagaatccctgcgccgcggcgcattgagccaatccggtggcgacatcgatgacgttgtcctccaccacttccgcgacatgaaaaccatgcacagccgccactccggccccttcgatggagtcgagcgcgtctgggacgaaatcctcgatgaagtcgaagacctcggatgcactctgccatccagcagcatcggttgggaagaatacatcgagggcccagccaccgctgatacctgcgaccaactggcctctgaagtttatgttcaggtgtgccaagcaccggtgaagtctgcataaagattcacccggaatttccc

SEQ ID NO: 32 - protein, 135 aa, Corynebacterium glutamicum
FLRLEGIEPKGPARAYYFGDVSDTVDILIGFPVSPAQAESLRRGALSQSGGDIDDVVLHHFRDMKTMHSRHSGPFDGVERVWDEILDEVEDLGCTLPSSSIGWEEYIEGPATADTCDQLASEVYVQVCQAPVKSA

SEQ ID NO: 33 - DNA, 567 bp, Corynebacterium glutamicum
  CDS (101)..(544): RXN01276
tgcgtaaaaccctcatcaccatgctcgcgaccaccgcgatcgccttttccgccatctcaccagtgcaggcgcaaaccgtggacacagacactgacgcctcgtgtcatctgagctgagcagcggcacaagctcaggaagttcagaggattccgaagattctgacatctccaaccgggacatcatcttcggcatcgcagctatcgctgcagtcggcggacttatcgcaagtggtgtgcactgggcagtacaacagcgcatgatcccaaatcccctcccaggaatcattccaaatccccctgcactggcacctcaggcgcctgccccagcacctgctcccgctcctgcccctcaggcagtcgcgccccaggttgtcgctccccaggttgtcgcgcctgctccagccccagtacagaccaaccgcacctacaaaaactgcaccgaagtatggaacgtcctgggaaggtccatccgccaaagcgatccaggctacggcacacacctcgaccgcgaccgcgacggcatcggctgcgaatcacgccctaggtagtttgggttttggggatcttc

SEQ ID NO: 34 - protein, 148 aa, Corynebacterium glutamicum
VSSELSSGTSSGSSEDSEDSDISNRDIIFGIAAIAAVGGLIASGVHWAVQQRMIPNPLPGIIPNPPALAPQAPAPAPAPAPAPQAVAPQVVAPQVVAPAPAPVQTNRTYKNCTEVWNVLGRSIRQSDPGYGTHLDRDRDGIGCESRPR

SEQ ID NO: 35 - DNA, 669 bp, Corynebacterium glutamicum
  CDS (101)..(646): FRXA01276
ctagatgcccggaaaatagcatctcctatacacccaaaaaaaaggggagcgctgacagaaaatagtaataattttgacagctcgtgcaaagatgattggcatgcgtaaaaccctcatcaccatgctcgcgaccaccgcgatcgccttttccgccatctcaccagtgcaggcgcaaaccgtggacacagacactgacgcctccgtgtcatctgagctgagcagcggcacaagctcaggaagttcagaggattccgaagattctgacatctccaaccgggacatcatcttcggcatcgcagctatcgctgcagtcggcggacttatcgcaggtggtgtgcactgggcagtacaacagcgcatgatcccaaatcccctcccaggaatcattccaaatccccctgcactggcacctcaggcgcctgccccagcacctgctcccgctcctgcccctcaggcagtcgcgccccaggttgtcgctccccaggttgtcgcgcctgctccagccccagtacagaccaaccgcacctacaaaaactgcaccgaagtatggaacgtcctgggaaggtccatccgccaaagcgatccaggctacggcacacacctcgaccgcgaccgcgacggcatcggctgcgaatcacgccctaggtagtttgggttttggggatcttc

SEQ ID NO: 36 - protein, 182 aa, Corynebacterium glutamicum
MRKTLITMLATTAIAFSAISPVQAQTVDTDTDASVSSELSSGTSSGSSEDSEDSDISNRDIIFGIAAIAAVGGLIAGGVHWAVQQRMIPNPLPGIIPNPPALAPQAPAPAPAPAPAPQAVAPQVVAPQVVAPAPAPVQTNRTYKNCTEVWNVLGRSIRQSDPGYGTHLDRDRDGIGCESRPR

SEQ ID NO: 37 - DNA, 366 bp, Corynebacterium glutamicum
  CDS (101)..(343): RXN01231
tcctgggacgtcttccccgaggcgtgggagacattgaaggtttacctgggctttcgtgccccaggcatcgagcacttcacccccctatgacgccttgcaaatgctgggctacaccttcgtcatctttatcctggcgccgtttctcatcctcaccggaatagcgatggccccggccatccggtcccgcttcccgtggtacgtcaaactcttcggcggccaccagggtgcacgttccctgcacttcatcgccatggtgttgatgacgggctttgtcatcatgcacgtcggcctggttttttggtccatggcgactacaacatggtccacatggtcttcggcgatatgaacactgaccgtgcggcgcag

SEQ ID NO: 38 - protein, 81 aa, Corynebacterium glutamicum
MLGYTFVIFILAPFLILTGIAMAPAIRSRFPWYVKLFGGHQGARSLHFIAMVLMTGFVIMHVGLVFWSMATTTWSTWSSAI

SEQ ID NO: 39 - DNA, 627 bp, Corynebacterium glutamicum
  CDS (101)..(604): FRXA01231
  misc_feature 84, 399, 506, 541, 542, 544: n = a, c, g, or t
  VARIANT 62: Xaa = Cys, Gly, Arg, or Ser
  VARIANT 100: Xaa = Ile, Thr, Asn, or Ser
  VARIANT 104: Xaa = Val or Phe
  VARIANT 106: Xaa = Asp or Asn
  VARIANT 107: Xaa = Arg
  VARIANT 112: Xaa = Gly or Cys
  VARIANT 113: Xaa = Ser, Arg, Asn, or His
  VARIANT 115: Xaa = Leu
  VARIANT 117: Xaa = Gly or Glu
  VARIANT 118: Xaa = Thr or Pro
  VARIANT 120: Xaa = Pro
  VARIANT 121: Xaa = Ser or Cys
  VARIANT 123: Xaa = Leu or Ser
  VARIANT 126: Xaa = Ala
  VARIANT 128: Xaa = Ser
  VARIANT 130: Xaa = Ile, Leu, or Phe
  VARIANT 131: Xaa = Gly
  VARIANT 136: Xaa = Ser, Pro, Thr, or Ala
  VARIANT 137: Xaa = Gln or His
  VARIANT 147: Xaa = Asp or Glu
  VARIANT 148: Xaa = Tyr, His, Gln, Asn, Lys, Asp, Glu, or; STOP codon
cctgggacgtcttccccgaggcgtgggangacattgaaggtttacctgggctttcgtgccccaggcatcgagcacttcacccccctatgacgccttgcaaatgctgggctacaccttcgtcatctttatcctggcgccgtttctcatcctcaccggaatagcgatggccccggccatccggtcccgcttcccgtggtacgtcaaactcttcggcggccaccagggtgcacgttccctgcacttcatcgccatggtgttgatgacgggctttgtcatcatgcacngtcggcctggttttttggtccatggcgactacaacatggtccacatggtcttcggcgatatgaacactgaccgtgcggcgcaggcctacatcatcgtgatcaccaccatcgtcantggtggtgttkttctgratcgkgctcagtatattkgtmrctggctkaccgrgmccgcgccmwgcggttyaccgccagcwtcatckgagwtmggwcgcaaaatctttnctcawccggctgcgtccccggatgagcaggcagannancacctacacggacaaggacatctcgcagttccactggaccaatggcctgccgccgaccgatgatgaatcccccgagtggatcg

SEQ ID NO: 40 - protein, 168 aa, Corynebacterium glutamicum
  VARIANT 62: Xaa = Cys, Gly, Arg, or Ser
  VARIANT 100: Xaa = Ile, Thr, Asn, or Ser
  VARIANT 104: Xaa = Val or Phe
  VARIANT 106: Xaa = Asp or Asn
  VARIANT 107: Xaa = Arg
  VARIANT 112: Xaa = Gly or Cys
  VARIANT 113: Xaa = Ser, Arg, Asn, or His
  VARIANT 115: Xaa = Leu
  VARIANT 117: Xaa = Gly or Glu
  VARIANT 118: Xaa = Thr or Pro
  VARIANT 120: Xaa = Pro
  VARIANT 121: Xaa = Ser or Cys
  VARIANT 123: Xaa = Leu or Ser
  VARIANT 126: Xaa = Ala
  VARIANT 128: Xaa = Ser
  VARIANT 130: Xaa = Ile, Leu, or Phe
  VARIANT 131: Xaa = Gly
  VARIANT 136: Xaa = Ser, Pro, Thr, or Ala
  VARIANT 137: Xaa = Gln or His
  VARIANT 147: Xaa = Asp or Glu
  VARIANT 148: Xaa = Tyr, His, Gln, Asn, Lys, Asp, Glu, or; STOP codon
MLGYTFVIFILAPFLILTGIAMAPAIRSRFPWYVKLFGGHQGARSLHFIAMVLMTGFVIMHXRPGFLVHGDYNMVHMVFGDMNTDRAAQAYIIVITTIVXGGVXLXXAQYIXXWXTXXAXXGXPPXSXEXXRKIFXXPAASPDEQAXXHLHGQGHLAVPLDQWPAADR

SEQ ID NO: 41 - DNA, 954 bp, Corynebacterium glutamicum
  CDS (101)..(931): RXN01210
ttcgctgcaaaacccgccaccttggaatccgtattcatggacatcgcctcactcgagaacacctcgctgcaaaccgcctagaatctttaaggagaccacaatgaccacgtcacacaccgcccgcgggctgcaacatgcaaccccggagcgccgcaagacttcatttttcaaaacctctctgtttaaggccgaatggctccagttccgcagaaataaaaccctgttgttcatggccaccgtattcccagtcggaatccctttgttgctctttctcatcggaaatggtggggcagcagagtccgcgaactccttcgactacttcgtcatgtacaccctgctatttgtgcagttctacacggtgctgtccatggcaaccacccgccgtgatgaacgtgtgctgaaaaggctgcgcacgggagaagcccgcgacatcgatatcatcggtgccatctgtttccccggcgcgctcctcacactgatcttcaccgtggtgatcattccattgctcatggttttgggagctcccgcgcccatcaaccttgtgcccattgtgtttgccgtactgatcggactacttctttgtagtgctcttgccttgatgaccagcggtttcacccgaaacgccgaagccgcacagatgacctccatgcccgtgttcatgcttgcgatgggtggacttggatcaatccgcttcgtattcggcgacagcattgtggctgatatcttggcctacaccccattcgccgcgatcagtgaccttgtccaaatcggctgggctggcgccaccttcgccgacagcgttggtggagtagaggcagcaaacttcgctggaattttccaagacatgctcataccacttggaattctggcagcgtggacagctgcagcggtgtgggcggcgaaccgctacatgcgctgggactcgtaccgctaagcctgcagccgacgggatta

SEQ ID NO: 42 - protein, 277 aa, Corynebacterium glutamicum
MTTSHTARGLQHATPERRKTSFFKTSLFKAEWLQFRRNKTLLFMATVFPVGIPLLLFLIGNGGAAESANSFDYFVMYTLLFVQFYTVLSMATTRRDERVLKRLRTGEARDIDIIGAICFPGALLTLIFTVVIIPLLMVLGAPAPINLVPIVFAVLIGLLLCSALALMTSGFTRNAEAAQMTSMPVFMLAMGGLGSIRFVFGDSIVADILAYTPFAAISDLVQIGWAGATFADSVGGVEAANFAGIFQDMLIPLGILAAWTAAAVWAANRYMRWDSYR

SEQ ID NO: 43 - DNA, 716 bp, Corynebacterium glutamicum
  CDS (1)..(693): FRXA01210
gtattcccagtcggaatccctttgttgctctttctcatcggaaatggtggggcagcagagtccgcgaactccttcgactacttcgtcatgtacaccctgctatttgtgcagttctacacggtgctgtccatggcaaccacccgccgtgatgaacgtgtgctgaaaaggctgcgcacgggagaagcccgcgacatcgatatcatcggtgccatctgtttccccggcgcgctcctcacactgatcttcaccgtggtgatcattccattgctcatggttttgggagctcccgcgcccatcaaccttgtgcccattgtgtttgccgtactgatcggactacttctttgtagtgctcttgccttgatgaccagcggtttcacccgaaacgccgaagccgcacagatgacctccatgcccgtgttcatgcttgcgatgggtggacttggatcaatccgcttcgtattcggcgacagcattgtggctgatatcttggcctacaccccattcgccgcgatcagtgaccttgtccaaatcggctgggctggcgccaccttcgccgacagcgttggtggagtagaggcagcaaacttcgctggaattttccaagacatgctcataccacttggaattctggcagcgtggacagctgcagcggtgtgggcggcgaaccgctacatgcgctgggactcgtaccgctaagcctgcagccgacgggatta

SEQ ID NO: 44 - protein, 231 aa, Corynebacterium glutamicum
VFPVGIPLLLFLIGNGGAAESANSFDYFVMYTLLFVQFYTVLSMATTRRDERVLKRLRTGEARDIDIIGAICFPGALLTLIFTVVIIPLLMVLGAPAPINLVPIVFAVLIGLLLCSALALMTSGFTRNAEAAQMTSMPVFMLAMGGLGSIRFVFGDSIVADILAYTPFAAISDLVQIGWAGATFADSVGGVEAANFAGIFQDMLIPLGILAAWTAAAVWAANRYMRWDSYR

SEQ ID NO: 45 - DNA, 400 bp, Corynebacterium glutamicum
  CDS (101)..(400): RXN01206
ccgtgccagtgatgaaaagccggcgagccgccaaacttgattaagtgattgtcactttggattgtcatattgggcgaataaaccggtaggattccccttcgtgagcgccgaaaataccgagaacacagattccccatttgaaatctccgagtttgatgatcaccgacgccccctccagcgggccctcaaattcggttccatcgccctaattgtcttcaccctgatctccctagcgatctggggtgcaactcgtggcgtacccggcgtatcagcagttgttatcggcgcagcagttggcgcaggctttgtcctcttaacggctctcagcgtcctgtttacaactaattccaacgtcaccaccaccggtgcggtggtgctcggtggctggctgctgaagatc

SEQ ID NO: 46 - protein, 100 aa, Corynebacterium glutamicum
VSAENTENTDSPFEISEFDDHRRPLQRALKFGSIALIVFTLISLAIWGATRGVPGVSAVVIGAAVGAGFVLLTALSVLFTTNSNVTTTGAVVLGGWLLKI

SEQ ID NO: 47 - DNA, 361 bp, Corynebacterium glutamicum
  CDS (101)..(361): FRXA01206
ccgtgccagtgatgaaaagccggcgagccgccaaacttgattaagtgattgtcactttggattgtcatattgggcgaataaaccggtaggattccccttcgtgagcgccgaaaataccgagaacacagattccccatttgaaatctccgagtttgatgatcaccgacgccccctccagcgggccctcaaattcggttccatcgccctaattgtcttcaccctgatctccctagcgatctggggtgcaactcgtggcgtacccggcgtatcagcagttgttatcggcgcagcagttggcgcaggctttgtcctcttaacggctctcagcgtcctgtttacaactaattccaacgtcaccacc

SEQ ID NO: 48 - protein, 87 aa, Corynebacterium glutamicum
VSAENTENTDSPFEISEFDDHRRPLQRALKFGSIALIVFTLISLAIWGATRGVPGVSAVVIGAAVGAGFVLLTALSVLFTTNSNVTT

SEQ ID NO: 49 - DNA, 1209 bp, Corynebacterium glutamicum
  CDS (101)..(1186): RXN01121
aaagatttactgcgtacaactctaaccaacaatattggcaatgggttgttccatcttagcgctttacctgtgaactctgcagagcggtacgcttaagctaatgaatcccgaatttattcacggcgcaaccgaaattgaaaccacaaacaggggccttcgcccgcatcgactcagcaaagaaatagtagaacgctactgtgatccccagtttagcgcgatggaacgccaaccatcgggcgtgcgcgttgtgtgtcgcaccaccgccacctccgtcacgctgaccacgtattccacgcgggtggtgtacctcgattccggccggccgggcggcaagattgatgtgcttatcgacggcgcccccacatcttccacgccaacttccgggggcgagaccacggaagtcaatttcatcaccggcgccacggaacggcgcctgaaagatccgcaggtgctcacagtggatggactttcagagcaggaaaaggtggtggagttctggctgcctcacaatgaagaaattgaagtgatctcccttaaagccaacgcagctttaaacactgtcgaagacacccgtcccgtgtggatcaattacggcagctccattagccacggttcggttgccactgccccaaccaaaatttggccagccattgttgcccagtccaaaaactacaacctgcgtaacttcggttttggtggcagcgccatgttggatccttttatggcgaggctaatcagggatactccagctgatctgatcaccttggaaattggcatcaatattgtcaatggtgatgtgatgcgtcgccgcggactagaggctgctgtggatgggttcatcaataccatccgcgatggccaccccaccacgccgatcaagattgtgtcgccgttctactgccccattcatgagaaaactccaggacccggcgcgtttgatacctcatcgtttggcagtggtcagattaggttcatcgccactggtgaacctgatgagcatggtcgactgacgctggagatggtgcgtgaggtgttggaggggttcgtcgaaaagcaaaaagacccgcacctgacctacgtcgatggtgcgagcctttatcaggccagcgatgcgccgttgctggataatttgcacccagacgaggcgtcgcacgccttaattgcgcagcgtttgcttaagcaactttgaaatcggcttcggtgatttcg

SEQ ID NO: 50 - protein, 362 aa, Corynebacterium glutamicum
MNPEFIHGATEIETTNRGLRPHRLSKEIVERYCDPQFSAMERQPSGVRVVCRTTATSVTLTTYSTRVVYLDSGRPGGKIDVLIDGAPTSSTPTSGGETTEVNFITGATERRLKDPQVLTVDGLSEQEKVVEFWLPHNEEIEVISLKANAALNTVEDTRPVWINYGSSISHGSVATAPTKIWPAIVAQSKNYNLRNFGFGGSAMLDPFMARLIRDTPADLITLEIGINIVNGDVMRRRGLEAAVDGFINTIRDGHPTTPIKIVSPFYCPIHEKTPGPGAFDTSSFGSGQIRFIATGEPDEHGRLTLEMVREVLEGFVEKQKDPHLTYVDGASLYQASDAPLLDNLHPDEASHALIAQRLLKQL

SEQ ID NO: 51 - DNA, 778 bp, Corynebacterium glutamicum
  CDS (101)..(778): FRXA01121
aaagatttactgcgtacaactctaaccaacaatattggcaatgggttgttccatcttagcgctttacctgtgaactctgcagagcggtacgcttaagctaatgaatcccgaatttattcacggcgcaaccgaaattgaaaccacaaacaggggccttcgcccgcatcgactcagcaaagaaatagtagaacgctactgtgatccccagtttagcgcgatggaacgccaaccatcgggcgtgcgcgttgtgtgtcgcaccaccgccacctccgtcacgctgaccacgtattccacgcgggtggtgtacctcgattccggccggccgggcggcaagattgatgtgcttatcgacggcgcccccacatcttccacgccaacttccgggggcgagaccacggaagtcaatttcatcaccggcgccacggaacggcgcctgaaagatccgcaggtgctcacagtggatggactttcagagcaggaaaaggtggtggagttctggctgcctcacaatgaagaaattgaagtgatctcccttaaagccaacgcagctttaaacactgtcgaagacacccgtcccgtgtggatcaattacggcagctccattagccacggttcggttgccactgccccaaccaaaatttggccagccattgttgcccagtccaaaaactacaacctgcgtaacttcggttttggtggcagcgccatgttggatccttttatggcgaggctaatcagggatactccagctgatctgatcaccttggaaattggcatc

SEQ ID NO: 52 - protein, 226 aa, Corynebacterium glutamicum
MNPEFIHGATEIETTNRGLRPHRLSKEIVERYCDPQFSAMERQPSGVRVVCRTTATSVTLTTYSTRVVYLDSGRPGGKIDVLIDGAPTSSTPTSGGETTEVNFITGATERRLKDPQVLTVDGLSEQEKVVEFWLPHNEEIEVISLKANAALNTVEDTRPVWINYGSSISHGSVATAPTKIWPAIVAQSKNYNLRNFGFGGSAMLDPFMARLIRDTPADLITLEIGI

SEQ ID NO: 53 - DNA, 902 bp, Corynebacterium glutamicum
  CDS (1)..(879): RXN01085
cgaaagcgtggtgaaggacttgatcccaactcaccagaagctattgagcaggcgaagaagaaaggggaacggaaggctcgtaatgagcgttgccgcaaaaacttcaaaggtggtggcaccaaagatcttaagcagactgatcggacctttgatcagctgcgaaaacagcgggtgacggataaagcccgcaaccgtgacgtacacaatgagcagcaactggcacgcggtgaaatcggagaaatgcgctcaccgatgtgggttgaggtgggtgctgcgattctgggcgtgtttgtcctggttgtgatgtggctggcctggggcggtatcgggctgctgatccagaccatgatgaatactggctcacctaatgacaaagagctttttgatgagcttggtgtgagaccctattatgttgctgtcgaacagcaaatcggcaccagtagtgctcacaccacgtgctaccaaccgcttgatgaatttggcaataattttggcgactgtacgcgtagcgtgcctaaagagccagtgtggtacgccgattatgtagctagtgtgttcgcagaacatggctttgatgcaccagaacctattgataattcggtgggtagctggctgttatttggtcatgtgggcattattcgggtgacgtttgtgattgcggttgcagcgggtgtgtatgcgatgtcacgcgcagcaatgatgcgtcagctagaaacacaaaacgtcgctgtggacaccaccgatattaaccagcacaccaatgacgcacgtttggcgattccgcaggagattgtgcgcgatttgagtctgttccccgatgtcggtgcacacttcaccagtccagccctcaagcatgatttcccatgtgatgctgtcgaataagggctttgaaaaaggtggat

SEQ ID NO: 54 - protein, 293 aa, Corynebacterium glutamicum
RKRGEGLDPNSPEAIEQAKKKGERKARNERCRKNFKGGGTKDLKQTDRTFDQLRKQRVTDKARNRDVHNEQQLARGEIGEMRSPMWVEVGAAILGVFVLVVMWLAWGGIGLLIQTMMNTGSPNDKELFDELGVRPYYVAVEQQIGTSSAHTTCYQPLDEFGNNFGDCTRSVPKEPVWYADYVASVFAEHGFDAPEPIDNSVGSWLLFGHVGIIRVTFVIAVAAGVYAMSRAAMMRQLETQNVAVDTTDINQHTNDARLAIPQEIVRDLSLFPDVGAHFTSPALKHDFPCDAVE

SEQ ID NO: 55 - DNA, 1057 bp, Corynebacterium glutamicum
  CDS (101)..(1057): FRXA01085
gaagggtcgtaatgagcgttgccgcaaaaacttcaaaggtggtggcaccaaagatcttaagcagactgatcggacctttgatcagctgcgaaaacagcgggtgacggataaagcccgcaaccgtgacgtacacaatgagcagcaactggcacgcggtgaaatcggagaaatgcgctcaccgatgtgggttgaggtgggtgctgcgattctgggcgtgtttgtcctggttgtgatgtggctggcctggggcggtatcgggctgctgatccagaccatgatgaatactggctcacctaatgacaaagagctttttgatgagcttggtgtgagaccctattatgttgctgtcgaacagcaaatcggcaccagtagtgctcacaccacgtgctaccaaccgcttgatgaatttggcaataattttggcgactgtacgcgtagcgtgcctaaagagccagtgtggtacgccgattatgtagctagtgtgttcgcagaacatggctttgatgcaccagaacctattgataattcggtgggtagctggctgttatttggtcatgtgggcattattcgggtgacgtttgtgattgcggttgcagcgggtgtgtatgcgatgtcacgcgcagcaatgatgcgtcagctagaaacacaaaacgtcgctgtggacaccaccgatattaaccagcacaccaatgacgcacgtttggcgattccgcaggagattgtgcgcgatttgagtctgttccccgatgtcggtgcacactcaccagtccagccctcaagcatgatttcccatgtgatgctgtcgaataagggcttgaaaaaggtggatgtaacgcagtttgcacaggagacaattatcgacaatgacactggtgaaattgtctctgaaaagggtgaagtgctctatgacggtgcaggacaaccgatcacaaagagcttgccgatgattgacaacgaatttagccatgcgatttttgacaaatcagatgtcccgaatcttcccgagctgcgacggttctttaatccagcaaagattgagtggaatcctggtggtagt

SEQ ID NO: 56 - protein, 319 aa, Corynebacterium glutamicum
VTDKARNRDVHNEQQLARGEIGEMRSPMWVEVGAAILGVFVLVVMWLAWGGIGLLIQTMMNTGSPNDKELFDELGVRPYYVAVEQQIGTSSAHTTCYQPLDEFGNNFGDCTRSVPKEPVWYADYVASVFAEHGFDAPEPIDNSVGSWLLFGHVGIIRVTFVIAVAAGVYAMSRAAMMRQLETQNVAVDTTDINQHTNDARLAIPQEIVRDLSLFPDVGAHSPVQPSSMISHVMLSNKGLKKVDVTQFAQETIIDNDTGEIVSEKGEVLYDGAGQPITKSLPMIDNEFSHAIFDKSDVPNLPELRRFFNPAKIEWNPGGS

SEQ ID NO: 57 - DNA, 1824 bp, Corynebacterium glutamicum
  CDS (101)..(1801): RXN00022
aggactgctccgcaaacctctaacaacacctgctactccccctgcagcgccggtcaaccccacaccacccaccccttaacaaccacaagaaagatttatcatgtccgctccaaccatctaccccggcaccaaaacatctattgatccgatcaccatggatgacgctcgcatcatctttttcgatattgagtcgctccacaatattttcacggtagcaacctacgattctctgtcccaccacgtcgatgtcttttacctgctcgatcacacaaccagccctcagatcacggtgctgccgcactcaatggattatttcgatcaaacgcgcagcgatgctgttatggctgccatcattgagcaaaaccctgcgttcgcagaaattaaaggctcacccattacaaccgcagatgtagccctccacaatctcggtgacaccaacgccaaccgacgctggcagtctaacgtgctgcttgcccggctactcgggggtattagtgtgcgcggagaggtacctgagcaccagagccacaaccatctcgccaagcagtttgccgaggcaaccttggtcaccagggacttcgatgtgaattatgatccaacaagcgctcacccttttactgctggcttcaactcgatcaactatgacaccaccttgctcagcctgtacttcgcaatgttgacctcaaatatcggaagtacaccgacgtatttcccggtgatcaccgcacaggaacttcgtgcgcataacgacaagctctttagccctgagttcatcaaaaacatgccaaagtatctctgggatcgcgacagcggtgctggactcagagctgcatcgggtttccgcaacgccatgctcaaatcgggtcgccacattgatattcaacgcctcaatgaaaaacagctctttgttggactcaagcgcctgcttggtctcctcggtcaccagattctcgaatctgatcgtctctctggtgatgatgcccatgttgatactaacgaggatgtacttgatctcattgcctacaacgtctcagacgtggtgggcaccagactgctcgctgaggacccggtgtactccggctctttcgatctgcgggcaggtctactgagcacctacccagagactgtttttgatcatgatggtactttccgtcagccatccacgcagatgcgtaaagatcgcctaacgattaatacctcatcagctcagttcgcagcgcgtattttggcgccatatcgcccactccgcgatgtccctgatgcgattggcgacatgccggtggtgtcttacttgtacccggatgcagcagtcgccgaagcaacaggtcaaaaacaagtcaacgtgcttgatgagtcaaagaagttcttctatgacaacatcaccgacccggaagcacgtgctgcctttgatgaggtctttgctttttacgctgatattgagggtcgcaacttcaacagtcacaatgaggctattgatacccagattaaccaattacgtgcttatctcaaccaggttgtcgcattcgatgcagctgggtatgcgctctatgatgtacgtacacgttttgagcagatcttccccaaggatcgcagctacatcaacgatgctacggatatgacccctcgcgcagtatcgagctttgacgatctggttgcactctgtgatgatattcgcggtgtacttgatcgaggtttagagatctcatctccgaatcatcatgagatggtggatgctatgcgcaagcagctgcactatattcaggcattttaccgtgcctgggacccatcaacgccgcttcaatgacgctgacccagcggtgaccc

SEQ ID NO: 58 - protein, 567 aa, Corynebacterium glutamicum
MSAPTIYPGTKTSIDPITMDDARIIFFDIESLHNIFTVATYDSLSHHVDVFYLLDHTTSPQITVLPHSMDYFDQTRSDAVMAAIIEQNPAFAEIKGSPITTADVALHNLGDTNANRRWQSNVLLARLLGGISVRGEVPEHQSHNHLAKQFAEATLVTRDFDVNYDPTSAHPFTAGFNSINYDTTLLSLYFAMLTSNIGSTPTYFPVITAQELRAHNDKLFSPEFIKNMPKYLWDRDSGAGLRAASGFRNAMLKSGRHIDIQRLNEKQLFVGLKRLLGLLGHQILESDRLSGDDAHVDTNEDVLDLIAYNVSDVVGTRLLAEDPVYSGSFDLRAGLLSTYPETVFDHDGTFRQPSTQMRKDRLTINTSSAQFAARILAPYRPLRDVPDAIGDMPVVSYLYPDAAVAEATGQKQVNVLDESKKFFYDNITDPEARAAFDEVFAFYADIEGRNFNSHNEAIDTQINQLRAYLNQVVAFDAAGYALYDVRTRFEQIFPKDRSYINDATDMTPRAVSSFDDLVALCDDIRGVLDRGLEISSPNHHEMVDAMRKQLHYIQAFYRAWDPSTPLQ

SEQ ID NO: 59 - DNA, 835 bp, Corynebacterium glutamicum
  CDS (101)..(835): FRXA00022
aggactgctccgcaaacctctaacaacacctgctactccccctgcagcgccggtcaaccccacaccacccaccccttaacaaccacaagaaagatttatcatgtccgctccaaccatctaccccggcaccaaaacatctattgatccgatcaccatggatgacgctcgcatcatctttttcgatattgagtcgctccacaatattttcacggtagcaacctacgattctctgtcccaccacgtcgatgtcttttacctgctcgatcacacaaccagccctcagatcacggtgctgccgcactcaatggattatttcgatcaaacgcgcagcgatgctgttatggctgccatcattgagcaaaaccctgcgttcgcagaaattaaaggctcacccattacaaccgcagatgtagccctccacaatctcggtgacaccaacgccaaccgacgctggcagtctaacgtgctgcttgcccggctactcgggggtattagtgtgcgcggagaggtacctgagcaccagagccacaaccatctcgccaagcagtttgccgaggcaaccttggtcaccagggacttcgatgtgaattatgatccaacaagcgctcacccttttactgctggcttcaactcgatcaactatgacaccaccttgctcagcctgtacttcgcaatgttgacctcaaatatcggaagtacaccgacgtatttcccggtgatcaccgcacaagaacttcgtgcgcataacgacaagctctttagccctgagttcatcaaaaacatgccaaagtatttctgggatcgcgacagcggtgctggactcagagctgcatcg

SEQ ID NO: 60 - protein, 245 aa, Corynebacterium glutamicum
MSAPTIYPGTKTSIDPITMDDARIIFFDIESLHNIFTVATYDSLSHHVDVFYLLDHTTSPQITVLPHSMDYFDQTRSDAVMAAIIEQNPAFAEIKGSPITTADVALHNLGDTNANRRWQSNVLLARLLGGISVRGEVPEHQSHNHLAKQFAEATLVTRDFDVNYDPTSAHPFTAGFNSINYDTTLLSLYFAMLTSNIGSTPTYFPVITAQELRAHNDKLFSPEFIKNMPKYFWDRDSGAGLRAAS

SEQ ID NO: 61 - DNA, 939 bp, Corynebacterium glutamicum
  CDS (1)..(939): FRXA01921
cacattgatattcaacgcctcaatgaaaaacagctctttgttggactcaagcgcctgcttggtctcctcggtcaccagattctcgaatctgatcgtctctctggtgatgatgcccatgttgatactaacgaggatgtacttgatctcattgcctacaacgtctcagacgtggtgggcaccagactgctcgctgaggacccggtgtactccggctctttcgatctgcgggcaggtctactgagcacctacccagagactgtttttgatcatgatggtactttccgtcagccatccacgcagatgcgtaaagatcgcctaacgattaatacctcatcagctcagttcgcagcgcgtattttggcgccatatcgcccactccgcgatgtccctgatgcgattggcgacatgccggtggtgtcttacttgtacccggatgcagcagtcgccgaagcaacaggtcaaaaacaagtcaacgtgcttgatgagtcaaagaagttcttctatgacaacatcaccgacccggaagcacgtgctgcctttgatgaggtctttgctttttacgctgatattgagggtcgcaacttcaacagtcacaatgaggctattgatacccagattaaccaattacgtgcttatctcaaccaggttgtcgcattcgatgcagctgggtatgcgctctatgatgtacgtacacgttttgagcagatcttccccaaggatcgcagctacatcaacgatgctacggatatgacccctcgcgcagtatcgagctttgacgatctggttgcactctgtgatgatattcgcggtgtacttgatcgaggtttagagatctcatctccgaatcatcatgagatggtggatgctatgcgcaagcagctgcactatattcaggcatttaccgtgcctgggacccatcaacgccgcttcaatgacgct

SEQ ID NO: 62 - protein, 313 aa, Corynebacterium glutamicum
HIDIQRLNEKQLFVGLKRLLGLLGHQILESDRLSGDDAHVDTNEDVLDLIAYNVSDVVGTRLLAEDPVYSGSFDLRAGLLSTYPETVFDHDGTFRQPSTQMRKDRLTINTSSAQFAARILAPYRPLRDVPDAIGDMPVVSYLYPDAAVAEATGQKQVNVLDESKKFFYDNITDPEARAAFDEVFAFYADIEGRNFNSHNEAIDTQINQLRAYLNQVVAFDAAGYALYDVRTRFEQIFPKDRSYINDATDMTPRAVSSFDDLVALCDDIRGVLDRGLEISSPNHHEMVDAMRKQLHYIQAFTVPGTHQRRFNDA

SEQ ID NO: 63 - DNA, 489 bp, Corynebacterium glutamicum
  CDS (101)..(466): RXN00027
ttaggcaacgactccgaaaccttcaagaacgtgtggcactaacaattgcggactatccttgggaactgttttagattttattcagggtagggagattgttgtggatgaacgaagccggtttgcgcgcagcgttttcccggacggtgaagaaccagatccacgtttcactttggccaatgagcgcacgtttctagcatggacgcgtacgtctttggcgtttcttgccggtggtattgcttttgaggcgttccagatcagtggactatcggatactgtccgtacaacaatcgcggtttttatcattgcggttggcatgatcattgccgctggtgctgcggtgaggtggatgaatgtggagcgtgcaatgcgtaaacagaagccacttcccgtacctgcgattattccgtttctgtctattgcggctttggtggcctctgcggctgtcttggttctgattattgttcagtagctatgcgcattcatgaggat

SEQ ID NO: 64 - protein, 122 aa, Corynebacterium glutamicum
VDERSRFARSVFPDGEEPDPRFTLANERTFLAWTRTSLAFLAGGIAFEAFQISGLSDTVRTTIAVFIIAVGMIIAAGAAVRWMNVERAMRKQKPLPVPAIIPFLSIAALVASAAVLVLIIVQ

SEQ ID NO: 65 - DNA, 489 bp, Corynebacterium glutamicum; identical to SEQ ID NO: 63
  CDS (101)..(466): FRXA00027

SEQ ID NO: 66 - protein, 122 aa, Corynebacterium glutamicum; identical to SEQ ID NO: 64

SEQ ID NO: 67 - DNA, 2070 bp, Corynebacterium glutamicum
  CDS (101)..(2047): RXN00028
aaaagtcctggccagaaaactctctatactgtgcagcatggcaccaacgatcaccgacatccatgttctgcttcgtcgcggtgagcgacaatcagtgatcatgaccctcactgcctcttccttggaggccgggaaaatgtcttttagtggcgggtatatcgtgggcgagacgatgatcttcctcgtcgatcccgatgaagtcgagatacgacgcagccctaacagcctccacgtcctgcgtaacggtagcgatattctgcgccgcaacgagcatcattgctgggtatttgagaatttcaataaacccattgacccacctgttcgattgggtcctcgggatatcatctgcccgagcgccttggcctgggttcttcaacagcattccatctcccggtccttatcccaccaccttcacgcggataagatcactgcgggagagattgctggacgccccacctggatcctccgtgaggaacctacttcaggagggcaggacccaagtcgattggtcagtcttgaaatcgaccaggaacacggtgtcatccttgcagtggagactggacaagaacgactcgaagccacggagatttcttttcctgacactcttcctaatccttcctgggacggagcctgggaaccattccattatccagattcgacaccacacactgcccctgatgttgctgaaatacccggttacattcagtcactgccgccgcagtctgaagatcctcgcagactacgagtcttcgtcaatgagatagcactcgaaggtgatttccctgactaccgtcaaggacaatctgtgcgacttactttgggaattagctcctcccctgtgccactcgaaggaatgacaaccagacgccggggccgggtacgcaaccttggggaagaagctagtccaggcgatgacggtatgccccagtggccaatcctgctcactggtgatgggtggacggcgctggcctacactcccatcccaaaacgtggagatgcagagatccaggggtggttttattattccgcctacggaattgttgatgttcccacagatctacgggtagagcgtattttcgctggtatcggcacaagtggcaccaacgagcgtttgtggcaggagatagacaatacttcttcggcttatcactcggaagattggtggatccgcgatgtcgttttagacgtcacgttggatggagctgttccgcctccgcttagacgtgacgtcttcactgctgtcgatcctattgtggcgggtgacaaattgtggctgtgtgacgtgcactttccggtagcccgctgctgggagaccacgaccggccgatacttggggcagactttagtcccagcaccactgcgagatcgatcgtacgtccttgagctgcacagcgaccaacaattaggagccgtagcggcaagtgggaagagtggttggattctcacacctggtcaagcagtagccactaaagctcctgattggactcctcccacccgggcaaccgatctgcctcaggtcccctccccctgggagatcgtcgctgtccgtggccaaggtctgtttgagctgcaggtggaaactagtagacgcaccgccctcggtcgagttaatgcgaccggtggcgtcgacatcggtgaactcccgcccaacggctataccatcagttctgtggttcagatcggtgatgaatacatcgtgggcaggtgggtagaggaataccggctcaactccaaactggaggtcatttctaccaaagagctagatatctccgcatccggatggaagagcaaggggacggttgcttatctgtcggaagacactcacatatgtttcttcgaccaggtcagcggggccgagcttcccagcctgggtatcgccgagggacaccagggcgaggttatgtcagcaacttcttcagagagcatcgtgcttatctaccggcgcaacccgaacaattcaatgtcgattgtcccgacttccgttgccacctatgacaatggcacctggacgactatgccgctacaggaagctccagcggaactgtcctaaactgctcatagactgctgag

SEQ ID NO: 68 - protein, 649 aa, Corynebacterium glutamicum
MTLTASSLEAGKMSFSGGYIVGETMIFLVDPDEVEIRRSPNSLHVLRNGSDILRRNEHHCWVFENFNKPIDPPVRLGPRDIICPSALAWVLQQHSISRSLSHHLHADKITAGEIAGRPTWILREEPTSGGQDPSRLVSLEIDQEHGVILAVETGQERLEATEISFPDTLPNPSWDGAWEPFHYPDSTPHTAPDVAEIPGYIQSLPPQSEDPRRLRVFVNEIALEGDFPDYRQGQSVRLTLGISSSPVPLEGMTTRRRGRVRNLGEEASPGDDGMPQWPILLTGDGWTALAYTPIPKRGDAEIQGWFYYSAYGIVDVPTDLRVERIFAGIGTSGTNERLWQEIDNTSSAYHSEDWWIRDVVLDVTLDGAVPPPLRRDVFTAVDPIVAGDKLWLCDVHFPVARCWETTTGRYLGQTLVPAPLRDRSYVLELHSDQQLGAVAASGKSGWILTPGQAVATKAPDWTPPTRATDLPQVPSPWEIVAVRGQGLFELQVETSRRTALGRVNATGGVDIGELPPNGYTISSVVQIGDEYIVGRWVEEYRLNSKLEVISTKELDISASGWKSKGTVAYLSEDTHICFFDQVSGAELPSLGIAEGHQGEVMSATSSESIVLIYRRNPNNSMSIVPTSVATYDNGTWTTMPLQEAPAELS

SEQ ID NO: 69 - DNA, 2070 bp, Corynebacterium glutamicum
  CDS (101)..(2047): FRXA00028
  VARIANT 416: Xaa = Val or Phe
aaaagtcctggccagaaaactctctatactgtgcagcatggcaccaacgatcaccgacatccatgttctgcttcgtcgcggtgagcgacaatcagtgatcatgaccctcactgcctcttccttggaggccgggaaaatgtcttttagtggcgggtatatcgtgggcgagacgatgatcttcctcgtcgatcccgatgaagtcgagatacgacgcagccctaacagcctccacgtcctgcgtaacggtagcgatattctgcgccgcaacgagcatcattgctgggtatttgagaatttcaataaacccattgacccacctgttcgattgggtcctcgggatatcatctgcccgagcgccttggcctgggttcttcaacagcattccatctcccggtccttatcccaccaccttcacgcggataagatcactgcgggagagattgctggacgccccacctggatcctccgtgaggaacctacttcaggagggcaggacccaagtcgattggtcagtcttgaaatcgaccaggaacacggtgtcatccttgcagtggagactggacaagaacgactcgaagccacggagatttcttttcctgacactcttcctaatccttcctgggacggagcctgggaaccattccattatccagattcgacaccacacactgcccctgatgttgctgaaatacccggttacattcagtcactgccgccgcagtctgaagatcctcgcagactacgagtcttcgtcaatgagatagcactcgaaggtgatttccctgactaccgtcaaggacaatctgtgcgacttactttgggaattagctcctcccctgtgccactcgaaggaatgacaaccagacgccggggccgggtacgcaaccttggggaagaagctagtccaggcgatgacggtatgccccagtggccaatcctgctcactggtgatgggtggacggcgctggcctacactcccatcccaaaacgtggagatgcagagatccaggggtggttttattattccgcctacggaattgttgatgttcccacagatctacgggtagagcgtattttcgctggtatcggcacaagtggcaccaacgagcgtttgtggcaggagatagacaatacttcttcggcttatcactcggaagattggtggatccgcgatgtcgttttagacgtcacgttggatggagctgttccgcctccgcttagacgtgacgtcttcactgctgtcgatcctattgtggcgggtgacaaattgtggctgtgtgacgtgcactttccggtagcccgctgctgggagaccacgaccggccgatacttggggcagactttaktcccagcaccactgcgagatcgatcgtacgtccttgagctgcacagcgaccaacaattaggagccgtagcggcaagtgggaagagtggttggattctcacacctggtcaagcagtagccactaaagctcctgattggactcctcccacccgggcaaccgatctgcctcaggtcccctccccctgggagatcgtcgctgtccgtggccaaggtctgtttgagctgcaggtggaaactagtagacgcaccgccctcggtcgagttaatgcgaccggtggcgtcgacatcggtgaactcccgcccaacggctataccatcagttctgtggttcagatcggtgatgaatacatcgtgggcaggtgggtagaggaataccggctcaactccaaactggaggtcatttctaccaaagagctagatatctccgcatccggatggaagagcaaggggacggttgcttatctgtcggaagacactcacatatgtttcttcgaccaggtcagcggggccgagcttcccagcctgggtatcgccgagggacaccagggcgaggttatgtcagcaacttcttcagagagcatcgtgcttatctaccggcgcaacccgaacaattcaatgtcgattgtcccgacttccgttgccacctatgacaatggcacctggacgactatgccgctacaggaagctccagcggaactgtcctaaactgctcatagactgctgag

SEQ ID NO: 70 - protein, 649 aa, Corynebacterium glutamicum
  VARIANT 416: Xaa = Val or Phe
MTLTASSLEAGKMSFSGGYIVGETMIFLVDPDEVEIRRSPNSLHVLRNGSDILRRNEHHCWVFENFNKPIDPPVRLGPRDIICPSALAWVLQQHSISRSLSHHLHADKITAGEIAGRPTWILREEPTSGGQDPSRLVSLEIDQEHGVILAVETGQERLEATEISFPDTLPNPSWDGAWEPFHYPDSTPHTAPDVAEIPGYIQSLPPQSEDPRRLRVFVNEIALEGDFPDYRQGQSVRLTLGISSSPVPLEGMTTRRRGRVRNLGEEASPGDDGMPQWPILLTGDGWTALAYTPIPKRGDAEIQGWFYYSAYGIVDVPTDLRVERIFAGIGTSGTNERLWQEIDNTSSAYHSEDWWIRDVVLDVTLDGAVPPPLRRDVFTAVDPIVAGDKLWLCDVHFPVARCWETTTGRYLGQTLXPAPLRDRSYVLELHSDQQLGAVAASGKSGWILTPGQAVATKAPDWTPPTRATDLPQVPSPWEIVAVRGQGLFELQVETSRRTALGRVNATGGVDIGELPPNGYTISSVVQIGDEYIVGRWVEEYRLNSKLEVISTKELDISASGWKSKGTVAYLSEDTHICFFDQVSGAELPSLGIAEGHQGEVMSATSSESIVLIYRRNPNNSMSIVPTSVATYDNGTWTTMPLQEAPAELS

SEQ ID NO: 71 - DNA, 1458 bp, Corynebacterium glutamicum
  CDS (101)..(1435): RXN00033
acacggatttaacgtgacggtttctcagtgtttttagcttctggcttttggcttctgatgctttagcgctggactcaacatttaaaacaaaggtgaacacatgtcagtacagcaaagcgggttgctcgaacgtctcggcattccccgacccttgattttcggatttatcggcctcaccatcttcatgatcggtgacggtgtcgaaaccaacattttggaacctttcctcagttccgaacatggtttcagcgtttccctcgcgggaaccctggtgactgtttacggtgttgccgtggcgatcgcagcattcttcgcggcggcactttcggacctgtggggtccacgaaaagtgatgatcctcggtgcttcaatctggatcgtctttgagctgatcttcctcaccgtggcactgaccaccgaccatacttggttgatcttccttgcttatggtctccgcggctttggttatccattcttcgcctacggattcttggtgtggatcaccgcaactgcctcacctaagcaattgggtaccggtgtgggttggttctacgttgccttctctgcaggtcttcctaccttgggtgcgctggttgccaccatttccatgcagtacgtgaacttgaccttctatgaaacgttgtgggtttccctcgtgctggtggtcatcggatcgctcatcgcactgctgggagtgaaggaacgtcgcggacgccacccactggttgccaaccccgacgatgtgaagcaaacacttggccagggcttcaaacttctgcgcaatgatcgacgtgcacgttttgtcacctacatccgcaccatcaactccattccgacctacgcgatggctgtgttcttcccatcatttttcactgacgatctgaagtggcagctaagctggttcctcatcctcaccactgtaatttacgcagtcaacctgccgttcaatcctttcttcggtagcttcggcgaccgccacggttgggcacgaactgtgttctggggcggatcaatcggtggcgcagtcaccctcgcgttggtttacttcattccgatgttcggcgttcaggctggcatgtccaacggtgtcgttttcggaatcaccatcgcagccggcgcactctttggtgtgtccctcgcgggcttcgtgccactttccgcaatcgctgtctcccttgatcccaagcaccccggcgcagcgatggccacatacaacctcggcgttggtggcgctgtagctgtgggaccgctcctggttgcagtcttccacccactgattggtccaaccggattgatcctggtcatgatcgccctctacctgctctccggttggatgactcttcaacttcgcggcacccaaccaggattcgacggagtgccagcacttgctgaagacgcccacatcgaagaccttgcagatgtaaacgcaaacgcctaactgtttttcgagctaaaccc

SEQ ID NO: 72 - protein, 445 aa, Corynebacterium glutamicum
MSVQQSGLLERLGIPRPLIFGFIGLTIFMIGDGVETNILEPFLSSEHGFSVSLAGTLVTVYGVAVAIAAFFAAALSDLWGPRKVMILGASIWIVFELIFLTVALTTDHTWLIFLAYGLRGFGYPFFAYGFLVWITATASPKQLGTGVGWFYVAFSAGLPTLGALVATISMQYVNLTFYETLWVSLVLVVIGSLIALLGVKERRGRHPLVANPDDVKQTLGQGFKLLRNDRRARFVTYIRTINSIPTYAMAVFFPSFFTDDLKWQLSWFLILTTVIYAVNLPFNPFFGSFGDRHGWARTVFWGGSIGGAVTLALVYFIPMFGVQAGMSNGVVFGITIAAGALFGVSLAGFVPLSAIAVSLDPKHPGAAMATYNLGVGGAVAVGPLLVAVFHPLIGPTGLILVMIALYLLSGWMTLQLRGTQPGFDGVPALAEDAHIEDLADVNANA

SEQ ID NO: 73 - DNA, 873 bp, Corynebacterium glutamicum
  CDS (101)..(850): RXN00056
atatgaatttaataatagattccgaacgaaatcggtgttagcgtctgtgctgaaacaatctaatcgcgtttcaggacacctacatgatcaggagctctttttgttaaacagagtcagtcgtattgcaggcgcttctgcaatcacactatgcatcggcttaaccacaatactaagccctacttccactgcacaaagcctcgaacagatcacccctttacctgaatctgcaatcgacctcaacgccgagattcacgtaaacacaagcgacatttcagctgaacagatccttggtgctcaagatgaaatcacaactatgtacgattctcatgacccctacgagtacttcgataccctcaccgacatcgaacagcgttcaataatagcagcgcttaaacgggatccgagttcactccaacaacgccaagaaacccgtctcgcggcacagtccgacccctacaaaatttacatatcaggcctcgaaatgctttcatgcatcaatctagttgatgttgtatcatgcgggattgcaaaccaagcagcaaccaaagcaaataatgaggctgtcgcacgatacccaggcgattcccttcgcaacggcaaaggcgatgcatttcggcattgctcatggaacgctctgatgacgatacgaatcgggagcaatggagctgaaagaattgcaacaaaccacgagacaatcggggacggtccggccgatgaaaatgcaatggacctattcaataatgcacaaggccgacagatcggagccggattcattaatagtaaggatgaaactagcgcgctcgcgatatgcgcgctgtggacaaatctcggtagactaaaaactctaaaataagcaaggtgccctctgatgct

SEQ ID NO: 74 - protein, 250 aa, Corynebacterium glutamicum
LLNRVSRIAGASAITLCIGLTTILSPTSTAQSLEQITPLPESAIDLNAEIHVNTSDISAEQILGAQDEITTMYDSHDPYEYFDTLTDIEQRSIIAALKRDPSSLQQRQETRLAAQSDPYKIYISGLEMLSCINLVDVVSCGIANQAATKANNEAVARYPGDSLRNGKGDAFRHCSWNALMTIRIGSNGAERIATNHETIGDGPADENAMDLFNNAQGRQIGAGFINSKDETSALAICALWTNLGRLKTLK

SEQ ID NO: 75 - DNA, 873 bp, Corynebacterium glutamicum; identical to SEQ ID NO: 73
  CDS (101)..(850): FRXA00056

SEQ ID NO: 76 - protein, 250 aa, Corynebacterium glutamicum; identical to SEQ ID NO: 74

SEQ ID NO: 77 - DNA, 609 bp, Corynebacterium glutamicum
  CDS (101)..(586): RXN00067
ggaatcccgcatgttgggctccagttggggactgactctgtttttgatcattttgacgccaatcattattttcctcactttcagctaaaaggaccatgcaatggtagacgctcagcgccccaaagcaggcatcttcggtagccacacagaagaaacatgggtgtggctcggtaatgaacttttcgacgagtccggcgaggtcatcgccgacgttcgctccgacgtcctctacgtggatcgcgaacgactactcatcgaatccacccccggcaccatgcgttttcgttgccgcgcaacactgtccgggggtgaggtctatacgatgactcagaattctttcactgtgggggatctcactgcggtgtgcgggcgccggacgtattcactaaaaagggtgtcgccgtggcgtaaagaacgcctgatcaccaacaatggggtggaagtggcgcggcttcgcccgatgaccagcggtaaagtcgaattcattgtgggcaccgcgggcagcgaggcgttgccgttcgtcgacgcagtatttttgagctgggcgtgcgtcctggtggattcggccgtgcgccggccgaaaatttaaaagctttttgcttatcgacg

SEQ ID NO: 78 - protein, 162 aa, Corynebacterium glutamicum
MVDAQRPKAGIFGSHTEETWVWLGNELFDESGEVIADVRSDVLYVDRERLLIESTPGTMRFRCRATLSGGEVYTMTQNSFTVGDLTAVCGRRTYSLKRVSPWRKERLITNNGVEVARLRPMTSGKVEFIVGTAGSEALPFVDAVFLSWACVLVDSAVRRPKI

SEQ ID NO: 79 - DNA, 609 bp, Corynebacterium glutamicum; identical to SEQ ID NO: 77
  CDS (101)..(586): FRXA00067

SEQ ID NO: 80 - protein, 162 aa, Corynebacterium glutamicum; identical to SEQ ID NO: 78

SEQ ID NO: 81 - DNA, 1485 bp, Corynebacterium glutamicum
  CDS (101)..(1462): RXN00077
ctaaattgttttaacgcgtgaagcagtccccgcccgatttattcgaggcggggactttcgctttccgggataaaaattgcaacgcactacactgagcagtatgaatgatgagaatattcaaagctccaactatcagccattcccgagttttgacgattggaaacagatcgaggtgtcgctcttagatgtcatcgaatcctcacgccatttttctgatttgaaagatagcactgatcgttctgcgttagatgctgcgctagagagagcaaaaagagctgccgcagttgataccaatgccatagaaggaatcttccaaactgatcgcggttttacccatacagttgcaacgcaggtaggggcttgggagcaacaaatggcgatgaaaggcaaacatgttaagcctgcgtttgacgatactctagaaggctttgagtatgttctcgatgcagtaactggtagaactccaatctctcagcaatggattagaaatttgcacgccgtcattctgcggagccaagaaagccacgaggtttttacagccgttggagtccaaaatcaggcgcttcagaaaggcgagtataaaactcagccaaatagtccacagcgctcagatggatctgtacatgcatacgccccagttgaagatactcctgctgaaatggctagatttatttcagaacttgaatctaaggaattcttagcagccgagaaggttattcaagctgcctatgcccactatgctttcgtatgtattcatccttttgcagatgggaatggacgagttgcacgagccttggctagtgtttttctatacaaagatcctggtgtccctctcgtaatctaccaagatcaacgcagagattacatccatgctctagaagcagcggacaagaataacccgctcctgctgattagattctttgctgaacgagtgaccgatactattaactctattatcgttgatctcactaccccgatcgcgggtaaatctggttcggctaagctttcggatgcgctacgccccactcgcgtattaccagaattacatgatgctgcacataggctccaagaaagtttatttacagaaatccgatctcgattggatgaagaaggaaaaaggaatgggttggagtttctacttcaacggatttttatcggttccccattcaatctgccagagggctataacgctttccctgatagctattgtctgaccttagctttcaatagcaactctccaaaacaaatcttccacccgctatccatagtaatagcagctcgagatgggaaaagagcgagcagcgacctcgtggcagctacttctattggatacaactttcacgcttacggacgtgaagtcgagcctgttgttactgaaagctttcgagaacgtgtgaaaatttacgccgacgggattgtagatcacttcttaaccgaactggctaaaaagtttcaacagaattaattagcctatctcggctttcg

SEQ ID NO: 82 - protein, 454 aa, Corynebacterium glutamicum
MNDENIQSSNYQPFPSFDDWKQIEVSLLDVIESSRHFSDLKDSTDRSALDAALERAKRAAAVDTNAIEGIFQTDRGFTHTVATQVGAWEQQMAMKGKHVKPAFDDTLEGFEYVLDAVTGRTPISQQWIRNLHAVILRSQESHEVFTAVGVQNQALQKGEYKTQPNSPQRSDGSVHAYAPVEDTPAEMARFISELESKEFLAAEKVIQAAYAHYAFVCIHPFADGNGRVARALASVFLYKDPGVPLVIYQDQRRDYIHALEAADKNNPLLLIRFFAERVTDTINSIIVDLTTPIAGKSGSAKLSDALRPTRVLPELHDAAHRLQESLFTEIRSRLDEEGKRNGLEFLLQRIFIGSPFNLPEGYNAFPDSYCLTLAFNSNSPKQIFHPLSIVIAARDGKRASSDLVAATSIGYNFHAYGREVEPVVTESFRERVKIYADGIVDHFLTELAKKFQQN

SEQ ID NO: 83 - DNA, 1485 bp, Corynebacterium glutamicum; identical to SEQ ID NO: 81
  CDS (101)..(1462): FRXA00077

SEQ ID NO: 84 - protein, 454 aa, Corynebacterium glutamicum; identical to SEQ ID NO: 82

SEQ ID NO: 85 - DNA, 1653 bp, Corynebacterium glutamicum
  CDS (101)..(1630): RXN00080
atgttcttgtttccctcatgatgagctccgtggtctacctcgcattcgatgtgggcttgggacttaatcttccttccggacttttgggtggtggcttttaatggatattttgtccctcttgatggaaggtttcgccggcgcgctaacgccgatgaacctcctctgggtgattgtcggctgtttgctcggcaccgcggttggcgtcatgcctggtcttggatcctccatggctgtggcgctgctgctgccaatgaccttcgcgcttgatccaactgccgcgttcattatgttctctggcgtatatttcggtggtctcttcggtgactccacgatggcaattttgatgaacaccccaggtcaggcatcggcaatcgcctcaacattcgagggccaccgcatggctcttaacggccgtgcgccacaggctctggctaccgcagcgatcggtgccttcatcggcggtatcgtctcctccttcatcgtggtcttcctcgcaccaaccctggcggaactgtccaccgcattcggccccgccgagtacttcgcactggcactcttcgcgttcgtcgccacctcctccgtggtgtccgactccgtgtttaagggacttgcgtccctcattttcggcctcggcattgcgaccatcggcatcgattcggtcaccggcatcgagcgcttcacgctcggggcaccgcagcttttcgacggaatttccctcgttactgttaccgtcgcgattttggcactgggagaagtgttttacattgcagcccgcgcacgccgtgacaaagcaaatctggagacgcgctctgcaggccgtccgtggcttaccggaacggaattcaaagaagccgctccagcctgggcacgcggaaccatcattggtctgcctttcggtgtgatccctgttggtggatctgaagttccaaccttcttggcttactccaccgagcgcgcattggataaacgacgcaaagatccgcagttcggcgataaaggtgcaatccgaggactcgctgctcctgaagctgcaggtaacgccaccacaggcatggcgatgggcgctcttcttgccctgggtctcccagtctctgcaactgcggccatcatgttggcagcgttccgccagtacggaatccagcccggaccactactcttcgatcgcaaccctgaacttgtctgggcacttcttgccagcttcttcatcgcgatgatcgtcctgctgttcatcaacctgccgttcgcacagctgtgggcaaagctcctgctcattccaaaccactacctctactccggcatcgcattgttctgtggcctgggcatttacgccacctccggcgcagtgttcgacctgctcatgctgctcggcatcggtgtcgtggctttgatcatgcgtcgctacggttacccgctggcaccgctgatgatcggtatggttcttggacctttggctgaaacctccctccgcgacgcactactgtcctcggttggcgatttctccatcctcgtctccagccccatcacctggtctctctacgcagtgctcgccatcttcatcgcggtcagtgtcatcactgcaatccgcggtcgtcgcaagcacctgacttctcagctcgaaaccatcgacgcttaaagtccccgtatagaaacagg

SEQ ID NO: 86 - protein, 510 aa, Corynebacterium glutamicum
MDILSLLMEGFAGALTPMNLLWVIVGCLLGTAVGVMPGLGSSMAVALLLPMTFALDPTAAFIMFSGVYFGGLFGDSTMAILMNTPGQASAIASTFEGHRMALNGRAPQALATAAIGAFIGGIVSSFIVVFLAPTLAELSTAFGPAEYFALALFAFVATSSVVSDSVFKGLASLIFGLGIATIGIDSVTGIERFTLGAPQLFDGISLVTVTVAILALGEVFYIAARARRDKANLETRSAGRPWLTGTEFKEAAPAWARGTIIGLPFGVIPVGGSEVPTFLAYSTERALDKRRKDPQFGDKGAIRGLAAPEAAGNATTGMAMGALLALGLPVSATAAIMLAAFRQYGIQPGPLLFDRNPELVWALLASFFIAMIVLLFINLPFAQLWAKLLLIPNHYLYSGIALFCGLGIYATSGAVFDLLMLLGIGVVALIMRRYGYPLAPLMIGMVLGPLAETSLRDALLSSVGDFSILVSSPITWSLYAVLAIFIAVSVITAIRGRRKHLTSQLETIDA

SEQ ID NO: 87 - DNA, 543 bp, Corynebacterium glutamicum
  CDS (101)..(520): FRXA00080
ttggcagcgttccgccagtacggaatccagcccggaccactactcttcgatcgcaaccctgaacttgtctgggcacttcttgccagcttctttcatcgcgatgatcgtcctgctgttcatcaacctgccgttcgcacagctgtgggcaaagctcctgctcattccaaaccactacctctactccggcatcgcattgttctgtggcctgggcatttacgccacctccggcgcagtgttcgacctgctcatgctgctcggcatcggtgtcgtggctttgatcatgcgtcgctacggttacccgctggcaccgctgatgatcggtatggttcttggacctttggctgaaacctccctccgcgacgcactactgtcctcggttggcgatttctccatcctcgtctccagccccatcacctggtctctctacgcagtgctcgccatcttcatcgcggtcagtgtcatcactgcaatccgcggtcgtcgcaagcacctgacttctcagctcgaaaccatcgacgcttaaagtccccgtatagaaacagg

SEQ ID NO: 88 - protein, 140 aa, Corynebacterium glutamicum
MIVLLFINLPFAQLWAKLLLIPNHYLYSGIALFCGLGIYATSGAVFDLLMLLGIGVVALIMRRYGYPLAPLMIGMVLGPLAETSLRDALLSSVGDFSILVSSPITWSLYAVLAIFIAVSVITAIRGRRKHLTSQLETIDA

SEQ ID NO: 89 - DNA, 651 bp, Corynebacterium glutamicum
  CDS (101)..(628): RXN00087
tcgtcagtcaacaaacgttttcccacccggaggtctccccgtgtctaccgaaatccacaacgccccacccaaggccccaacttggcttggctgggtgctcatgatcggcggaataatcggcctcattttgtcggtgatcatcatggccgaaaaacttgccatcctcgaggatcccggtcacatcaccagctgcgatttcaatgcagtcctagcttgtggcgatgtcatgcgttccggccaagctaacgcgttcggcatcccgaatccgctcatcggcatcgccggtttcgccgctgtcgccatcatcggcgccggcatcctcgcgggcggcgggttccgcggttggttctggttcggcgcccaggccggactcacttttgccatgatgttctgccactggctcgcctaccaatccatgtccgtcatccgcgcgctctgcccttactgcatgggcgtgtggaccgtatcgatcatcatgttcgtgctggtcactgcatggaatgtgaaaactttcagcggctccgacagcacgttcgtcaacgcactgtacaaatacaagtgggtcatcgcgatcgtctggctgctgctcatcgcagccgcagctgtgtggtcattccgctacatgttctaggcatttaaggctttcaggcc

SEQ ID NO: 90 - protein, 176 aa, Corynebacterium glutamicum
MIGGIIGLILSVIIMAEKLAILEDPGHITSCDFNAVLACGDVMRSGQANAFGIPNPLIGIAGFAAVAIIGAGILAGGGFRGWFWFGAQAGLTFAMMFCHWLAYQSMSVIRALCPYCMGVWTVSIIMFVLVTAWNVKTFSGSDSTFVNALYKYKWVIAIVWLLLIAAAAVWSFRYMF

SEQ ID NO: 91 - DNA, 651 bp, Corynebacterium glutamicum; identical to SEQ ID NO: 89
  CDS (101)..(628): FRXA00087

SEQ ID NO: 92 - protein, 176 aa, Corynebacterium glutamicum; identical to SEQ ID NO: 90

SEQ ID NO: 93 - DNA, 426 bp, Corynebacterium glutamicum
  CDS (101)..(403): RXN00096
ggggaacctggggtaaaaggagaagtattcattaccccaataacctactaggtggggtggacacgcatagtcgacagccagacgtggcagaatagtgtgcatgactaatgcaggtgacaacttcgagatcaggatgccttctggcacggatgacccattgtccgatgcggagatccaaaagtatcgcgaggagatcaaccgcttggaccgcgaaatcctcgatgcggtgaaacgccgcacgaagatttcccaaaccatcggaaaaacacgcatgagctcgggcggaacacgtctcgtgcacacccgagaagtagcaatcatcaaccaattccgtgaagagatcggcgaggaaggccctgccctcgctggaattttgctgcgcatgggacgcggaaaactcggataagttatccacaggtagaaaaa

SEQ ID NO: 94 - protein, 101 aa, Corynebacterium glutamicum
MTNAGDNFEIRMPSGTDDPLSDAEIQKYREEINRLDREILDAVKRRTKISQTIGKTRMSSGGTRLVHTREVAIINQFREEIGEEGPALAGILLRMGRGKLG

SEQ ID NO: 95 - DNA, 426 bp, Corynebacterium glutamicum
  CDS (101)..(403): FRXA00096
ggggaacctggggtaaaaggagaagtattcattaccccaataacctactaggtggggtggacacgcatagtcgacagccagacgtggcagaatagtgtgcatgactaatgcaggtgacaacttcgagatcaggatgccttctggcacggatgacccattgtccgatgcggagatccaaaagtatcgcgaggagatcaaccgcttggaccgcgaaatcctcgatgcggtgaaacgccgcacgaagatttcccaaaccatcggaaaaacacgcatgagctcgggcggaacacgtctcgtgcacacccgagaagtagcaatcatcaaccagttccgtgaagagatcggcgaggaaggccctgccctcgctggaattttgctgcgcatgggacgcggaaaactcggataagttatccacaggtagaaaaa

SEQ ID NO: 96 - protein, 101 aa, Corynebacterium glutamicum; identical to SEQ ID NO: 94

SEQ ID NO: 97 - DNA, 1299 bp, Corynebacterium glutamicum
  CDS (101)..(1276): RXN00097
tcagggttttagccgttgatgggcagagttatccacaggtttttagcgagctggtttccgacgaagaaaatagtggataggttacagggcagaatcccgaatggaggtgccttccttgtttaccaacttcttcgcagtcaacaacccagacagtccgcccgcacgacaaaaaaccaaactcagagaactggaacaccgcttctggcaagaacacctgccaggcgacgacgatgaccattccaccgcaatctccagcctcgccatcgtcacaggtctaacaaaagcgcaggtctcccgcatatccatcgcgtttgccacgctcgccgacttgcccgaactcaaagccctgcaacaaaagctgtaccacctcgacctctcccgactgatcaccattagcaacgaactcgccggcatcaaccccgacaacctcgccggcgccgacgcaatcctcaccgaatacctcaccgccaccagccccaaccagattctgccaagcccggcgtccataggacgcaagataaaagaaataagagatttgcttgacgacgcaagagccaccggttcgcgcggtacccaagacgacagctctttcggagtgaccttctccccagacggaaccgccgaaatcggagcctccgtcgatgctgtggacgggcacatcatcaacgacgccgtcacccaacacgcgaagaaaaacgacctcacctacggcgaagctttcagcgacatccttcggaacaatatccaagtcaaggtagtcctcaacttgtacaccgccaaagacctcgccaacgccccagtgtgggccagcggaatcggctggttggatgccaagactggaacattctggtcagagaaagccaacaaagaacaagacatggatgcggctgccaaaatcagcaccgacaaacacgatcctccaccagcgttgcgtgacgcactcattggtcgtgatggcacctgccgattccctggctgttcagtcccagcgctcaaaacccaagccgaccaccgcatcccctacgaagaaggcggagaaacttgcctaggcggaatcggctgcctctgtcaacaccaccacaacatgaaaaccgacggccgagtcacctaccttctcgatcccttctccggcatcatcgtctggctcatgggagacggaacatgggcagtgtcagaacccaacgggccgctcaatcccaaaaatgcgagatgggcgcaaacagtcgcccaacaccgggcacgccaccacaagcgttgggttaaggaggacgccaagtagccggatggccacgtcgaaaa

SEQ ID NO: 98 - protein, 392 aa, Corynebacterium glutamicum
MEVPSLFTNFFAVNNPDSPPARQKTKLRELEHRFWQEHLPGDDDDHSTAISSLAIVTGLTKAQVSRISIAFATLADLPELKALQQKLYHLDLSRLITISNELAGINPDNLAGADAILTEYLTATSPNQILPSPASIGRKIKEIRDLLDDARATGSRGTQDDSSFGVTFSPDGTAEIGASVDAVDGHIINDAVTQHAKKNDLTYGEAFSDILRNNIQVKVVLNLYTAKDLANAPVWASGIGWLDAKTGTFWSEKANKEQDMDAAAKISTDKHDPPPALRDALIGRDGTCRFPGCSVPALKTQADHRIPYEEGGETCLGGIGCLCQHHHNMKTDGRVTYLLDPFSGIIVWLMGDGTWAVSEPNGPLNPKNARWAQTVAQHRARHHKRWVKEDAK

SEQ ID NO: 99 - DNA, 1284 bp, Corynebacterium glutamicum
  CDS (101)..(1261): FRXA00097
ttgatgggcagagttatccacaggtttttagcgagctggtttccgacgaagaaaatagtggataggttacagggcagaatcccgaatggaggtgccttccttgtttaccaacttcttcgcagtcaacaacccagacagtccgcccgcacgacaaaaaaccaaactcagagaactggaacaccgcttctggcaagaacacctgccaggcgacgacgatgaccattccaccgcaatctccagcctcgccatcgtcacaggtctaacaaaagcgcaggtctcccgcatatccatcgcgtttgccacgctcgccgacttgcccgaactcaaagccctgcaacaaaagctgtaccacctcgacctctcccgactgatcaccattagcaacgaactcgccggcatcaaccccgacaacctcgccggcgccgacgcaatcctcaccgaatacctcaccgccaccagccccaaccagattctgccaagcccggcgtccataggacgcaagataaaagaaataagagatttgcttgacgacgcaagagccaccggttcgcgcggtacccaagacgacagctctttcggagtgaccttctccccagacggaaccgccgaaatcggagcctccgtcgatgctgtggacgggcacatcatcaacgacgccgtcacccaacacgcgaagaaaaacgacctcacctacggcgaagctttcagcgacatccttcggaacaatatccaagtcaaggtagtcctcaacttgtacaccgccaaagacctcgccaacgccccagtgtgggccagcggaatcggctggttggatgccaagactggaacattctggtcagagaaagccaacaaagaacaagacatggatgcggctgccaaaatcagcaccgacaaacacgatcctccaccagcgttgcgtgacgcactcattggtcgtgatggcacctgccgattccctggctgttcagtcccagcgctcaaaacccaagccgaccaccgcatcccctacgaagaaggcggagaaacttgcctaggcggaatcggctgcctctgtcaacaccaccacaacatgaaaaccgacggccgagtcacctaccttctcgatcccttctccggcatcatcgtctggctcatgggagacggaacatgggcagtgtcagaacccaacgggccgctcaatcccaaaaatgcgagatgggcgcaaacagtcgcccaacaccgggcacgccaccacaagcgttgggttaaggaggacgccaagtagccggatggccacgtcgaaaa

SEQ ID NO: 100 - protein, 387 aa, Corynebacterium glutamicum
LFTNFFAVNNPDSPPARQKTKLRELEHRFWQEHLPGDDDDHSTAISSLAIVTGLTKAQVSRISIAFATLADLPELKALQQKLYHLDLSRLITISNELAGINPDNLAGADAILTEYLTATSPNQILPSPASIGRKIKEIRDLLDDARATGSRGTQDDSSFGVTFSPDGTAEIGASVDAVDGHIINDAVTQHAKKNDLTYGEAFSDILRNNIQVKVVLNLYTAKDLANAPVWASGIGWLDAKTGTFWSEKANKEQDMDAAAKISTDKHDPPPALRDALIGRDGTCRFPGCSVPALKTQADHRIPYEEGGETCLGGIGCLCQHHHNMKTDGRVTYLLDPFSGIIVWLMGDGTWAVSEPNGPLNPKNARWAQTVAQHRARHHKRWVKEDAK

SEQ ID NO: 101 - DNA, 612 bp, Corynebacterium glutamicum
  CDS (101)..(589): RXN00114
tgcattccctaacgggaatgcagctttttgtgttcctagtgcaaatcgaaatctcatgtgatttacttaaaacctaattaaatctactatcggagatctcatgaaacttctcaagtttgctgcagcaggaaccttcgcactagccctggctggctgcacacagactgagtctctcgtagcaacaatcgaatctgcaacctctgcagcacaggcatccggaaacgacgtagaaggagaccaaacctccgcgttcgaactctccgttggcgaatgcttcaacgacacctacgaagaagaaatctccgaagtacccatcgtcgactgcgcagaacctcacgacaacgagatctactacctctacgacatcgaaggcgacgacttcccaaccgacatcaccaccacaggctacgaaggctgcctcccaacatttgaaggcttcgtaggagctccttacgaaacctccatctacgaggtctacccaatgaccccaacctttggctcctggacaaacggcgaccgcgaggtagtgtgctccgtgtacttggccaccggtgagcagatgaccggaaccgcagcaggaaccgcgcagtagattttggatagggaattttg

SEQ ID NO: 102 - protein, 163 aa, Corynebacterium glutamicum
MKLLKFAAAGTFALALAGCTQTESLVATIESATSAAQASGNDVEGDQTSAFELSVGECFNDTYEEEISEVPIVDCAEPHDNEIYYLYDIEGDDFPTDITTTGYEGCLPTFEGFVGAPYETSIYEVYPMTPTFGSWTNGDREVVCSVYLATGEQMTGTAAGTAQ

SEQ ID NO: 103 - DNA, 612 bp, Corynebacterium glutamicum; identical to SEQ ID NO: 101
  CDS (101)..(589): FRXA00114

SEQ ID NO: 104 - protein, 163 aa, Corynebacterium glutamicum; identical to SEQ ID NO: 102

SEQ ID NO: 105 - DNA, 963 bp, Corynebacterium glutamicum
  CDS (101)..(940): RXN00120
acaaactcttaatttaatgagacgtaagtagttgatagttaggggaaatactcccaaatcctcacaggaaacgctctgaattctttcaaaaaaatgtttcatgcttattggcatgagcaatcaaacagtcaatcaagcagtgtcgtcaggggtgaaagcatccccgcacaggttcaatcgttttgaaatcaaatacttgattacagagcaagatgtacctgcactccgcgagcagttggcaacgaggatgagcacggatccgctttccccacccggaggctaccgagtggaatccctttacttcgattcagccgatttacggtgctacaccgaaaagatcgagggtctgaaattccgaaggaaactacggatccgtacctacggtgatggagtgctcactccagaatccaccgtgtcggtagagatcaagcagcgggttaacaaagtaactcaaaagcgtcggctggatttgccctttatatatgcgctcgccctgggcgatagcacgggcgccgcggtaggcgagcaggtggacgtcgagaagcttcttgaaatctctccggaaaaccagcacgctttgattcacgaaatggcgtcgtttgctaaaaattatcggctgcgacccatcgccaccacgaagtatcaccgcgaggcattcgtcggcgctgatgcggaggaaagttcgcgagtcaccattgaccacggtgtttcaggccgtgatcgtgattttctgcttggccaagaccttgaagaccgcccaacggtggcgcaaggattggcagtcgtggaaatcaaatgcgatgaacgcgtgccgttttggctcactgatatgactgctcaactggaaatgtccgtgattcggatgtccaaatactgcgaaaccatcgaagcgtttcacaaccgtccggcatcagctttcggcgctgtcgaccccatcttctaaacaagaaaggcccctccaat

SEQ ID NO: 106 - protein, 280 aa, Corynebacterium glutamicum
MLIGMSNQTVNQAVSSGVKASPHRFNRFEIKYLITEQDVPALREQLATRMSTDPLSPPGGYRVESLYFDSADLRCYTEKIEGLKFRRKLRIRTYGDGVLTPESTVSVEIKQRVNKVTQKRRLDLPFIYALALGDSTGAAVGEQVDVEKLLEISPENQHALIHEMASFAKNYRLRPIATTKYHREAFVGADAEESSRVTIDHGVSGRDRDFLLGQDLEDRPTVAQGLAVVEIKCDERVPFWLTDMTAQLEMSVIRMSKYCETIEAFHNRPASAFGAVDPIF

SEQ ID NO: 107 - DNA, 777 bp, Corynebacterium glutamicum
  CDS (101)..(754): FRXA00120
aatcaaatacttgattacagagcaagatgtacctgcactccgcgagcagttggcaacgaggatgagcacggatccgctttccccacccggaggctaccgagtggaatccctttacttcgattcagccgatttacggtgctacaccgaaaagatcgagggtctgaaattccgaaggaaactacggatccgtacctacggtgatggagtgctcactccagaatccaccgtgtcggtagagatcaagcagcgggttaacaaagtaactcaaaagcgtcggctggatttgccctttatatatgcgctcgccctgggcgatagcacgggcgccgcggtaggcgagcaggtggacgtcgagaagcttcttgaaatctctccggaaaaccagcacgctttgattcacgaaatggcgtcgtttgctaaaaattatcggctgcgacccatcgccaccacgaagtatcaccgcgaggcattcgtcggcgctgatgcggaggaaagttcgcgagtcaccattgaccacggtgtttcaggccgtgatcgtgattttctgcttggccaagaccttgaagaccgcccaacggtggcgcaaggattggcagtcgtggaaatcaaatgcgatgaacgcgtgccgttttggctcactgatatgactgctcaactggaaatgtccgtgattcggatgtccaaatactgcgaaaccatcgaagcgtttcacaaccgtccggcatcagctttcggcgctgtcgaccccatcttctaaacaagaaaggcccctccaat

SEQ ID NO: 108 - protein, 218 aa, Corynebacterium glutamicum
VESLYFDSADLRCYTEKIEGLKFRRKLRIRTYGDGVLTPESTVSVEIKQRVNKVTQKRRLDLPFIYALALGDSTGAAVGEQVDVEKLLEISPENQHALIHEMASFAKNYRLRPIATTKYHREAFVGADAEESSRVTIDHGVSGRDRDFLLGQDLEDRPTVAQGLAVVEIKCDERVPFWLTDMTAQLEMSVIRMSKYCETIEAFHNRPASAFGAVDPIF

SEQ ID NO: 109 - DNA, 1827 bp, Corynebacterium glutamicum
  CDS (101)..(1804): RXN00128
ccattttccgtttggtcttgcctaaagaaccgcatggaaattatcgtgaagcaccgatcccgttgatcgctccagagacaccgtgggaaggggagcagcagtgagtaaaatttcgacgaaactgaaggccctcaccgcggtgctgtctgtgaccactctggtggctgggtgttccacgcttccgcagaacacggatccgcaagtgctgcgctcattttccgggtcccaaagcacacaagagatagcagggccgaccccgaatcaagatccggatttgttgatccgcggcttcttcagcgcaggtgcgtatccgactcagcagtatgaagcggcgaaggcgtatctgacggaagggacgcgcagcacgtggaatccggctgcgtcgactcgtattttggatcgcattgatctgaacactctgccaggttcgacgaatgcggaacgaacgattgcgatccgtggaacgcaggtcggaacgttgctcagcggtggcgtgtatcagccggagaatgcggagtttgaagctgagatcacgatgcgtcgggaagatggggagtggcgtatcgatgctttgccggacgggattttattagagagaaacgatctgcggaaccattacactccgcacgatgtgtatttctttgatccttctggccaggtgttggtgggggatcggcgttggttgttcaatgagtcgcagtcgatgtccacggtgctgatggcccttctggttaatggtccttcgccggcaatttctcctggtgtggtcaatcagctgtccacggatgcgtcgttcgtggggttcaatgatggggagtatcagttcactggtttgggaaatttggatgatgatgcgcgtttgcgtttcgccgcccaggccgtgtggacgttggcgcatgctgatgtcgcaggcccctacactttggtcgctgacggcgcgccgttgctgtcggagttcccaacgctcaccaccgatgacctcgccgaatacaacccagaggcttacaccaacacggtgtccacgttgtttgcgttgcaggatggatcgttgtcgagggtcagttccggcaatgtgagtccactacagggcatttggagcggtggagatatcgattctgcagcgatttcctcctccgccaatgtggtggcagcggtacgccacgaaaacaacgaggcagtgcttactgttggctccatggaaggcgtgacttcagatgcgttgaggagtgaaacgatcactcgtcccacctttgaatacgcgtcgagtgggttgtgggctgtggtggatggggagacgcctgtccgagtcgcacgatcggcaacaaccggtgagctcgtccagacggaggcggagattgtgctgccaagggatgtgacgggtccgatctctgaattccaactgtcacgaactggggtccgggccgccatgatcattgaaggcaaggtgtacgtgggcgtcgtaacgcgtcctggtccgggcgagcggcgcgtgacaaatatcacggaggtggcgccgagcttgggcgaggcggcgctgtcgatcaactggcgcccagacggcattttgcttgtgggcacgtcaattccagagacgccgctgtggcgcgtcgagcaggacggatcggcgatttcgtcgatgccgagcgggaatctcagcgcgccggtggtggcggtggcaagttccgcgacgacggtctacgtcactgattcgcatgcgatgcttcagctgccgactgccgataatgatatttggcgcgaggtgcccggtttgctgggcacgcgtgcggcgccggtggttgcgtactgatggagctgttcttcccgcgc

SEQ ID NO: 110 - protein, 568 aa, Corynebacterium glutamicum
VSKISTKLKALTAVLSVTTLVAGCSTLPQNTDPQVLRSFSGSQSTQEIAGPTPNQDPDLLIRGFFSAGAYPTQQYEAAKAYLTEGTRSTWNPAASTRILDRIDLNTLPGSTNAERTIAIRGTQVGTLLSGGVYQPENAEFEAEITMRREDGEWRIDALPDGILLERNDLRNHYTPHDVYFFDPSGQVLVGDRRWLFNESQSMSTVLMALLVNGPSPAISPGVVNQLSTDASFVGFNDGEYQFTGLGNLDDDARLRFAAQAVWTLAHADVAGPYTLVADGAPLLSEFPTLTTDDLAEYNPEAYTNTVSTLFALQDGSLSRVSSGNVSPLQGIWSGGDIDSAAISSSANVVAAVRHENNEAVLTVGSMEGVTSDALRSETITRPTFEYASSGLWAVVDGETPVRVARSATTGELVQTEAEIVLPRDVTGPISEFQLSRTGVRAAMIIEGKVYVGVVTRPGPGERRVTNITEVAPSLGEAALSINWRPDGILLVGTSIPETPLWRVEQDGSAISSMPSGNLSAPVVAVASSATTVYVTDSHAMLQLPTADNDIWREVPGLLGTRAAPVVAY

SEQ ID NO: 111 - DNA, 1827 bp, Corynebacterium glutamicum; identical to SEQ ID NO: 109
  CDS (101)..(1804): FRXA00128

SEQ ID NO: 112 - protein, 568 aa, Corynebacterium glutamicum; identical to SEQ ID NO: 110

SEQ ID NO: 113 - DNA, 966 bp, Corynebacterium glutamicum
  CDS (101)..(943): RXN00154
tagccagacggcagtattttgaagcggtgaataaacgtttgctcgaatttccatagtgttagggaagtgtagtgcagtgctttgactagggtggtgagctatgagtttttcagacccctatgcaggcaatatttttggtggacactcccgcaacaagcagccggagtatcccgatgtgcccgcaaaaccaggccttgtggtggaagttcgtggagatggcttcgtcggcgctgtgaccggttttgaacgcacctacgatggtgattttgtgcgtctcgaggaccgccgcggacgcgatgcgctgtacaagctgcgcaagggtgcgttcatgattgatgggcagatcgttaacctcacccgtttcgtggaaaaacaagcaccacgtaaatctaattctggttccaggcgtgtagaaaacgcgcaagcaaaggtcgcggcgccgtcacgcatctgggtagaaggcatccatgacgccgccatcgtggagaaagtgtggggacacgaccttcgcgttgagggcgtcgtggtggagtacctggaaggtctagacaacctggaggaacgtctcgcggaatttcagcctgggcctggacgacgcatcggagtgctcgctgatcaccttgttgagggatctaaagaaactcggatgactaaatcactacccgcggatgtcgctgtcaccggccacccctacatcgatatttgggctgctgtgaaaccagagcgtttggggcttaaggcgtggcctgaggtgccatacggggaggattggaaaaccggcatctgcaaacgagttggctggtcagaccccaaagaaggctggcaccgtgtgtataacgccgtgaattccttccgcgatttggactacaccctaattggggcagtggaacgtttggtggattttgtgaccaacctcgatttgagtaaagaggacgtcctcgcctgatttttcgggtgtgtttttgc

SEQ ID NO: 114 - protein, 281 aa, Corynebacterium glutamicum
MSFSDPYAGNIFGGHSRNKQPEYPDVPAKPGLVVEVRGDGFVGAVTGFERTYDGDFVRLEDRRGRDALYKLRKGAFMIDGQIVNLTRFVEKQAPRKSNSGSRRVENAQAKVAAPSRIWVEGIHDAAIVEKVWGHDLRVEGVVVEYLEGLDNLEERLAEFQPGPGRRIGVLADHLVEGSKETRMTKSLPADVAVTGHPYIDIWAAVKPERLGLKAWPEVPYGEDWKTGICKRVGWSDPKEGWHRVYNAVNSFRDLDYTLIGAVERLVDFVTNLDLSKEDVLA

SEQ ID NO: 115 - DNA, 966 bp, Corynebacterium glutamicum; identical to SEQ ID NO: 113
  CDS (101)..(943): FRXA00154

SEQ ID NO: 116 - protein, 281 aa, Corynebacterium glutamicum; identical to SEQ ID NO: 114

SEQ ID NO: 117 - DNA, 477 bp, Corynebacterium glutamicum
  CDS (101)..(454): RXN00162
ggagacgtcgaaaagcataaacctggaacttttccgggcccgcgcccgactgctttgctgaagccctatcccgctattttatttttgaaggaagagttgcgtgtctaccaccaccccaatccaccctgagcgcaagaaacgcgttcgtcaggccctcaccatgttctccatcgctgcgtgggtgactggtgtgtttttgctggcgctggtggcggagatgatcatgaagtacataattggcatggatcttcctgagtgggcacgattcgttccgattgcacatggatgggtttacattgttttcttgatgaccaccctgaacctgggtctgaaggcgcgttggaatccgactcgttgggtgaccaccgctatcgcaggtgtggttccgctgctgtcgttttttgttgagcacaaccgccgcaaggaagttactcagacattccagctgaactcatagttaaatacacaaaaacctcc

SEQ ID NO: 118 - protein, 118 aa, Corynebacterium glutamicum
VSTTTPIHPERKKRVRQALTMFSIAAWVTGVFLLALVAEMIMKYIIGMDLPEWARFVPIAHGWVYIVFLMTTLNLGLKARWNPTRWVTTAIAGVVPLLSFFVEHNRRKEVTQTFQLNS

SEQ ID NO: 119 - DNA, 477 bp, Corynebacterium glutamicum; identical to SEQ ID NO: 117
  CDS (101)..(454): FRXA00162

SEQ ID NO: 120 - protein, 118 aa, Corynebacterium glutamicum; identical to SEQ ID NO: 118

SEQ ID NO: 121 - DNA, 621 bp, Corynebacterium glutamicum
  CDS (101)..(598): RXN00167
ccgacaatccagtggaacttccctatcgctgtgatgcatttttactttcacgttccggtaccctggcaggcagatcttccaatctttaggagccctcgccatgtacctgttgaatccaccagtcactgaacccgagatcctcactgtcaacgagattccgaccgtcgtcgctgtctttgacaaccaccccatgaacgacatgcccgcagcattcgatcaaacctaccaagtgctcttccccaccttgggtgccaagggcatcgcgccaattggccccggatttgctctgtacacctccgaaccaactgacaccgtcagctttgaagtgggcatcccagtcagccaaccacttgagggagatgtttcagccgccagcggcatcgtgctgaaaaactcagtggtccctgccggaaaaattgcgcgaatcagccacatcggctcattcgacggactgagccaagcatggggttcattcgtggaagctcttgaatctgcaggccatgagatcgatatgccgtgttgggaggtatatgtcaccgagccttcccccgacatggatcccgcaacactccaaactgatctatacgtcctgttgaagtagagaagctttctggtcaagtt

SEQ ID NO: 122 - protein, 166 aa, Corynebacterium glutamicum
MYLLNPPVTEPEILTVNEIPTVVAVFDNHPMNDMPAAFDQTYQVLFPTLGAKGIAPIGPGFALYTSEPTDTVSFEVGIPVSQPLEGDVSAASGIVLKNSVVPAGKIARISHIGSFDGLSQAWGSFVEALESAGHEIDMPCWEVYVTEPSPDMDPATLQTDLYVLLK

SEQ ID NO: 123 - DNA, 361 bp, Corynebacterium glutamicum
  CDS (101)..(361): FRXA00167
ccgacaatccagtggaacttccctatcgctgtgatgcatttttactttcacgttccggtaccctggcaggcagatcttccaatctttaggagccctcgccatgtacctgttgaatccaccagtcactgaacccgagatcctcactgtcaacgagattccgaccgtcgtcgctgtctttgacaaccaccccatgaacgacatgcccgcagcattcgatcaaacctaccaagtgctcttccccaccttgggtgccaagggcatcgcgccaattggccccggatttgctctgtacacctccgaaccaactgacaccgtcagctttgaagtgggcatgccagtcagccaaccacttgagggagag

SEQ ID NO: 124 - protein, 87 aa, Corynebacterium glutamicum
MYLLNPPVTEPEILTVNEIPTVVAVFDNHPMNDMPAAFDQTYQVLFPTLGAKGIAPIGPGFALYTSEPTDTVSFEVGMPVSQPLEGE

SEQ ID NO: 125 - DNA, 281 bp, Corynebacterium glutamicum
  CDS (1)..(258): RXN00171
aaagatcagcagaagcagattcataacttggcagctgaggtaaagcgtcttcgtgagcgtgacgatgcacgagatcagcagctaggagtgcttaatgaagccatgttttcactactaggagatggacttgaccgttttcgtgaatctggcgatgaggcatccttcaatgctgcattgaactatcaggcagtggtggcaccagaaatgtttaagaccgtgtatggtgtcgatccgtctaccggagagcctattcccacttaaagtacaacacagtcttttca

SEQ ID NO: 126 - protein, 86 aa, Corynebacterium glutamicum
KDQQKQIHNLAAEVKRLRERDDARDQQLGVLNEAMFSLLGDGLDRFRESGDEASFNAALNYQAVVAPEMFKTVYGVDPSTGEPIPT

SEQ ID NO: 127 - DNA, 354 bp, Corynebacterium glutamicum
  CDS (101)..(331): FRXA00171
cgattaaggtaggggccttaaaaaggggaataaagaatattgggcccagacgaaaactgctggcgagatcatcaaagatcagcagaagcagattcataacttggcagctgaggtaaagcgtcttcgtgagcgtgacgatgcacgagatcagcagctaggagtgcttaatgaagccatgttttcactactaggagatggacttgaccgttttcgtgaatctggcgatgaggcatccttcaatgctgcattgaactatcaggcagtggtggcaccagaaatgtttaagaccgtgtatggtgtcgatccgtctaccggagagcctattcccacttaaagtacaacacagtcttttca

SEQ ID NO: 128 - protein, 77 aa, Corynebacterium glutamicum
LAAEVKRLRERDDARDQQLGVLNEAMFSLLGDGLDRFRESGDEASFNAALNYQAVVAPEMFKTVYGVDPSTGEPIPT

SEQ ID NO: 129 - DNA, 564 bp, Corynebacterium glutamicum
  CDS (101)..(541): RXN00194
aaatatgagaacatagtgagagttaaaccaagttctgtaggtgcttgttgcagcgggcgcgaaggcgtaccactgcaacttgcgaataaaggagtaaaacgtggctggttcctcccacacgattgagcctgagatctaccgcggtgtatccacccttgatgagccttcggctgcatggggatggcacggtctcaagcgcaacaccatccaactcgctggctggatttccgttctgttcatgcttggatacaacttcggtaaccacaagggccacgttgaaaccatctggcttctcgtcatcaccgcccttctggtcatcggcctgctgatccacctgttcgagccaaagctcttccaggttcgcaccatcacttcccgcaacaagcctgtcggccacgtcgagccagactggacctacgaccaggcaaccctcaccggcacctggggtaacctcactgactcccagcttcgctccgtcaacatcgagccaagccgtgtcgctcacctgcgtgctgcagattctgcgaaagaactagacaactagttttttaaaaagaaaatgcg

SEQ ID NO: 130 - protein, 147 aa, Corynebacterium glutamicum
VAGSSHTIEPEIYRGVSTLDEPSAAWGWHGLKRNTIQLAGWISVLFMLGYNFGNHKGHVETIWLLVITALLVIGLLIHLFEPKLFQVRTITSRNKPVGHVEPDWTYDQATLTGTWGNLTDSQLRSVNIEPSRVAHLRAADSAKELDN

SEQ ID NO: 131 - DNA, 385 bp, Corynebacterium glutamicum
  CDS (101)..(385): FRXA00194
aaatatgagaacatagtgagagttaaaccaagttctgtaggtgcttgttgcagcgggcgcgaaggcgtaccactgcaacttgcgaataaaggagtaaaacgtggctggttcctcccacacgattgagcctgagatctaccgcggtgtatccacccttgatgagccttcggctgcatggggatggcacggtctcaagcgcaacaccatccaactcgctggctggatttccgttctgttcatgcttggatacaacttcggtaaccacaagggccacgttgaaaccatctggcttctcgtcatcaccgcccttctggtcatcggcctgctgatccacctgttcgagccaaaagctcttccaggttcgcaccatcacttctcgcaacaa

SEQ ID NO: 132 - protein, 95 aa, Corynebacterium glutamicum
VAGSSHTIEPEIYRGVSTLDEPSAAWGWHGLKRNTIQLAGWISVLFMLGYNFGNHKGHVETIWLLVITALLVIGLLIHLFEPKALPGSHHHFSQQ

SEQ ID NO: 133 - DNA, 1335 bp, Corynebacterium glutamicum
  CDS (101)..(1312): RXN00197
gtcgatgatattttggcaaccgaatctgaggcacgcgcgcgtgcgaatgctttgatcaaccggttggcaaccaacttgtaagctaaggagcttccgcctcgtggcagcctatcttcttggtgtcgtattatttttcctcggcatcgcagtaaccatcgcgcttcacgagtgggggcacttcatcacagcgcgcattttcggaatgaaagtgcggcgtttcttcatcggtttcggcccgacggtgtttgccaaaagacgcggcgaaaccgtgtacggccttaaagcgattccggtcggcggtttttgtgacatcgcggggatgactgcccaagatgaacttgatccggaagacctgccgcgcgccatgtatctaaagccctggtggcagcgcataattgtgctttccggcggcgtgatcatgaatctgatcgtcggctttttggtgctttacggcgtggcggtgagctccggaatcccgaatccggatgtggataccaccgcgacagtcgacaccgttcagtgcgtgccggaaacccaaatttccgcaactgaactgtcctcctgcgtaggttcaggcccagcgggcgacgccggcattgagcacggcgataagattttggccgtcaacggccaagagatggcaagcttcaccgccatccgcgatgcgatcctcgagctcccaggcgaaacggcaacgctgacgattgaacgggagggaacgcttttcgacgtcgacctccaggttgcctctgtcacccgtctcgcctctgacggttcagaaattaccgtcggcgcggtgggcatgtcgagccttccaccgaccgatgtgtacaaaaaatacggcccaatcgagggtgtgggagcaactgcacgtttcaccggcgacatgatcagcgccacgtgggatggcctcaaagccttcccggcgaaaatcccaggggtcgtcgcatccatcttcggtgcagaacgagatgtagaaagccccatgagtgtggtgggcgccgtacgcatcggcggcgaatttgtcgaacgttccatgtgggacatgttcatgatgatgctggccagcctgaacttcttcctcgcgctgtttaacctcgtgccgctgccaccacttgatggcggacacattgccgtggtgatctatgaaaaaatccgcgacttcttccgcaaactgcgcggaaaaccagcgggcggcccagcggattacaccaaactaatgcccgtcaccgtagctgtcgcagccttgctgatgacagtgggaggcctggtcattgtcgccgatgtggtcaatcccatccgactctttggctaacgatacggaattgaactgcc

SEQ ID NO: 134 - protein, 404 aa, Corynebacterium glutamicum
VAAYLLGVVLFFLGIAVTIALHEWGHFITARIFGMKVRRFFIGFGPTVFAKRRGETVYGLKAIPVGGFCDIAGMTAQDELDPEDLPRAMYLKPWWQRIIVLSGGVIMNLIVGFLVLYGVAVSSGIPNPDVDTTATVDTVQCVPETQISATELSSCVGSGPAGDAGIEHGDKILAVNGQEMASFTAIRDAILELPGETATLTIEREGTLFDVDLQVASVTRLASDGSEITVGAVGMSSLPPTDVYKKYGPIEGVGATARFTGDMISATWDGLKAFPAKIPGVVASIFGAERDVESPMSVVGAVRIGGEFVERSMWDMFMMMLASLNFFLALFNLVPLPPLDGGHIAVVIYEKIRDFFRKLRGKPAGGPADYTKLMPVTVAVAALLMTVGGLVIVADVVNPIRLFG

SEQ ID NO: 135 - DNA, 1111 bp, Corynebacterium glutamicum
  CDS (101)..(1111): FRXA00197
gtcgatgatattttggcaaccgaatctgaggcacgcgcgcgtgcgaatgctttgatcaaccggttggcaaccaacttgtaagctaaggagcttccgcctcgtggcagcctatcttcttggtgtcgtattatttttcctcggcatcgcagtaaccatcgcgcttcacgagtgggggcacttcatcacagcgcgcattttcggaatgaaagtgcggcgtttcttcatcggtttcggcccgacggtgtttgccaaaagacgcggcgaaaccgtgtacggccttaaagcgattccggtcggcggtttttgtgacatcgcggggatgactgcccaagatgaacttgatccggaagacctgccgcgcgccatgtatctaaagccctggtggcagcgcataattgtgctttccggcggcgtgatcatgaatctgatcgtcggctttttggtgctttacggcgtggcggtgagctccggaatcccgaatccggatgtggataccaccgcgacagtcgacaccgttcagtgcgtgccggaaacccaaatttccgcaactgaactgtcctcctgcgtaggttcaggcccagcgggcgacgccggcattgagcacggcgataagattttggccgtcaacggccaagagatggcaagcttcaccgccatccgcgatgcgatcctcgagctcccaggcgaaacggcaacgctgacgattgaacgggagggaacgcttttcgacgtcgacctccaggttgcctctgtcacccgtctcgcctctgacggttcagaaattaccgtcggcgcggtgggcatgtcgagccttccaccgaccgatgtgtacaaaaaatacggcccaatcgagggtgtgggagcaactgcacgtttcaccggcgacatgatcagcgccacgtgggatggcctcaaagccttcccggcgaaaatcccaggggtcgtcgcatccatcttcggtgcagaacgagatgtagaaagccccatgagtgtggtgggcgcgtcacgcatcggcggcgaatttgtcgaacgttccatgtgggacatgttcatgatgatgctggccagcctgaacttcttcctcgcgctgtttaacctcgtgccgctgcca

SEQ ID NO: 136 - protein, 337 aa, Corynebacterium glutamicum
VAAYLLGVVLFFLGIAVTIALHEWGHFITARIFGMKVRRFFIGFGPTVFAKRRGETVYGLKAIPVGGFCDIAGMTAQDELDPEDLPRAMYLKPWWQRIIVLSGGVIMNLIVGFLVLYGVAVSSGIPNPDVDTTATVDTVQCVPETQISATELSSCVGSGPAGDAGIEHGDKILAVNGQEMASFTAIRDAILELPGETATLTIEREGTLFDVDLQVASVTRLASDGSEITVGAVGMSSLPPTDVYKKYGPIEGVGATARFTGDMISATWDGLKAFPAKIPGVVASIFGAERDVESPMSVVGASRIGGEFVERSMWDMFMMMLASLNFFLALFNLVPLP

SEQ ID NO: 137 - DNA, 1113 bp, Corynebacterium glutamicum
  CDS (101)..(1090): RXN00216
gtgttgctcgcggccaggcagcagtgctgtacctgcctgacgcggatggtgacatcgttcttggatcaggcaccatctgccacacggagtcttaagaaaattgggcgcttatggtttaggtgagcttcctggaaaatccgccgcggaagccgccgacattattcagggtgaaacgggcgatcttctccatattcctcagcttccggcgcgaggtttgggtgctgatctgatcggtcgaaccgtcggtctgctggacatgatcaacgttgatcgcggggcccgatcttgggtgatgagcacacgccccagcagattgacgcacctgaccggcgatttccttgacatggatttggatgcgtgcgaggaaacctggggaacgggcgtcgacaagctaaaaatccaagttgctggtccctggactttaggtgcgcgcattgagttggccaatggccatcgcgttttgtctgatcgcggtgcgatgcgtgatctcacgcaggcgctgatcgccggcatcgatgcgcatgcacgcaaggttgctgggcgatttcgcgccgaagtgcaggtgcaaattgatgagccggagctgaaatcgcttatcgacggctccctccctggcacttccacctttgacattattcctgcggtgaatgtcgctgatgccagtgaacgtttgcagcaggtctttagctcgattgaggggccgacatatctcaacctcaccggccagattcctacttgggatgtggctcggggtgcgggcgccgatactgtgcagatttccatggatcaagtccgtggaaatgaacatttggatggttttggtgaaaccatcaccagtggaattcgtcttggtttgggcattacgacaggaaaagatgtcgtagatgaactgctcgagcgaccgcggcaaaaggccgttgaggtagcacgcttttttgatcgtttaggtgtgggccgaaactatctcgtggatgctgttgatattcatccgggtgaggatttggtgcaggggaccatcaccgaggccgcgcaggcttatcgcatggcccgggtgatgtcggagatgttgtcgaaggattcatgcgacctttaaggctttaccggcgctgggtg

SEQ ID NO: 138 - protein, 330 aa, Corynebacterium glutamicum
LGAYGLGELPGKSAAEAADIIQGETGDLLHIPQLPARGLGADLIGRTVGLLDMINVDRGARSWVMSTRPSRLTHLTGDFLDMDLDACEETWGTGVDKLKIQVAGPWTLGARIELANGHRVLSDRGAMRDLTQALIAGIDAHARKVAGRFRAEVQVQIDEPELKSLIDGSLPGTSTFDIIPAVNVADASERLQQVFSSIEGPTYLNLTGQIPTWDVARGAGADTVQISMDQVRGNEHLDGFGETITSGIRLGLGITTGKDVVDELLERPRQKAVEVARFFDRLGVGRNYLVDAVDIHPGEDLVQGTITEAAQAYRMARVMSEMLSKDSCDL

SEQ ID NO: 139 - DNA, 1269 bp, Corynebacterium glutamicum
  CDS (101)..(1246): RXN00222
agggaaaaactaccgtccgcctggacaaagtcatcgatgtactccgcgtccttggactcgagctttctgttggaattcacgatcccctcaaggttaatcaatgacccccactgccgatatctggtttaaagatactttggctgctcatttcacacgcgacggcgaccagaccacattctcctacacagctgattacgcaggtccaccgattgccacgtccctgcccatcaattctgaacccgtgattacgcgctctggagcgatcccaccatttttcgcgggattactccccgaaggtcgtcgcttaagttcactccggagaaacattaaagcctctgccgatgatgaactttcactccttctagcagtgggagctgatcctgttggtgcagtcgctatcttcccccatggtgaaaatacacaacctgcaccacccacagttgattttgacgatgaacttgatttctcggctgcactaaccgagtccgggattgcggatcccgttgcactggccggtgtccaagacaaagcctctgcacgcaccatcgcggtccccgttgcaagcgatgccatcttgaaactctccccgcctgaatacccttacttggtggaaaacgaagcagcttgttaccagttgctgaccaaaaataagcttcgcattgaactgtccaaagtagaagttctccatgacaaacacggcaggtccggactcttagttcaccgctttgaccgcacacccaaaggcaaaatccccgtcgaggatgcaggacaggtcttgggaatctggcctgcagataaatacttagtgagctacgaggacatcgcacaagccctcactaaagtgtgcgcctcccccatcttggcgatgcgcaatctcgccttccaaatcgcagtcgcgtggctcagcggcaatggtgatcttcatgccaagaacatctccattatcaacaaaggccgcggatttgagatcagccccatctatgacatccctgccaccgcagtatatggcgacaccacgatggcattagaaatccagggatccaaaaaggatctcagccaaaagaaattcctaaaattctgtacatccatcggactaccagaaaaaacagccatgtcggttgcgaacgctgcactgttggcaacagaaaatgccgcagagacaattcttgcttcgggaaattttgatacacggatgaatcgagatctggccagggttctcaaacatcgacgaagcgcatggggagcttaattcgcctgtttaagaggtcg

SEQ ID NO: 140 - protein, 382 aa, Corynebacterium glutamicum
MTPTADIWFKDTLAAHFTRDGDQTTFSYTADYAGPPIATSLPINSEPVITRSGAIPPFFAGLLPEGRRLSSLRRNIKASADDELSLLLAVGADPVGAVAIFPHGENTQPAPPTVDFDDELDFSAALTESGIADPVALAGVQDKASARTIAVPVASDAILKLSPPEYPYLVENEAACYQLLTKNKLRIELSKVEVLHDKHGRSGLLVHRFDRTPKGKIPVEDAGQVLGIWPADKYLVSYEDIAQALTKVCASPILAMRNLAFQIAVAWLSGNGDLHAKNISIINKGRGFEISPIYDIPATAVYGDTTMALEIQGSKKDLSQKKFLKFCTSIGLPEKTAMSVANAALLATENAAETILASGNFDTRMNRDLARVLKHRRSAWGA

SEQ ID NO: 141 - DNA, 1269 bp, Corynebacterium glutamicum; identical to SEQ ID NO: 139
  CDS (101)..(1246): FRXA00222

SEQ ID NO: 142 - protein, 382 aa, Corynebacterium glutamicum; identical to SEQ ID NO: 140

SEQ ID NO: 143 - DNA, 633 bp, Corynebacterium glutamicum
  CDS (101)..(610): RXN00232
gctgaaaaaactcccatttggacaatgaacacttgtcaaaatgggagttttggattttcgcaccaccggcagcactcgaaaacgtgtttatacttgaactatgaacgacagggctcaccaacgaataggcgacatcgagcgatcccaagccctcgaccgacttgggtcatattttgcagacggatacctcgacatcgacgaattcgatacccgaaccggcgccgcagcaatcgcacgcacagccggtgaaatagatgtcttgttcacagatcttcccgaacaacaggcaagcaccgccgtgacacccgtgcaagacgataccgagaaagaattagacctggtcctacagcgaggaaagaagctcaagcagatcgactccgccatttgggctgtcgtgatggtctcgttcttcctaggcttgtttgttttcaacgtgccatatttctgggttgtgttcatccttggcggagcggcctccgcgggtgcgcgattcttgctcaaagtagatgacgccgatgaaaaactctttgaggaactccacagcaaggaacaaagcgaacgcgaagcacgcctacgcattgcggcacaacgtcgacgcgagttggaacaatagccacaaaagctatcaagccc

SEQ ID NO: 144 - protein, 170 aa, Corynebacterium glutamicum
MNDRAHQRIGDIERSQALDRLGSYFADGYLDIDEFDTRTGAAAIARTAGEIDVLFTDLPEQQASTAVTPVQDDTEKELDLVLQRGKKLKQIDSAIWAVVMVSFFLGLFVFNVPYFWVVFILGGAASAGARFLLKVDDADEKLFEELHSKEQSEREARLRIAAQRRRELEQ

SEQ ID NO: 145 - DNA, 627 bp, Corynebacterium glutamicum
  CDS (101)..(610): FRXA00232
gctgaaaaaactcccatttggacaatgaacacttgtcaaaatgggagttttggattttcgcaccaccggcagcactcgaaaacgtgtttatacttgaactatgaacgacagggctcaccaacgaataggcgacatcgagcgatcccaagccctcgaccgacttgggtcatattttgcagacggatacctcgacatcgacgaattcgatacccgaaccggcgccgcagcaatcgcacgcacagccggtgaaatagatgtcttgttcacagatcttcccgaacaacaggcaagcaccgccgtgacacccgtgcaagacgataccgagaaagaattagacctggtcctacagcgaggaaagaagctcaagcagatcgactccgccatttgggctgtcgtgatggtctcgttcttcctaggcttgtttgttttcaacgtgccatatttctgggttgtgttcatccttggcggagcggcctccgcgggtgcgcgattcttgctcaaagtagatgacgccgatgaaaaactctttgaggaactccacagcaaggaacaaagcgaacgcgaagcacgcctacgcattgcggcacaacgtcgacgcgagttggaacaatagccacaaaagctatc

SEQ ID NO: 146 - protein, 170 aa, Corynebacterium glutamicum; identical to SEQ ID NO: 144

SEQ ID NO: 147 - DNA, 849 bp, Corynebacterium glutamicum
  CDS (101)..(826): RXN00236
aatgcgagagttctaaaacgagccggtaacatcgacccccatgagttcaggggttagaaaagcaatgggatttggatgcggttcggttttggccgtcatcatggtgatctcatttgttggatgggcgctcagcttcatggatggaacggcacctattcgccaactccagcaaatccctgaagatgttccgccggcgcgtggtgtagaagttccgcaaattgatacagaggcagatggacgcacatccaaccatttgcgtttttgggcggaaccaattgctcaagatactggtgtgtccgctcaagcgattgcggcttatggaaacgcagagctcatcgcgagtactgcgtggcctggctgcaatctggggtggaataccttggcaggtatcggccaggtggaaacccgtcacggtacctacaacggcaaaatgttcgggggcagttccctggatgaaaatggagttgcaacccctccaatcatcggcgttccacttgatggttcaccggggtttgcggaaattcccgacactgatggtggggaattagatggcgatactgaatatgatcgcgcggtaggtcccatgcagttcattccggaaacgtggcgacttatgggattggatgcaaacggtgatggggtagcggaccccaaccaaattgatgacgcagcattgagtgccgcaaacctgttgtgttccaacgatcgtgacttgtccactcctgaaggatggaccgcagctgttcattcttacaacatgtctaatcagtatttgatggacgttcgagatgctgccgcgtcctacgctttacgacagccggcgatctaaaacttaacaagcgcaacccc

SEQ ID NO: 148 - protein, 242 aa, Corynebacterium glutamicum
MVISFVGWALSFMDGTAPIRQLQQIPEDVPPARGVEVPQIDTEADGRTSNHLRFWAEPIAQDTGVSAQAIAAYGNAELIASTAWPGCNLGWNTLAGIGQVETRHGTYNGKMFGGSSLDENGVATPPIIGVPLDGSPGFAEIPDTDGGELDGDTEYDRAVGPMQFIPETWRLMGLDANGDGVADPNQIDDAALSAANLLCSNDRDLSTPEGWTAAVHSYNMSNQYLMDVRDAAASYALRQPAI

SEQ ID NO: 149 - DNA, 849 bp, Corynebacterium glutamicum; identical to SEQ ID NO: 147
  CDS (101)..(826): FRXA00236

SEQ ID NO: 150 - protein, 242 aa, Corynebacterium glutamicum; identical to SEQ ID NO: 148

SEQ ID NO: 151 - DNA, 1401 bp, Corynebacterium glutamicum
  CDS (101)..(1378): RXN00242
ggatcactatcgctttaaacaccgaaaccttcctgctagttcaccaagatttttaagttttaccgcaatttcttgagagctttgggaggataatggcggtgtgaatgaatggcgaacagtctcgcttgtagattccacggcgctgaccgtgatcatcagtgtggccgtgtttacttctgctgtggctctgctcggagttgtgaaaaagcgctctcggtggcgggttctcggagctctcatctcctcagcagttctcaccagtggcgcatgggtggttattgaaaagctgtggaagcctttccccgaccccaatccgtggaccatctatctttccgctggtttggcggtttttcctctgttgagcatcttgttccgcactggtcgtacaagaatactgatggctacactcaccgtgattgcactggttaatacggccgcagtcatcaatgtcatctaccagccatacccgacgttgggttctttcaatcccgtgccaacggctgtgtccatgtcgtatgcagattttgaatctcagaccactgccccgacgatggatgaccgtgaagtcggtgcccttgtgcaggtgccgctagctggaacaacagatgattccacctccggctttgatgcgcgcgatgcctacgcctatattccgcctgcgtattgggataatccttccctacaactgccagttttggttctcatgcccggaaaccccggccagccagatcagtggtttagcagtggaaatgccgatcaaacagcagataatttccaagcaacccacgatggcatcagccccattgtcatcagcgtggatggcacaggatcattcagcggaaaccctgcttgcgtggattctgatgcccaaagcgtgatgacatatctatcccacgatgtccccatgttgatcaaacagaaattccgagtcaatcaggatcagcgcacctggacaattggtggtttaagttacggcggcacctgtgctttgcagatcatgaccaatcaccccgaagcgtatggttctttccttgacttctcgggccaggaagaaccaacacttggcacacgccagcaaactgttgatcagcttttcggcggcgatgaagacgcattcaaagccgttaatccggaagatctgctcaatcaagcaatcagctcaggagcgcatacctacagcgggatttcgggcaggtttattgctggtagcaacgataaaagtgcagtgagcgcgctgtctcatcttgataatttgagcaatcaggcgggcatgtccaccacctttgataccgtggccggtggacattccttccaggtgtggcgcgtggctttagcgaatacttttgattgggttgccaagcgcggcggattgcaggtttaacaatgaaagacgcttcacag

SEQ ID NO: 152 - protein, 426 aa, Corynebacterium glutamicum
VNEWRTVSLVDSTALTVIISVAVFTSAVALLGVVKKRSRWRVLGALISSAVLTSGAWVVIEKLWKPFPDPNPWTIYLSAGLAVFPLLSILFRTGRTRILMATLTVIALVNTAAVINVIYQPYPTLGSFNPVPTAVSMSYADFESQTTAPTMDDREVGALVQVPLAGTTDDSTSGFDARDAYAYIPPAYWDNPSLQLPVLVLMPGNPGQPDQWFSSGNADQTADNFQATHDGISPIVISVDGTGSFSGNPACVDSDAQSVMTYLSHDVPMLIKQKFRVNQDQRTWTIGGLSYGGTCALQIMTNHPEAYGSFLDFSGQEEPTLGTRQQTVDQLFGGDEDAFKAVNPEDLLNQAISSGAHTYSGISGRFIAGSNDKSAVSALSHLDNLSNQAGMSTTFDTVAGGHSFQVWRVALANTFDWVAKRGGLQV

SEQ ID NO: 153 - DNA, 1303 bp, Corynebacterium glutamicum
  CDS (101)..(1303): FRXA00242
ggatcactatcgctttaaacaccgaaaccttcctgctagttcaccaagatttttaagttttaccgcaatttcttgagagctttgggaggataatggcggtgtgaatgaatggcgaacagtctcgcttgtagattccacggcgctgaccgtgatcatcagtgtggccgtgtttacttctgctgtggctctgctcggagttgtgaaaaagcgctctcggtggcgggttctcggagctctcatctcctcagcagttctcaccagtggcgcatgggtggttattgaaaagctgtggaagcctttccccgaccccaatccgtggaccatctatctttccgctggtttggcggtttttcctctgttgagcatcttgttccgcactggtcgtacaagaatactgatggctacactcaccgtgattgcactggttaatacggccgcagtcatcaatgtcatctaccagccatacccgacgttgggttctttcaatcccgtgccaacggctgtgtccatgtcgtatgcagattttgaatctcagaccactgccccgacgatggatgaccgtgaagtcggtgcccttgtgcaggtgccgctagctggaacaacagatgattccacctccggctttgatgcgcgcgatgcctacgcctatattccgcctgcgtattgggataatccttccctacaactgccagttttggttctcatgcccggaaaccccggccagccagatcagtggtttagcagtggaaatgccgatcaaacagcagataatttccaagcaacccacgatggcatcagccccattgtcatcagcgtggatggcacaggatcattcagcggaaaccctgcttgcgtggattctgatgcccaaagcgtgatgacatatctatcccacgatgtccccatgttgatcaaacagaaattccgagtcaatcaggatcagcgcacctggacaattggtggtttaagttacggcggcacctgtgctttgcagatcatgaccaatcaccccgaagcgtatggttctttccttgacttctcgggccaggaagaaccaacacttggcacacgccagcaaactgttgatcagcttttcggcggcgatgaagacgcattcaaagccgttaatccggaagatctgctcaatcaagcaatcagctcaggagcgcatacctacagcgggatttcgggcaggtttattgctggtagcaacgataaaagtgcagtgagcgcgctgtctcatcttgataatttgagcaatcaggcgggcatgtccaccacctttgataccgtggccggtgga

SEQ ID NO: 154 - protein, 401 aa, Corynebacterium glutamicum
VNEWRTVSLVDSTALTVIISVAVFTSAVALLGVVKKRSRWRVLGALISSAVLTSGAWVVIEKLWKPFPDPNPWTIYLSAGLAVFPLLSILFRTGRTRILMATLTVIALVNTAAVINVIYQPYPTLGSFNPVPTAVSMSYADFESQTTAPTMDDREVGALVQVPLAGTTDDSTSGFDARDAYAYIPPAYWDNPSLQLPVLVLMPGNPGQPDQWFSSGNADQTADNFQATHDGISPIVISVDGTGSFSGNPACVDSDAQSVMTYLSHDVPMLIKQKFRVNQDQRTWTIGGLSYGGTCALQIMTNHPEAYGSFLDFSGQEEPTLGTRQQTVDQLFGGDEDAFKAVNPEDLLNQAISSGAHTYSGISGRFIAGSNDKSAVSALSHLDNLSNQAGMSTTFDTVAGG

SEQ ID NO: 155 - DNA, 1050 bp, Corynebacterium glutamicum
  CDS (101)..(1027): RXN00247
aacccctaactactgacctcgcaccacttgttgcagcccgttaccacgctgcattgagcgcactgctggcacatatctaagaccgctaaggaaatcagctatgcagacattaatctttatcgccattgcaggcgtcgcagcacagcttgttgatggcggcctcggcatggggttcggcgtcacctcaaccaccatcctcatcatgctcgcaggtttaggccctgcgcaggcatccgccgtcgtgcacaccgcagaggttggaaccaccttagtttctggtttaagccactggaaatttggcaacgtggattggaaagtagttgtccggctcggtatccccggcgctatcggcgcatttgctggcgctaccttcttgtccaatatttccaccgaagcagcagcaccgatcacctccctgattcttgccctgatcggcatgaacctagtctggcgattcagcaagggacgcatccgccgcgactattccgatcgcccgcacagcaggggattcctcggcggactcggtattgtcggtggtttcgttgacgcatccggtggcggcggatggggtccagtgaccacctctacgctgctgtctttgggacgcaccgaaccccgcaaagtagtcggcaccgtcaacaccgcagaattcttagtctccctagccgcaacattgggcttcgtcgtgggactgtgggatgacctagtagctaacctctctgcagttctcgcgttgctcatcggcggcgcaatcgcagcaccaatcggcgcctggatgatctctcgcgttaatgcaaccgtcctcggtggcttcgtgggcaccctgattgtcacactgaacctgccaaaggtgctcaacgtggttggccttgatttcatccccaccggcctcatccaggtcaccgtcctcctcatcggcctgccgctgacgtacctcggcttccgccgctaccgcaaaaatctcctcaacgagaccatctccagcgaagttgtctccgaaccaaagggccaaaagattaaaagcacttaaaacacgcttttcgacgccca

SEQ ID NO: 156 - protein, 309 aa, Corynebacterium glutamicum
MQTLIFIAIAGVAAQLVDGGLGMGFGVTSTTILIMLAGLGPAQASAVVHTAEVGTTLVSGLSHWKFGNVDWKVVVRLGIPGAIGAFAGATFLSNISTEAAAPITSLILALIGMNLVWRFSKGRIRRDYSDRPHSRGFLGGLGIVGGFVDASGGGGWGPVTTSTLLSLGRTEPRKVVGTVNTAEFLVSLAATLGFVVGLWDDLVANLSAVLALLIGGAIAAPIGAWMISRVNATVLGGFVGTLIVTLNLPKVLNVVGLDFIPTGLIQVTVLLIGLPLTYLGFRRYRKNLLNETISSEVVSEPKGQKIKST

SEQ ID NO: 157 - DNA, 1050 bp, Corynebacterium glutamicum; identical to SEQ ID NO: 155
  CDS (101)..(1027): FRXA00247

SEQ ID NO: 158 - protein, 309 aa, Corynebacterium glutamicum; identical to SEQ ID NO: 156

SEQ ID NO: 159 - DNA, 894 bp, Corynebacterium glutamicum
  CDS (101)..(871): RXN00256
aattaatcaatcagaaaaacatattgaatacttataaatttctgacatactcattaatgagatattcgaagtctttatcaaaatgattaacaaaaggagtatgtttatgtcgctaaaaactcgccgaatattcggcgcacttgctgtttcgctatcaatctctttctcagccattgctacacctgcagcatccgcacaagaactagtggtgagcacatcagcagtaaacgaatttggtgtagttaccagtgacatcacggctgagcaaattcttcaggcgcaagatctaatcgctgagatgaaacagtcagaggacatatatgagtatttcggtgccttgtctgacgttgaacagagatccatcattgcagctgtaaaggaaaatccatatctcattgagaacgaatcaccccgtatgagagtccaaagtgaaacacccgacgaggaaacacctgataagaaaaagccgagcaaaacctacaagctctatatgagcattctcgaaatgatgtcatgtatcaatcttgttgatgttccgtcatgtgcccaagcccttaaagcggcaaatatagctgaacgcgaggccaaggcccgttaccccgattcggtcactaatggtaaaggcgatgcccttcgtcattgtgcatggagcgctctcatgactattcgaatcggaaaagatgcagccgaaagaattggtaacgctcatgaaaccgttgtgagaggtgaacccgaagaaagagaaatggatctcatcaataacgcgctgggtagagacatcggcgaaagattcatcatcaatggcgatgaaacgggtgcgctcagtacttgtgtatccatggctaatatcgggctacttcatactctgttgtaaacaaaggaagtttctatcat

SEQ ID NO: 160 - protein, 257 aa, Corynebacterium glutamicum
MFMSLKTRRIFGALAVSLSISFSAIATPAASAQELVVSTSAVNEFGVVTSDITAEQILQAQDLIAEMKQSEDIYEYFGALSDVEQRSIIAAVKENPYLIENESPRMRVQSETPDEETPDKKKPSKTYKLYMSILEMMSCINLVDVPSCAQALKAANIAEREAKARYPDSVTNGKGDALRHCAWSALMTIRIGKDAAERIGNAHETVVRGEPEEREMDLINNALGRDIGERFIINGDETGALSTCVSMANIGLLHTLL

SEQ ID NO: 161 - DNA, 894 bp, Corynebacterium glutamicum; identical to SEQ ID NO: 159
  CDS (101)..(871): FRXA00256

SEQ ID NO: 162 - protein, 257 aa, Corynebacterium glutamicum; identical to SEQ ID NO: 160

SEQ ID NO: 163 - DNA, 501 bp, Corynebacterium glutamicum
  CDS (101)..(478): RXN00264
aaaccggaagggcccgtttactcccctacttggcgcagaaatccacatcaatccaggtgaagcagtcatctttgatgttgatcccacgtttgaacacggtttgcttgtcgattccggcgacgtccaactagaaggcgtcaccgtcgagcccacccagctggcctacaccggcatcaatgaaacccaactccgaatccgtaacatcggcaccacaccggcgcgtactgtactgctaggtggcgaaccatttaccgaagacatcgtgatgtggtggaacttcattggccgcagccatgaagaaattgccgagtaccgtaaacagtggcaggccgaagctgatcgttttggtatcacccacggatatatcagccaccacaaagatgggctcaccaggcttccagcacccgagcttcccaacgctgctatcaaggcacgtaaaaacccagcaccaactgcacgaccagaaacgagaattgattaaatgcgctccgctcacggccc

SEQ ID NO: 164 - protein, 126 aa, Corynebacterium glutamicum
LLVDSGDVQLEGVTVEPTQLAYTGINETQLRIRNIGTTPARTVLLGGEPFTEDIVMWWNFIGRSHEEIAEYRKQWQAEADRFGITHGYISHHKDGLTRLPAPELPNAAIKARKNPAPTARPETRID

SEQ ID NO: 165 - DNA, 501 bp, Corynebacterium glutamicum
  CDS (101)..(478): FRXA00264
aaaccggaagggccsgtttactcccctacttggcgcagaaatccacatcaatccaggtgaagcagtcatctttgatgttgatcccacgtttgaacacggtttgcttgtcgattccggcgacgtccaactagaaggcgtcaccgtcgagcccacccagctggcctacaccggcatcaatgaaacccaactccgaatccgtaacatcggcaccacaccggcgcgtactgtactgctaggtggcgaaccatttaccgaagacatcgtgatgtggtggaacttcattggccgcagccatgaagaaattgccgagtaccgtaaacagtggcaggccgaagctgatcgttttggtatcacccacggatatatcagccaccacaaagatgggctcaccaggcttccagcacccgagcttcccaacgctgctatcaaggcacgtaaaaacccagcaccaactgcacgaccagaaacgagaattgattaaatgcgctccgctcacggccc

SEQ ID NO: 166 - protein, 126 aa, Corynebacterium glutamicum; identical to SEQ ID NO: 164

SEQ ID NO: 167 - DNA, 441 bp, Corynebacterium glutamicum
  CDS (101)..(418): RXN00267
gtcgtacttatcttttaaagtcatgccttaaaggatacggagatcactccggcttggcttgggtggcggtgttatcaaagtagtcgtagcgttgagaactatgcgaaactctaagtctggcctggccttttccgcagctgcactattttgtgtcgtcgcggtaatcactcgtattgcaagttccccatcatttatcgctattgtggcgatcatcgtggctgcgatcgcactttttgtgggtctgaacagtcgtgtgggaacaaagcttgttgatcagccagtggtgttcacccaggaacaaattgatcaattgaaagagttgaaatcccgcgaccaggaggcggcagcgatccgtcaggcgcagctgtggagtaggggatcgtccagcgaagcggtcgcagaggctgtgaggaagctctaagtcgacttaagtgcgcgaag

SEQ ID NO: 168 - protein, 106 aa, Corynebacterium glutamicum
MRNSKSGLAFSAAALFCVVAVITRIASSPSFIAIVAIIVAAIALFVGLNSRVGTKLVDQPVVFTQEQIDQLKELKSRDQEAAAIRQAQLWSRGSSSEAVAEAVRKL

SEQ ID NO: 169 - DNA, 358 bp, Corynebacterium glutamicum
  CDS (66)..(335): FRXA00267
cgtagcgttgagaactatgcgaaactctaagtctggcctggccttttccgcagctgcactattttgtgtctgtcgcggtaatcactcgtattgcaagttccccatcatttatcgctattgtggcgatcatcgtggctgcgatcgcactttttgtgggtctgaacagtcgtgtgggaacaaagcttgttgatcagccagtggtgttcacccaggaacaaattgatcaattgaaagagttgaaatcccgcgaccaggaggcggcagcgatccgtcaggcgcagctgtggagtaggggatcgtccagcgaagcggtcgcagaggctgtgaggaagctctaagtcgacttaagtgcgcgaag

SEQ ID NO: 170 - protein, 90 aa, Corynebacterium glutamicum
VSVAVITRIASSPSFIAIVAIIVAAIALFVGLNSRVGTKLVDQPVVFTQEQIDQLKELKSRDQEAAAIRQAQLWSRGSSSEAVAEAVRKL

SEQ ID NO: 171 - DNA, 1113 bp, Corynebacterium glutamicum
  CDS (101)..(1090): RXN00271
tagtttaaatcatgagacatttcacatatggttctttatccgagacatgtgttgacgctgtctgcccctttttgaaaataacactttaaggagatgtgccatgttttcttcccgttcgaaggtactcgcaagcatctttactgttggcgccttggcgttggcttcgtgctcaagcgattccagtgacagctccacctccactgatgctgcaggtggcgactcttaccgagttggcatcaaccagcttgttcagcaccctgcacttgatgcagcgaccactggtttcaaggaagcttttgaagaggcaggcgttgacgtcacctttgatgagcaaaacgctaacggcgagcagggcactgcactgactatttctcagcagttcgcttctgacaatttggatctcgtgttggctgttgcaactccagcagcacaggcaactgcgcagaatatcactgatatcccagtcctgttcaccgcagttaccgatgcagtgtcggcagagctggtggattctaatgaagcacctggcggaaacgtcaccggtacttctgatatcgcaccgattgagcagcagttggagcttttgcagcagctggttcctgacgcaaagtccatcggcatcgtctacgcgtctggtgaggtcaactctcaggtgcaggtcgatgaggtcaccaaggctgctgagccactggggctgtccgttaatactcagactgtcactaccgtgaacgagattcagcaggctgttgaagctctcggcgatgttgatgtcatctacgttccaactgacaacatggttgtttccggtatttcttctctggttcaggttgctgagcagaagcagatccctgtgatcggcgctgagtccggcactgttgagggtggcgcactggcaaccctgggtatcgattacaccgagcttggccgccagactggtgagatggctctgcgtattctgcaggacggcgaagacccagcaaccatgcctgtggagactgcaactgagttcacctacgtgatcaacgaagatgcagcagagcgccagggcgtggagatccctcaagagattttggataaggccgaacgcgtatgatcggcgcttttgagttcgga

SEQ ID NO: 172 - protein, 330 aa, Corynebacterium glutamicum
MFSSRSKVLASIFTVGALALASCSSDSSDSSTSTDAAGGDSYRVGINQLVQHPALDAATTGFKEAFEEAGVDVTFDEQNANGEQGTALTISQQFASDNLDLVLAVATPAAQATAQNITDIPVLFTAVTDAVSAELVDSNEAPGGNVTGTSDIAPIEQQLELLQQLVPDAKSIGIVYASGEVNSQVQVDEVTKAAEPLGLSVNTQTVTTVNEIQQAVEALGDVDVIYVPTDNMVVSGISSLVQVAEQKQIPVIGAESGTVEGGALATLGIDYTELGRQTGEMALRILQDGEDPATMPVETATEFTYVINEDAAERQGVEIPQEILDKAERV

SEQ ID NO: 173 - DNA, 1113 bp, Corynebacterium glutamicum; identical to SEQ ID NO: 171
  CDS (101)..(1090): FRXA00271

SEQ ID NO: 174 - protein, 330 aa, Corynebacterium glutamicum; identical to SEQ ID NO: 172

SEQ ID NO: 175 - DNA, 495 bp, Corynebacterium glutamicum
  CDS (101)..(472): RXN00272
accgatgcaccagccaccaacgcgtccaaatcaatatcagcctggcccacaaggtggaattccagtgggtggccatctgccacaaccaggtgcagggcacatgccggaaccagaaacctccacgatgggctccatccaaaagtccggtgaatggctcgttcctgcatattcggcatacaagctcaacggtgctgaccttttcttagatatccgccatgccaccgcggctgctcctgtcattacctttgatgtcaacatgaccatgggttctatgacgctgattgttccaccgggtgtgtatgtggaagtgcagatggcttccaagaactggtcggatttcaaggttcaaacaaccaatcctctccccggtgctccccgagtgttcatcactggtgttgcacgcgcatcagggttgaaggttttcaccaagcatcctcatgagccttttgggttctggcagaaaatgtttgagtagcctcgggccacgcccgaacc

SEQ ID NO: 176 - protein, 124 aa, Corynebacterium glutamicum
MPEPETSTMGSIQKSGEWLVPAYSAYKLNGADLFLDIRHATAAAPVITFDVNMTMGSMTLIVPPGVYVEVQMASKNWSDFKVQTTNPLPGAPRVFITGVARASGLKVFTKHPHEPFGFWQKMFE

SEQ ID NO: 177 - DNA, 495 bp, Corynebacterium glutamicum; identical to SEQ ID NO: 175
  CDS (101)..(472): FRXA00272

SEQ ID NO: 178 - protein, 124 aa, Corynebacterium glutamicum; identical to SEQ ID NO: 176

SEQ ID NO: 179 - DNA, 1155 bp, Corynebacterium glutamicum
  CDS (101)..(1132): RXN00283
gcgttggcattggcgtttttagcgcgctatgacgccctcatcatggccttcgtagccatgtggactgtcggatttatgacatggcgcgcacgataccgccgtggcttccgcgaccgcatcggattcgcacttgtcgacatgctgctcctcgtctggccgatcggcttcgccttcgtcgcctggactggcgccaagctggctcactaccggcgaactctttgcccaattcacctccacagacggcaacgctgcgatcatcgcagcatccggcggcggcgccatagggccccaagcgcttttcgacgcctccgtccgcaccttcctcatctccccagctctcctactcgtcgcagtagttgcagtcttttttgcttatcgacgccgcgaccccgaacccatcatccccttagctctcatcggctctgtggtgttcttccaaatcattacctactcacttggatctaccttcggcctgctgcgctttttcctcaccgccctgccgctcaccattatcttgctgttccaaattatcccgccccgccaccgattcccctcactgcgaccaggtgcgtgctaccgcgatcgcgtcaccggcaagtacgtgcccaaaacaatcaccggtgttttagttctcgcgatcttcggcggcaccggcatcaccctgtacggcatgagcagtgctaactgggcgccccaggaatatgccatccaagaactagttttcaacatgggatcgccatcgcaggacgccgtccacaccctgaacaccttctccactgaaatggatgtcgccgatttcgtcgactccctaaaccttggagacggcgaagtccttctctccaccacctacggcttcgccgtcctcaccgcatcaaacaaccaaaagcaattcatcatcccctccgacgaagacttcatcaccaccctcaacgaacccgctgagcacggcgttaagtacatcctcgccctcccacgcgaaggtcgcggcgccaccgacccgatcaacctgcgctacccagacatgtatgaaaccggcagccacatcgccacgatggaaatcgaattcatcaatcaaggccaaggacaaccaaattggcgcctctatcgggtgctcaccacacctgaacagtcgtagactctttgtaactaccgttg

SEQ ID NO: 180 - protein, 344 aa, Corynebacterium glutamicum
VASATASDSHLSTCCSSSGRSASPSSPGLAPSWLTTGELFAQFTSTDGNAAIIAASGGGAIGPQALFDASVRTFLISPALLLVAVVAVFFAYRRRDPEPIIPLALIGSVVFFQIITYSLGSTFGLLRFFLTALPLTIILLFQIIPPRHRFPSLRPGACYRDRVTGKYVPKTITGVLVLAIFGGTGITLYGMSSANWAPQEYAIQELVFNMGSPSQDAVHTLNTFSTEMDVADFVDSLNLGDGEVLLSTTYGFAVLTASNNQKQFIIPSDEDFITTLNEPAEHGVKYILALPREGRGATDPINLRYPDMYETGSHIATMEIEFINQGQGQPNWRLYRVLTTPEQS

SEQ ID NO: 181 - DNA, 1251 bp, Corynebacterium glutamicum
  CDS (101)..(1228): FRXA00283
gaagctccgttcatttacgccactctctgggcggtgcgcaggctgattcggtggagttctacggaaaacgtccacagacctcattacctgtggttttgcgttggcattggcgtttttagcgcgctatgacgccctcatcatggccttcgtagccatgtggactgtcggatttatgacatggcgcgcacgataccgccgtggcttccgcgaccgcatcggattcgcacttgtcgacatgctgctcctcgtctggccgatcggcttcgccttcgtcgcctggactggcgccagctggctcactaccggcgaactctttgcccaattcacctccacagacggcaacgctgcgatcatcgcagcatccggcggcggcgccatagggccccaagcgcttttcgacgcctccgtccgcaccttcctcatctccccagctctcctactcgtcgcagtagttgcagtcttttttgcttatcgacgccgcgaccccgaacccatcatccccttagctctcatcggctctgtggtgttcttccaaatcattacctactcacttggatctaccttcggcctgctgcgctttttcctcaccgccctgccgctcaccattatcttgctgttccaaattatcccgccccgccaccgattcccctcactgcgaccaggtgcgtgctaccgcgatcgcgtcaccggcaagtacgtgcccaaaacaatcaccggtgttttagttctcgcgatcttcggcggcaccggcatcaccctgtacggcatgagcagtgctaactgggcgccccaggaatatgccatccaagaactagttttcaacatgggatcgccatcgcaggacgccgtccacaccctgaacaccttctccactgaaatggatgtcgccgatttcgtcgactccctaaaccttggagacggcgaagtccttctctccaccacctacggcttcgccgtcctcaccgcatcaaacaaccaaaagcaattcatcatcccctccgacgaagacttcatcaccaccctcaacgaacccgctgagcacggcgttaagtacatcctcgccctcccacgcgaaggtcgcggcgccaccgacccgatcaacctgcgctacccagacatgtatgaaaccggcagccacatcgccacgatggaaatcgaattcatcaatcaaggccaaggacaaccaaattggcgcctctatcgggtgctcaccacacctgaacagtcgtagactctttgtaactaccgttg

SEQ ID NO: 182 - protein, 376 aa, Corynebacterium glutamicum
LALAFLARYDALIMAFVAMWTVGFMTWRARYRRGFRDRIGFALVDMLLLVWPIGFAFVAWTGASWLTTGELFAQFTSTDGNAAIIAASGGGAIGPQALFDASVRTFLISPALLLVAVVAVFFAYRRRDPEPIIPLALIGSVVFFQIITYSLGSTFGLLRFFLTALPLTIILLFQIIPPRHRFPSLRPGACYRDRVTGKYVPKTITGVLVLAIFGGTGITLYGMSSANWAPQEYAIQELVFNMGSPSQDAVHTLNTFSTEMDVADFVDSLNLGDGEVLLSTTYGFAVLTASNNQKQFIIPSDEDFITTLNEPAEHGVKYILALPREGRGATDPINLRYPDMYETGSHIATMEIEFINQGQGQPNWRLYRVLTTPEQS

SEQ ID NO: 183 - DNA, 459 bp, Corynebacterium glutamicum
  CDS (101)..(436): RXN00334
ataagccccgcatgggatatgagaaaaggaatgcacgatgagtattgaatttccgttaggtaatccagcgcctgcacagtggttttctggcgaggtccatatggccaagcttgatgacaacgtgcagattgagactgtgaacgtgtcttttgaggcaggcggtcgcaccaattggcacactcacccagtcggtcaaaacataattgtgctgtcgggcttgggcatttatgaggcggagggggagcctgctcgactcctggagcctggcgatgttgttttcgcagccgccggggttcgccactggcacggcgccgtgtctggtgcaccgatgttccacgtggtggttaacctcaaaggcatcgacggcgagaccgtcgattgggaggagccggtcgacgaggagcactaccgcagcgtgagcgcggagctacaaagataaaaatgcttttcgacgtccac

SEQ ID NO: 184 - protein, 112 aa, Corynebacterium glutamicum
MAKLDDNVQIETVNVSFEAGGRTNWHTHPVGQNIIVLSGLGIYEAEGEPARLLEPGDVVFAAAGVRHWHGAVSGAPMFHVVVNLKGIDGETVDWEEPVDEEHYRSVSAELQR

SEQ ID NO: 185 - DNA, 459 bp, Corynebacterium glutamicum; identical to SEQ ID NO: 183
  CDS (101)..(436): FRXA00334

SEQ ID NO: 186 - protein, 112 aa, Corynebacterium glutamicum; identical to SEQ ID NO: 184

SEQ ID NO: 187 - DNA, 1263 bp, Corynebacterium glutamicum
  CDS (101)..(1240): RXN00338
tcttagaaggcgtagtcacaccattaaccttgccagaatttttcaaggcttggctagacttgggaaacgaacatgcggtaccaaccaggggagttaatgcgtgagtgatgtaaccgttggcgatattcgccgcattttggatgaggcttatccgccggcgttggcggaaagctgggacaaagtggggctgatctgcggtgatccaacagagtcggtgaagcgtgtcggtttagcactcgattgcacccaggcagtggccgacaaggctgtggacatgggtttggacatgctgatcattcaccacccattgctgctgcgtggggtgacgtctgttgctgcggatgagccaaaaggcaaggtcattcacaccctaattcgcggcggggtggcactgttttccgcgcacactaatgcggattccgcgcgcccaggtgtcaacgataaactcgccgagctcgtcggcatcacggccgggcgacccatcgcgacacggcttttaggcggcatggacaaatggggcgtgcacgttctgcccaaggatgcagcgtacctaaagaagatgcttttcgacgcaggtgccggtgcgatcggcgactaccgagagtgtgcctttgagatcgaaggaaccgggcagtttaggcccgtggagggggcgaatccggcagagggggacgtcgataagctttttaaatcccttgagctgcgcatcgagtttgttgcaccgcgcaacctgcgcgcccggctcacgtcggtgctgcgggaggctcatccgtatgaggagcctgccttcgatattgttgaaatgcacagcgctgagagtttagaaaatgcgaccggattgggtcgtgtgggtgaattgccggagccgatgcgcctcgcggatttcgtgcaacaagtggccaacaacctgcctgtcaccgaatggggcgtgcgcgctaccggcgatcctgaacaaatggtgtcccgtgtggcggtttcatcagggtcgggtgacagtttcttaaacgatgtgattaagctcggagtggacgtttatgtcacttctgatctgcgccaccatccagttgatgaatatctccgagaaggtggccctgcagtaatcgatactgcacactgggccagcgaatttccatggacttcccaagcccaagaaattttgcaggacaaagccccacaggttgaagttgatgtgatttcgatccgcacagacccctggaccatgtctgcgcgagcagtgaactaaattcttgagaactaaaaaag

SEQ ID NO: 188 - protein, 380 aa, Corynebacterium glutamicum
VSDVTVGDIRRILDEAYPPALAESWDKVGLICGDPTESVKRVGLALDCTQAVADKAVDMGLDMLIIHHPLLLRGVTSVAADEPKGKVIHTLIRGGVALFSAHTNADSARPGVNDKLAELVGITAGRPIATRLLGGMDKWGVHVLPKDAAYLKKMLFDAGAGAIGDYRECAFEIEGTGQFRPVEGANPAEGDVDKLFKSLELRIEFVAPRNLRARLTSVLREAHPYEEPAFDIVEMHSAESLENATGLGRVGELPEPMRLADFVQQVANNLPVTEWGVRATGDPEQMVSRVAVSSGSGDSFLNDVIKLGVDVYVTSDLRHHPVDEYLREGGPAVIDTAHWASEFPWTSQAQEILQDKAPQVEVDVISIRTDPWTMSARAVN

SEQ ID NO: 189 - DNA, 806 bp, Corynebacterium glutamicum
  CDS (1)..(783): FRXA00338
gtcggcatcacggccgggcgacccatcgcgacacggcttttaggcggcatggacaaatggggcgtgcacgttctgcccaaggatgcagcgtacctaaagaagatgcttttcgacgcaggtgccggtgcgatcggcgactaccgagagtgtgcctttgagatcgaaggaaccgggcagtttaggcccgtggagggggcgaatccggcagagggggacgtcgataagctttttaaatcccttgagctgcgcatcgagtttgttgcaccgcgcaacctgcgcgcccggctcacgtcggtgctgcgggaggctcatccgtatgaggagcctgccttcgatattgttgaaatgcacagcgctgagagtttagaaaatgcgaccggattgggtcgtgtgggtgaattgccggagccgatgcgcctcgcggatttcgtgcaacaagtggccaacaacctgcctgtcaccgaatggggcgtgcgcgctaccggcgatcctgaacaaatggtgtcccgtgtggcggtttcatcagggtcgggtgacagtttcttaaacgatgtgattaagctcggagtggacgtttatgtcacttctgatctgcgccaccatccagttgatgaatatctccgagaaggtggccctgcagtaatcgatactgcacactgggccagcgaatttccatggacttcccaagcccaagaaattttgcaggacaaagccccacaggttgaagttgatgtgatttcgatccgcacagacccctggaccatgtctgcgcgagcagtgaactaaattcttgagaactaaaaaag

SEQ ID NO: 190 - protein, 261 aa, Corynebacterium glutamicum
VGITAGRPIATRLLGGMDKWGVHVLPKDAAYLKKMLFDAGAGAIGDYRECAFEIEGTGQFRPVEGANPAEGDVDKLFKSLELRIEFVAPRNLRARLTSVLREAHPYEEPAFDIVEMHSAESLENATGLGRVGELPEPMRLADFVQQVANNLPVTEWGVRATGDPEQMVSRVAVSSGSGDSFLNDVIKLGVDVYVTSDLRHHPVDEYLREGGPAVIDTAHWASEFPWTSQAQEILQDKAPQVEVDVISIRTDPWTMSARAVN

SEQ ID NO: 191 - DNA, 310 bp, Corynebacterium glutamicum
  CDS (101)..(310): FRXA00318
tcttagaaggcgtagtcacaccattaaccttgccagaatttttcaaggcttggcttgacttgggaaacgaacatgcggtaccaaccaggggaggtaatgcgtgagtgatgtaaccgttggcgatattctccgcattttggatgaggcttatccgccggcgttggcggaaagctgggacaaagtggtgctgatctgcgttgatccaacagagtcggtgaagcgtgttggtttagcactcgattgcacccaggcactggccgacaaggctgtggacatgggtttggacatgctgatcattcaccacccatta

SEQ ID NO: 192 - protein, 70 aa, Corynebacterium glutamicum
VSDVTVGDILRILDEAYPPALAESWDKVVLICVDPTESVKRVGLALDCTQALADKAVDMGLDMLIIHHPL

SEQ ID NO: 193 - DNA, 552 bp, Corynebacterium glutamicum
  CDS (101)..(529): RXN00342
cggtaatgtgcaattcggatatatcaatagccccgcggtttcatgttgaatccatgtaatcgaaaaacacatcggggcccacacgaggaggattattaaagtggccgacgctccgggcgcagtcaagcaaggtgcccaggattatgctcaactactcggcattcaatcgggtcatatcgttcaagaaattggatgggatgaagattccgacacgctgatcagcgagtccatcgaagatgcaatcggtgaggaactactcgatgaagaaaccgacgagctgtgcgatgtcgtgctgctctggtggcgcgaggatgacggcgatctcgtcgacggacttgtggattccatccgctccctcgctgagaatggtcgtatctgggtgttgactcctggcattggtaaagaaggagccctggctcctggagttatctctgaatcagctcaactggcaggtctcgtgcagaccaaggcagaacgtctcggtaattggcaaggttcttgcctcgtccagcgtggaaacaagaagccttaacaatcgctaatttccacggc

SEQ ID NO: 194 - protein, 143 aa, Corynebacterium glutamicum
VADAPGAVKQGAQDYAQLLGIQSGHIVQEIGWDEDSDTLISESIEDAIGEELLDEETDELCDVVLLWWREDDGDLVDGLVDSIRSLAENGRIWVLTPGIGKEGALAPGVISESAQLAGLVQTKAERLGNWQGSCLVQRGNKKP

SEQ ID NO: 195 - DNA, 524 bp, Corynebacterium glutamicum
  CDS (73)..(501): FRXA00342
tagccccgcggtttcatgttgaatccatgtaatcgaaaacacatcggggcccacacgaggagaattattaaagtggccgacgctccgggcgcagtcaagcaaggtgcccaggattatgctcaactactcggcattcaatcgggtcatatcgttcaagaaattggatgggatgaagattccgacacgctgatcagcgagtccatcgaagatgcaatcggtgaggaactactcgatgaagaaaccgacgagctgtgcgatgtcgtgctgctctggtggcgcgaggatgacggcgatctcgtcgacggacttgtggattccatccgctccctcgctgagaatggtcgtatctgggtgttgactcctggcattggtaaagaaggagccctggctcctggagttatctctgaatcagctcaactggcaggtctcgtgcagaccaaggcagaacgtctcggtaattggcaaggttcttgcctcgtccagcgtggaaacaagaagccttaacaatcgctaatttccacggc

SEQ ID NO: 196 - protein, 143 aa, Corynebacterium glutamicum; identical to SEQ ID NO: 194

SEQ ID NO: 197 - DNA, 1002 bp, Corynebacterium glutamicum
  CDS (101)..(979): RXN00344
cggcacggttggcgatgtcatgcagtccgaaaaactcagcgaactctacaacgcacccgtcacggtggctcgcatcaacgacagaatcgtggtggtttaagtggatctatccacctggctttccgacacccaatatctcatcagcgtcgatttcgtccagcacgcactcatcgcctccgcgctgttgggcctgctctccggtgtgatcgcgccgctcatcgtggtgcgccaacagtccttcgcagtccacggcaccgccgaactcgccctcatgggagccgccgccgcgctgctcttcggattgaatgtaggcggcggtgcagtgatcggttccgtggtcgccgcgatcctactggcattactcggcatgaaacaacaagattccgccgtcggtgccgtgatgagtttcggactcggtctgtccgtgctgttcattcacctctaccccggccgaagctccaccgcgttctccctgctcacagggcaaatcgttggtgtttcctcatcatcgctgtggatccttgtggcagtcaccgtgatcgtggttagcgccgtggtgattttctggcgcccgctgcttttcgccagcgccgatccgatcatggcgcaggcctccggagtaaacgtccgattcatcgccgttgccttcgcagttctggttggcctcaccacgtcccagtccgtgcagattgtcggtgcgctgctggtcatggcattgctgatcactcccggcgcggccgctgtggcggtgaccgccaatccagtgaaagccgtggtgctggcagtcatcttcgcggaagtatcggctgtcggtggcctgctattgtcgctagcgcctggtttgccggtgagtgtttttgtcaccaccatctcttttgtgatttacctggtctgccgcctgatcggttggctccgcggccgtggagctcagcgtgacgaagatgcttatcgacgccgccagcacgatcaccaccctcactaggcgtttcgaagtcctatttc

SEQ ID NO: 198 - protein, 293 aa, Corynebacterium glutamicum
VDLSTWLSDTQYLISVDFVQHALIASALLGLLSGVIAPLIVVRQQSFAVHGTAELALMGAAAALLFGLNVGGGAVIGSVVAAILLALLGMKQQDSAVGAVMSFGLGLSVLFIHLYPGRSSTAFSLLTGQIVGVSSSSLWILVAVTVIVVSAVVIFWRPLLFASADPIMAQASGVNVRFIAVAFAVLVGLTTSQSVQIVGALLVMALLITPGAAAVAVTANPVKAVVLAVIFAEVSAVGGLLLSLAPGLPVSVFVTTISFVIYLVCRLIGWLRGRGAQRDEDAYRRRQHDHHPH

SEQ ID NO: 199 - DNA, 594 bp, Corynebacterium glutamicum
  CDS (1)..(579): FRXA00344
atgagtttcggactcggtctgtccgtgctgttcattcacctctaccccggccgaagctccaccgcgttctccctgctcacagggcaaatcgttggtgtttcctcatcatcgctgtggatccttgtggcagtcaccgtgatcgtggttagcgccgtggtgattttctggcgcccgctgcttttcgccagcgccgatccgatcatggcgcaggcctccggagtaaacgtccgattcatcgccgttgccttcgcagttctggttggcctcaccacgtcccagtccgtgcagattgtcggtgcgctgctggtcatggcattgctgatcactcccggcgcggccgctgtggcggtgaccgccaatccagtgaaagccgtggtgctggcagtcatcttcgcggaagtatcggctgtcggtggcctgctattgtcgctagcgcctggtttgccggtgagtgtttttgtcaccaccatctcttttgtgatttacctggtctgccgcctgatcggttggctccgcggccgtggagctcagcgtgacgaagatgcttatcgacgccgccagcacgatcaccaccctcactaggcgtttcgaagt

SEQ ID NO: 200 - protein, 193 aa, Corynebacterium glutamicum
MSFGLGLSVLFIHLYPGRSSTAFSLLTGQIVGVSSSSLWILVAVTVIVVSAVVIFWRPLLFASADPIMAQASGVNVRFIAVAFAVLVGLTTSQSVQIVGALLVMALLITPGAAAVAVTANPVKAVVLAVIFAEVSAVGGLLLSLAPGLPVSVFVTTISFVIYLVCRLIGWLRGRGAQRDEDAYRRRQHDHHPH

SEQ ID NO: 201 - DNA, 816 bp, Corynebacterium glutamicum
  CDS (101)..(793): RXN00353
ctttcatcaggaccgaaagcgaacgtttcgtattgttgagccttttggttccaccacggatgcgctgatctattttcatggctcccagcagtcaggatctgtggggcgcagcttcaccaacaggacttttgatccgttgccgttcatggtggtttatccggatggggtggatcagcattggaatgatgcgcggttgggtttggatgaaaatacccgccatttaggcattgatgatgtggggttctttgtaaaactcgccacgcacttgggcaacacgtatggcatcaagaggatctttattgttggctattccaacggtgggcagatggtgttgcggctcatgcatgaggttcccaagatgctcagtggcgctgcaaccattgcatccaacatgccagttgcagagaatacgctgccgcaggtgaaaaccttcaagacacatccggtgccttatttggcgatggctggaactgccgatactttttcaccgtatgagggtggcgatgccggtattggtcgcgaacaccgccgtggcgtgggcatgtccgcctttgattcagctgcctatattgccgcccgaaacggactgaccgaacaccgccacgacgtgattgatgatgtggtgtcgatcgatacctgggatggagaaaatcccgttgagttttggacactcaacgggatcggccacttggtaccaagtgggaaaacttatccagaatttctaggcccctcaaccacatcagtgatagcggctgaggagattgggaagttctttgatggggtcaggcgtcgataagctcaagctttaaaaacgca

SEQ ID NO: 202 - protein, 231 aa, Corynebacterium glutamicum
VGRSFTNRTFDPLPFMVVYPDGVDQHWNDARLGLDENTRHLGIDDVGFFVKLATHLGNTYGIKRIFIVGYSNGGQMVLRLMHEVPKMLSGAATIASNMPVAENTLPQVKTFKTHPVPYLAMAGTADTFSPYEGGDAGIGREHRRGVGMSAFDSAAYIAARNGLTEHRHDVIDDVVSIDTWDGENPVEFWTLNGIGHLVPSGKTYPEFLGPSTTSVIAAEEIGKFFDGVRRR

SEQ ID NO: 203 - DNA, 816 bp, Corynebacterium glutamicum; identical to SEQ ID NO: 201
  CDS (101)..(793): FRXA00353

SEQ ID NO: 204 - protein, 231 aa, Corynebacterium glutamicum; identical to SEQ ID NO: 202

SEQ ID NO: 205 - DNA, 936 bp, Corynebacterium glutamicum
  CDS (101)..(913): RXN00354
ggcttgtcggtaaggctgcagggtagcgggagtttccttcagattggaagttctttaattttctcgattatgtacctcatttacgcgtaaagtttggggcatgggaaagttacttttcgtagacatcggtggcacactgctggattactcaaatgaagttccgcgttcggccgttgacgcgatccgtaaggcacgcgccaaaggacaccgcgtgtacttgagctctggtcgaagcagcgctgaggtgacttctcagttgtgggatatcggagtggatggcctcattggcgcaaatggtggatatgtggaaagcgcacaggagtctgtgttccaccgccgtttgtcgggtgaggagacccgccacattgtggagtggctctacaaccgtggtttggagttttatctcgagtccaacaacggtttgtatgcaagccgtggtttccgtgaggcttctaagccagtgctgtctcgcctttcggagaagaccgacgtgacagtcgatagcatgtacccggatatgttctggggcgcgagccttgatcgtgacgatgtgaacaagatcagttacatcttcaattctcaggaagatttggacgcagcgcgtgaggcgttccctaacctggagcacaccacgtggggtggtcagacgggtgcgttgttcggcacgatcggtgtgtctgtcaacaagaagatcggcgtggatcgcctgctgaagtacctgaacgcagatcgcgcaaacaccattgcgttcggcgacagcgatgaggatctctccctatttgaggcgagcgcttacggcgtcgcgatgggcgaggccaccgaatcgctcaaggctgctgctgacctggtcacggatgctgttgggcaggacggcttgcgcaatgcgtttttaaagcttgagcttatcgacgcctgaccccatcaaagaacttccca

SEQ ID NO: 206 - protein, 271 aa, Corynebacterium glutamicum
MGKLLFVDIGGTLLDYSNEVPRSAVDAIRKARAKGHRVYLSSGRSSAEVTSQLWDIGVDGLIGANGGYVESAQESVFHRRLSGEETRHIVEWLYNRGLEFYLESNNGLYASRGFREASKPVLSRLSEKTDVTVDSMYPDMFWGASLDRDDVNKISYIFNSQEDLDAAREAFPNLEHTTWGGQTGALFGTIGVSVNKKIGVDRLLKYLNADRANTIAFGDSDEDLSLFEASAYGVAMGEATESLKAAADLVTDAVGQDGLRNAFLKLELIDA

SEQ ID NO: 207 - DNA, 1470 bp, Corynebacterium glutamicum
  CDS (101)..(1447): RXN00362
cactttttgggtgaaaattccacgaagttaatgccgctttaagtcaattcaatcacatgtaacatgctacggttttttcggtcacttaaaggaggcgcttatgggaatcattgctctgctcgtttttatcgcaattgccgtgatattgaatgtgtttttgaaacgagatatttcagaagcattgctagttggattagtaggaactgcgcttgtcggcggtgtaaatgcaccgacattactgattgatgctgtagtggatgctgctcagtcggaagttactttcgcaggtatggcctttgttttcatgggcatcgttgtgcaatcaactggattgattgatcgattaatcgcaatccttaactcgatttttggtcggcttcgaggtggcgcaggttatgtttccactcttggatctgcgctcattggactcatcgctggatcaacggctggaaactccgcgacggttggctcagtgacgatcccttggatgaaaaagacgggatggactgctgaaaggtccgcaacgttagtcgcgggcaactctggccttggtgttgcgttgcctcccaattcaacaatgttcatcattttggcattgccagctgcagcagcttcttcggcctctcaggtgtacattgctttggcttgtggtggtgcgtatgcagtgctctaccgcttagcggtcgtcttttactggacacgtaaagataaaattcctgccacccctgatgatcaacgggtgtcattcggtgaggcaatgaagactggatggcgttcaccgttgatcttccttggaattttgatccccgtaatcctcacaatcggcccattgtctgaatggttaaagacacatggagttggggagtctggtgttaaatcgatgtcgatcatcgtgtgggtgccaattctgattacggcaattgctctgattgaagggcgtaaacgaattgctaacaacatggcacactttagggttcagatctccaaggacttgccacaatttgccaccgtaggaatttcgttgttttctgcgcttgcagcagcgaacatcatggaagaactgggtgttggcccgcagttgtctaactggcttgattccatggacctacctaagtctgtcatggtgatcattgtctgcatcatgtgcattgtggtggcaacgccactgtcgtcaacagcaaccgcggctgcgattggtgctcccgctgtcgctgcgttggctgcggtaggtattgatccaactgtggcgatcgtagtgatcttgctgtgcacttccactgaaggtgcatccccgccggtgggcgcgccgatttacctttctgctgcgatcgccgatgcaaacccaacgaaaatgttcgtaccactgattacgtactttgttgtccccatgattctgcttgcttggctagttggaatgggattcttaccagtgattgttcctacgggttaaaggggtaaaaatgaactcaa

SEQ ID NO: 208 - protein, 449 aa, Corynebacterium glutamicum
MGIIALLVFIAIAVILNVFLKRDISEALLVGLVGTALVGGVNAPTLLIDAVVDAAQSEVTFAGMAFVFMGIVVQSTGLIDRLIAILNSIFGRLRGGAGYVSTLGSALIGLIAGSTAGNSATVGSVTIPWMKKTGWTAERSATLVAGNSGLGVALPPNSTMFIILALPAAAASSASQVYIALACGGAYAVLYRLAVVFYWTRKDKIPATPDDQRVSFGEAMKTGWRSPLIFLGILIPVILTIGPLSEWLKTHGVGESGVKSMSIIVWVPILITAIALIEGRKRIANNMAHFRVQISKDLPQFATVGISLFSALAAANIMEELGVGPQLSNWLDSMDLPKSVMVIIVCIMCIVVATPLSSTATAAAIGAPAVAALAAVGIDPTVAIVVILLCTSTEGASPPVGAPIYLSAAIADANPTKMFVPLITYFVVPMILLAWLVGMGFLPVIVPTG

SEQ ID NO: 209 - DNA, 983 bp, Corynebacterium glutamicum
  CDS (1)..(960): FRXA00362
gatgaaaagacgggatggactgctgaaaggtccgcaacgttagtcgcgggcaactctggccttggtgttgcgttgcctcccaattcaacaatgttcatcattttggcattgccagctgcagcagcttcttcggcctctcaggtgtacattgctttggcttgtggtggtgcgtatgcagtgctctaccgcttagcggtcgtcttttactggacacgtaaagataaaattcctgccacccctgatgatcaacgggtgtcattcggtgaggcaatgaagactggatggcgttcaccgttgatcttccttggaattttgatccccgtaatcctcacaatcggcccattgtctgaatggttaaagacacatggagttggggagtctggtgttaaatcgatgtcgatcatcgtgtgggtgccaattctgattacggcaattgctctgattgaagggcgtaaacgaattgctaacaacatggcacactttagggttcagatctccaaggacttgccacaatttgccaccgtaggaatttcgttgttttctgcgcttgcagcagcgaacatcatggaagaactgggtgttggcccgcagttgtctaactggcttgattccatggacctacctaagtctgtcatggtgatcattgtctgcatcatgtgcattgtggtggcaacgccactgtcgtcaacagcaaccgcggctgcgattggtgctcccgctgtcgctgcgttggctgcggtaggtattgatccaactgtggcgatcgtagtgatcttgctgtgcacttccactgaaggtgcatccccgccggtgggcgcgccgatttacctttctgctgcgatcgccgatgcaaacccaacgaaaatgttcgtaccactgattacgtactttgttgtccccatgattctgcttgcttggctagttggaatgggattcttaccagtgattgttcctacgggttaaaggggtaaaaatgaactcaa

SEQ ID NO: 210 - protein, 320 aa, Corynebacterium glutamicum
DEKTGWTAERSATLVAGNSGLGVALPPNSTMFIILALPAAAASSASQVYIALACGGAYAVLYRLAVVFYWTRKDKIPATPDDQRVSFGEAMKTGWRSPLIFLGILIPVILTIGPLSEWLKTHGVGESGVKSMSIIVWVPILITAIALIEGRKRIANNMAHFRVQISKDLPQFATVGISLFSALAAANIMEELGVGPQLSNWLDSMDLPKSVMVIIVCIMCIVVATPLSSTATAAAIGAPAVAALAAVGIDPTVAIVVILLCTSTEGASPPVGAPIYLSAAIADANPTKMFVPLITYFVVPMILLAWLVGMGFLPVIVPTG

SEQ ID NO: 211 - DNA, 439 bp, Corynebacterium glutamicum
  CDS (101)..(439): RXN00373
cacgtggcggatctgcgcgctaagggcgagctgccgccgccgaggaagaaacgcaggcgtcgaaaagcgtcttaaaaggtttttcactagggtgttgtccatggacatccagcagctagacgccgaaacaacagcatggaaagacagcctcctgcgcgccgcacaggaggctggttttcattttgagccaccgaaactcttcgaggattttgagaccatggtggagcagtacaagcaggcagctgcgagcgacccggacattgatgtcactgatattcagcaaatgtggggcatcgtggtgggggagtacctgcgcgaaaaaatgggcatggaatgggtcgtcatcaccgatgactacggcactgacctcgcgattctagccacggcacccaacggggaccacgtatattcctgccccatcatcgtggtgggcaagcgc

SEQ ID NO: 212 - protein, 113 aa, Corynebacterium glutamicum
MDIQQLDAETTAWKDSLLRAAQEAGFHFEPPKLFEDFETMVEQYKQAAASDPDIDVTDIQQMWGIVVGEYLREKMGMEWVVITDDYGTDLAILATAPNGDHVYSCPIIVVGKR

SEQ ID NO: 213 - DNA, 439 bp, Corynebacterium glutamicum; identical to SEQ ID NO: 211
  CDS (101)..(439): FRXA00373

SEQ ID NO: 214 - protein, 113 aa, Corynebacterium glutamicum; identical to SEQ ID NO: 212

SEQ ID NO: 215 - DNA, 528 bp, Corynebacterium glutamicum
  CDS (101)..(505): RXN00390
ggaaatagaccgttaatagctggtctttacatttgccagaaagctccgacgaaaccccaatagttgacacggaaactaattcattctagctttagtgaccatgtcaactaccagggaaattgcattcctcatcgcacgtatcctcttgggcgtcatcctcatcgcccacggctgggacaagttcgccatcacaggacttgaaggcgtcaccggcttcttcgattcactcggcatcccagcagccggcatcgccgcaatagctgctgcagtcgtcgagctcctaggaggaatccttatcatcctaggagtatttacccgcatcgttgccgccttcgttgccatagacatgctcttcgcagcactgtttgcgcacgtctcctccggcatctttgtcaccaacaatggttgggaactcaccggcgcaatcggcgctggcgcgctgcttctcatcgcagttggcgcaagtgcatggagcatcgacggggttctggcaaaacgcaaggcctaaatctagcgccacaactccga

SEQ ID NO: 216 - protein, 135 aa, Corynebacterium glutamicum
MSTTREIAFLIARILLGVILIAHGWDKFAITGLEGVTGFFDSLGIPAAGIAAIAAAVVELLGGILIILGVFTRIVAAFVAIDMLFAALFAHVSSGIFVTNNGWELTGAIGAGALLLIAVGASAWSIDGVLAKRKA

SEQ ID NO: 217 - DNA, 528 bp, Corynebacterium glutamicum; identical to SEQ ID NO: 215
  CDS (101)..(505): FRXA00390

SEQ ID NO: 218 - protein, 135 aa, Corynebacterium glutamicum; identical to SEQ ID NO: 216

SEQ ID NO: 219 - DNA, 438 bp, Corynebacterium glutamicum
  CDS (101)..(415): RXN00399
ggacattgctatgtcgtgagttgtagtaaccccaaagcccacggattaatcaatagtgaaattcaatgattttcttttcccacaggcctaaacttaaatcatgagccacaacgacagcccaaactttgctcgccgagcgctcaattggctccgccaaggttatccaaccggtgttccgcggcacgatactttcgctctgttttacgttttggagcgcgaacttactgaggaagatctcaatgagctcgcagagcttctcatcgcggaaggtgagaacaatgggctgcacgataatcccattacgcgtgaaaaaatcggcaagctgatcacgcatgttcacagtcagccacctgaggatgaagacatcgatcgaattcagaaaaagctgcaggctgagggcttccccacccgcaattaattaattggagttttgttgtt

SEQ ID NO: 220 - protein, 105 aa, Corynebacterium glutamicum
MSHNDSPNFARRALNWLRQGYPTGVPRHDTFALFYVLERELTEEDLNELAELLIAEGENNGLHDNPITREKIGKLITHVHSQPPEDEDIDRIQKKLQAEGFPTRN

SEQ ID NO: 221 - DNA, 438 bp, Corynebacterium glutamicum; identical to SEQ ID NO: 219
  CDS (101)..(415): FRXA00399

SEQ ID NO: 222 - protein, 105 aa, Corynebacterium glutamicum; identical to SEQ ID NO: 220

SEQ ID NO: 223 - DNA, 1673 bp, Corynebacterium glutamicum
  CDS (1)..(1650): RXN00416
ctggcgtcttacttaagcccaactgcgctggtggttgcggtgttggctattccgctgtctgcgacccgcctgtatttggacggaatcagcgttgaccagggctttagaactcagtttttaacccgcatggctgacgatatcggcttgtcggacatgaactacatcgatatgcctaccttctaccctgctggatggttctggctcggtggtcgcttggccaatcttttggggctgcccggttgggaagctttccagccatgggcaattgtgtccatggcagttgctgcttctgtgttagttccagtgtggcagcgcatcaccggttccctgccggtggcaacaggcattgcgttggtgacaacctgcattatcttggcgatgaattccgaagagccctacgctgcaatcgttgcgatgggtattccagcgatgctcgtgctggcttcccgcattgccaagggcgataagtttgcgcttgccggcggcattatttacttgggtgtttcggctactttctatactttgttcaccggtgctatcgcgctttctgcggtcgcggtgtgcatcgtggtggcggctattgtgcagcgctccatcaaaccactgctgtggcttgcagtgctgggtggtggatccattgtcattgcgttgatttcttggggtccttaccttctggcctccatcaacggagcggagcgctctggcgattccgcaacacactacctgcctcttgaaggcacccaattcccggttcctttcttggcatcaagcgttgtgggactgttgtgtcttgttggcctgatctatttggtggtgcgtttccacaacaatgaggtgcgcgcgatgtgggtcggcatcgcagtgttttatgcctggatgggcatgtccatggcgatcacgcttttgggcaacacgttgcttggattccgtcttgatacggtgctggtgcttatttttgccacggctggagtgttgggcattgcagatttccgccttgccagtgtgtatcagctctaccccacccaaatcacagagcgcacggccacccatctgaccaatctaattgtggtcctcgtgctgcttggcggcctctactacgcgcaagatctgccgcagaagaacgcacgagctatcgatctggcctataccgatactgatggctacggcgagcgcgcggatctgtatccggccggagctgcacgttattacaaggacatcaacgatcatctgcttgatcaaggattcgagccttccgaaactgtcgtgctgacagacgaactcgatttcatgtcctactacccttatcgcggataccaagcttttacttcccactacgccaacccgcttggtgagttcggaaacaggaacgcattcatcgaagatctcgcgatccgaagctgggatgagttggctgatcctcaacaattcagcgacgccttgaacacctctccatggacgatccctgaggtgttcatcttccgtggctccatcgatgatcctgacgccggttggaaatacgacgtggctgaagatctgtacccgaacaatccaaacgtgcgcttccgcggcgtgtactttaacccggagtcatttgatcagatgtggcagaccaagcaagtgggacctttcgtggtggtaacgcacaatgagtaattcctcaccaaacgacccaa

SEQ ID NO: 224 - protein, 550 aa, Corynebacterium glutamicum
LASYLSPTALVVAVLAIPLSATRLYLDGISVDQGFRTQFLTRMADDIGLSDMNYIDMPTFYPAGWFWLGGRLANLLGLPGWEAFQPWAIVSMAVAASVLVPVWQRITGSLPVATGIALVTTCIILAMNSEEPYAAIVAMGIPAMLVLASRIAKGDKFALAGGIIYLGVSATFYTLFTGAIALSAVAVCIVVAAIVQRSIKPLLWLAVLGGGSIVIALISWGPYLLASINGAERSGDSATHYLPLEGTQFPVPFLASSVVGLLCLVGLIYLVVRFHNNEVRAMWVGIAVFYAWMGMSMAITLLGNTLLGFRLDTVLVLIFATAGVLGIADFRLASVYQLYPTQITERTATHLTNLIVVLVLLGGLYYAQDLPQKNARAIDLAYTDTDGYGERADLYPAGAARYYKDINDHLLDQGFEPSETVVLTDELDFMSYYPYRGYQAFTSHYANPLGEFGNRNAFIEDLAIRSWDELADPQQFSDALNTSPWTIPEVFIFRGSIDDPDAGWKYDVAEDLYPNNPNVRFRGVYFNPESFDQMWQTKQVGPFVVVTHNE

SEQ ID NO: 225 - DNA, 350 bp, Corynebacterium glutamicum
  CDS (1)..(327): FRXA00416
acttcccactacgccaacccgcttggtgagttcggaaacaggaacgcattcatcgaagatctcgcgatccgaagctggaatgagttggctgatcctcaacaattcagcgacgccttgaacacctctccatggacgatccctgaggtgttcatcttccgtggctccatcgatgatcctgacgccggttggaaatacgatgtggctgaagatctgtacccgaacaatccaaacgtgcgcttccgcggcgtgtactttaacccggagtcatttgatcagatgtggcagaccaagcaagtgggacctttcgtggtggtaacgcacaatgagtaattcctcaccaaacgacccaa

SEQ ID NO: 226 - protein, 109 aa, Corynebacterium glutamicum
TSHYANPLGEFGNRNAFIEDLAIRSWNELADPQQFSDALNTSPWTIPEVFIFRGSIDDPDAGWKYDVAEDLYPNNPNVRFRGVYFNPESFDQMWQTKQVGPFVVVTHNE

SEQ ID NO: 227 - DNA, 1065 bp, Corynebacterium glutamicum
  CDS (1)..(1065): FRXA00418
ctggcgtcttacttaagcccaactgcgctggtggttgcggtgttggctattccgctgtctgcgacccgcctgtatttggacggaatcagcgttgaccagggctttagaactcagtttttaacccgcatggctgacgatatcggcttgtcggacatgaactacatcgatatgcctaccttctaccctgctggatggttctggctcggtggtcgcttggccaatcttttggggctgcccggttgggaagctttccagccatgggcaattgtgtccatggcagttgctgcttctgtgttagttccagtgtggcagcgcatcaccggttccctgccggtggcaacaggcattgcgttggtgacaacctgcattatcttggcgatgaattccgaagagccctacgctgcaatcgttgcgatgggtattccagcgatgctcgtgctggcttcccgcattgccaagggcgataagtttgcgcttgccggcggcattatttacttgggtgtttcggctactttctatactttgttcaccggtgctatcgcgctttctgcggtcgcggtgtgcatcgtggtggcggctattgtgcagcgctccatcaaaccactgctgtggcttgcagtgctgggtggtggatccattgtcattgcgttgatttcttggggtccttaccttctggcctccatcaacggagcggagcgctctggcgattccgcaacacactacctgcctcttgaaggcacccaattcccggttcctttcttggcatcaagcgttgtgggactgttgtgtcttgttggcctgatctatttggtggtgcgtttccacaacaatgaggtgcgcgcgatgtgggtcggcatcgcagtgttttatgcctggatgggcatgtccatggcgatcacgcttttgggcaacacgttgcttggattccgtcttgatacggtgctggtgcttatttttgccacggctggagtgttgggcattgcagatttccgccttgccagtgtgtatcagctctaccccacccaaatcacagagcgcacggccacccatctgaccaatctaatt

SEQ ID NO: 228 - protein, 355 aa, Corynebacterium glutamicum
LASYLSPTALVVAVLAIPLSATRLYLDGISVDQGFRTQFLTRMADDIGLSDMNYIDMPTFYPAGWFWLGGRLANLLGLPGWEAFQPWAIVSMAVAASVLVPVWQRITGSLPVATGIALVTTCIILAMNSEEPYAAIVAMGIPAMLVLASRIAKGDKFALAGGIIYLGVSATFYTLFTGAIALSAVAVCIVVAAIVQRSIKPLLWLAVLGGGSIVIALISWGPYLLASINGAERSGDSATHYLPLEGTQFPVPFLASSVVGLLCLVGLIYLVVRFHNNEVRAMWVGIAVFYAWMGMSMAITLLGNTLLGFRLDTVLVLIFATAGVLGIADFRLASVYQLYPTQITERTATHLTNLI

SEQ ID NO: 229 - DNA, 1017 bp, Corynebacterium glutamicum
  CDS (101)..(994): RXN00422
aagcgccgggcgcggaaggcgctggctgaggccttcggcgcggaggtccagccactgccgcttgacaccgaataggacaaatgggtctatcctggggcgcatgcccacgaattatgcacgcgacaacgtcatttccttggcgtctgcccgcgagcagcgttccgggaaacccgagcccaaacccgaactaacactcatcgtccgcgccaccaacgtgcaagcggacggcgaggtccacaggcaaattgggttgaactcggcgatgagcctggacgagctgcacaatgtactcaacatcgttttcggtgttggcggcgagcagtcaccctggcgtttcgaagaccaattccaccaacccagcgcccccgacaccaacctcggcgaactcctgcccgaacccggcgacttcctgttttacttctggggcctgtggcaattcaacctgcaatgcgtggaaatgtacccgcgcgacaacggcaccccgcgcgcgctgtgcatcggcggctccggcggcctcggcgacgacttcgaccaagccaccatcaacgccgaactcaccggcaccgacaccatccgcgacgtcctctccggcgtgcgccccgaagtcatcgacctcgtcgaccgcaccggcgtcttcgacttcatcccactgctccaagcgctcgacctcaaaagagaaccgcttatcgacgccacccgctaccacacctgccgcacgctgccagtggaaaacagcgccgaagcctccgacgcattctggtcctgcgtactcgccctgtcctgcctcggaaacgacgaacttttcatcgaagtgatcgaatccacaatgagcaccctcggctgggtcgccgacgacggctccccactacgtgcaccagagatcaccagcgcctgcgaagcctccctgaagatactcgcggaactcggtggctacggcccagagcggcttgcccccgtggatcgcctggacatttatagggagctgctgtgtttctaggtattgtgtaacctcgtgtc

SEQ ID NO: 230 - protein, 298 aa, Corynebacterium glutamicum
MPTNYARDNVISLASAREQRSGKPEPKPELTLIVRATNVQADGEVHRQIGLNSAMSLDELHNVLNIVFGVGGEQSPWRFEDQFHQPSAPDTNLGELLPEPGDFLFYFWGLWQFNLQCVEMYPRDNGTPRALCIGGSGGLGDDFDQATINAELTGTDTIRDVLSGVRPEVIDLVDRTGVFDFIPLLQALDLKREPLIDATRYHTCRTLPVENSAEASDAFWSCVLALSCLGNDELFIEVIESTMSTLGWVADDGSPLRAPEITSACEASLKILAELGGYGPERLAPVDRLDIYRELLCF

SEQ ID NO: 231 - DNA, 523 bp, Corynebacterium glutamicum
  CDS (101)..(523): FRXA00422
aagcgccgggcgcggaaggcgctggctgaggccttcggcgcggaggtccagccactgccgcttgacaccgaataggacaaatgggtctatcctggggcgcatgcccacgaattatgcacgcgacaacgtcatttccttggcgtctgcccgcgagcagcgttccgggaaacccgagcccaaacccgaactaacactcatcgtccgcgccaccaacgtgcaagcggacggcgaggtccacaggcaaattgggttgaactcggcgatgagcctggacgagctgcacaatgtactcaacatcgttttcggtgttggcggcgagcagtcaccctggcgtttcgaagaccaattccaccaacccagcgcccccgacaccaacctcggcgaactcctgcccgaacccggcgacttcctgttttacttctggggcctgtggcaattcaacctgcaatgcgtggaaatgtacccgcgcgacaacggcaccccgcgcgcgctgtgcatcggcggctccggcggcctcggcgac

SEQ ID NO: 232 - protein, 141 aa, Corynebacterium glutamicum
MPTNYARDNVISLASAREQRSGKPEPKPELTLIVRATNVQADGEVHRQIGLNSAMSLDELHNVLNIVFGVGGEQSPWRFEDQFHQPSAPDTNLGELLPEPGDFLFYFWGLWQFNLQCVEMYPRDNGTPRALCIGGSGGLGD

SEQ ID NO: 233 - DNA, 543 bp, Corynebacterium glutamicum
  CDS (101)..(520): RXN00447
gagcacggcatcgtgattcgcgcgttccccgagggtgcgcgcatttcggtgaccaacgccgaggaaactgacaagctgctgcgcgcgtgggaggccatcaatgctgggtagtctttggcgttttgcggtgcgcaccgcagcaggcgcggtggcgttgtgggtggttattaagcttatcgacggcatctccctgagttttcccaccacacctctctatcaggacggtcagcacgacaatctgctgacattcctggcggtggcagcaatcattgtcgtgttgaatgccacggtgaaacccgtcttgaagctgcttggtttgccgttgacaatcatcaccttgggtctgttctcgctggtcatcaacgcggtaatcatgctgctggcggagtatgtgtcagatttgatcggtttcggtctacgcattgaaaccttcggtgcggccttctggggtgcgattgtgctggcgttagtgaactgggttcttggccccattaccggcctcctcggtgcaaaaaaggactaaccatggcggatctgagcatt

SEQ ID NO: 234 - protein, 140 aa, Corynebacterium glutamicum
MLGSLWRFAVRTAAGAVALWVVIKLIDGISLSFPTTPLYQDGQHDNLLTFLAVAAIIVVLNATVKPVLKLLGLPLTIITLGLFSLVINAVIMLLAEYVSDLIGFGLRIETFGAAFWGAIVLALVNWVLGPITGLLGAKKD

SEQ ID NO: 235 - DNA, 400 bp, Corynebacterium glutamicum
  CDS (101)..(400): FRXA00447
gagcacggcatcgtgattcgcgcgttccccgagggtgcgcgcatttcggtgaccaacgccgaggaaactgacaagctgctgcgcgcgtgggaggccatcaatgctgggtagtctttggcgttttgcggtgcgcaccgcagcaggcgcggtggcgttgtgggtggttattaagcttatcgacggcatctccctgagttttcccaccacacctctctatcaggacggtcagcacgacaatctgctgacattcctggcggtggcagcaatcattgtcgtgttgaatgccacggtgaaacccgtcttgaagctgcttggtttgccgttgacaatcatcaccttgggtctgttctcgctggtcatcaacgcggtaatcatgctgctggcggagtatgtgtcagat

SEQ ID NO: 236 - protein, 100 aa, Corynebacterium glutamicum
MLGSLWRFAVRTAAGAVALWVVIKLIDGISLSFPTTPLYQDGQHDNLLTFLAVAAIIVVLNATVKPVLKLLGLPLTIITLGLFSLVINAVIMLLAEYVSD

SEQ ID NO: 237 - DNA, 873 bp, Corynebacterium glutamicum
  CDS (101)..(850): RXN00455
gaagtgtctggccgattggctaacaatctctagttaaatcccgcctcatgaaaccacgatgaaaccaacatgagagttttttcatccacgttttctggctatggttgtggacgtgcaaaatcaatcacacaccccagaaacccagcctcaacctgggcagggcgcagccaagaaaacccccgttgcgtccggaaactccacgttcattcacattcagccaagcttgtaccccattttgctggcgctgtttgttgcagtctttctaatttcaaatatcaccgcaaccaagggcgtagaaatcggcccgttggtgacagacggtgcgttcttcctcttccccatctcatatgtgttgggcgatgttctagccgaatgttacggcttcaaatccactcgtcgtgccattcttactggttttggcatcacgatgctcgcggcgctgtctttctacatttccatctggctgcctggcgcaagtttctgggaaggccaagaagctttcgaagcaacgctcggccttgttccacagatcatcgtggcatcactggcgggctatattgtgggtcagctgctcaacgccaaagttctggtggctatcaaaaagcgcacgggtgaaaagtccctgtgggcgcgcctgattggttccaccgttgtcggagaatttgtcgataccctgctgttttgcgccatcgcagcgccagtgatcggtattgccaccgccccggatttcatcaactacgttgtggtgggcttcgtgtggaaaacccttctagaggtcatcctcatgcccatcacctacgcagtcattaggtgggtgaaacgccgcgaaggttatgaaaccttcgacgcgtagtaccggcctaagaattcttc

SEQ ID NO: 238 - protein, 250 aa, Corynebacterium glutamicum
MVVDVQNQSHTPETQPQPGQGAAKKTPVASGNSTFIHIQPSLYPILLALFVAVFLISNITATKGVEIGPLVTDGAFFLFPISYVLGDVLAECYGFKSTRRAILTGFGITMLAALSFYISIWLPGASFWEGQEAFEATLGLVPQIIVASLAGYIVGQLLNAKVLVAIKKRTGEKSLWARLIGSTVVGEFVDTLLFCAIAAPVIGIATAPDFINYVVVGFVWKTLLEVILMPITYAVIRWVKRREGYETFDA

SEQ ID NO: 239 - DNA, 641 bp, Corynebacterium glutamicum
  CDS (1)..(618): FRXA00455
attttgctggcgctgtttgttgcagtctttctaatttcaaatatcaccgcaaccaagggcgtagaaatcggcccgttggtgacagacggtgcgttcttcctcttccccatctcatatgtgttgggcgatgttctagccgaatgttacggcttcaaatccactcgtcgtgccattcttactggttttggcatcacgatgctcgcggcgctgtctttctacatttccatctggctgcctggcgcaagtttctgggaaggccaagaagctttcgaagcaacgctcggccttgttccacagatcatcgtggcatcactggcgggctatattgtgggtcagctgctcaacgccaaagttctggtggctatcaaaaagcgcacgggtgaaaagtccctgtgggcgcgcctgattggttccaccgttgtcggagaatttgtcgataccctgctgttttgcgccatcgcagcgccagtgatcggtattgccaccgccccggatttcatcaactacgttgtggtgggcttcgtgtggaaaacccttctagaggtcatcctcatgcccatcacctacgcagtcattaggtgggtgaaacgccgcgaaggttatgaaaccttcgacgcgtagtaccggcctaagaattcttc

SEQ ID NO: 240 - protein, 206 aa, Corynebacterium glutamicum
ILLALFVAVFLISNITATKGVEIGPLVTDGAFFLFPISYVLGDVLAECYGFKSTRRAILTGFGITMLAALSFYISIWLPGASFWEGQEAFEATLGLVPQIIVASLAGYIVGQLLNAKVLVAIKKRTGEKSLWARLIGSTVVGEFVDTLLFCAIAAPVIGIATAPDFINYVVVGFVWKTLLEVILMPITYAVIRWVKRREGYETFDA

SEQ ID NO: 241 - DNA, 912 bp, Corynebacterium glutamicum
  CDS (101)..(889): RXN00473
ggggcagctgtggatttttcacaaccaccccttttctcacaccagccccgcatgaacaggctggttgcacaccgttgaaaatgagtgtttactggaactcatgagtggaacaggtgttcgaaagttgtggggagatggcactccggtgtcgctccctgacctttcaggattaagtagagcggagcgcattgatgcgttgcgttcacgcatgtccaccatgggtgctgcggtgccaaagtttgagccgtcggtggaagaaagtgctgaacaaaagcaggattctctcgccgaaaaacaggacatagttgcagttccttccgctttttctgatcttttccctggggatggtttgccgcgtcgtgcggttactcaattggttgaacagccacttgtggtggtggacttcctggctcatattactgcccagggtggacacgctgcggtgattgggtggaaggatttagcctacgccggggtgattgattccggaggtgtgtgcgagaacatcattgctattccaaatcctggtacggagccactgaatgtggcagcggtgctgtgtgaggggttggatgtggtcgtgtacaaaggcccggagatttccctgtcgccaaccagagcgaggccgttgctgggaaagctgaggcaggggactgctgccttggtgatggttggcacgaaagtaagctcaccggcgctgtcggtggatgcagagatcactgattatgttggcattggtgcaggtagtgggcgtattcgtggcgttgagatgcaggtgcgggctgtgtcgaaaactcacggtgtgcgcagcggaaaagtcctgatcagtaggcctcaggatgcagcattgcttgagcctgaacagccaacaacgttgcgggcggtcccatgacgcgggtgatggcattgtgg

SEQ ID NO: 242 - protein, 263 aa, Corynebacterium glutamicum
MSGTGVRKLWGDGTPVSLPDLSGLSRAERIDALRSRMSTMGAAVPKFEPSVEESAEQKQDSLAEKQDIVAVPSAFSDLFPGDGLPRRAVTQLVEQPLVVVDFLAHITAQGGHAAVIGWKDLAYAGVIDSGGVCENIIAIPNPGTEPLNVAAVLCEGLDVVVYKGPEISLSPTRARPLLGKLRQGTAALVMVGTKVSSPALSVDAEITDYVGIGAGSGRIRGVEMQVRAVSKTHGVRSGKVLISRPQDAALLEPEQPTTLRAVP

SEQ ID NO: 243 - DNA, 888 bp, Corynebacterium glutamicum
  CDS (101)..(865): FRXA00473
ccaccccttttctcacaccagccccgcatgaacaggctggttgcacaccgttgaaaatgagtgtttactggaactcatgagtggaacaggtgttcgaaagttgtggggagatggcactccggtgtcgctccctgacctttcaggattaagtagagcggagcgcattgatgcgttgcgttcacgcatgtccaccatgggtgctgcggtgccaaagtttgagccgtcggtggaagaaagtgctgaacaaaagcaggattctctcgccgaaaaacaggacatagttgcagttccttccgctttttctgatcttttccctggggatggtttgccgcgtcgtgcggttactcaattggttgaacagccacttgtggtggtggacttcctggctcatattactgcccagggtggacacgctgcggtgattgggtggaaggatttagcctacgccggggtgattgattccggaggtgtgtgcgagaacatcattgctattccaaatcctggtacggagccactgaatgtggcagcggtgctgtgtgaggggttggatgtggtcgtgtacaaaggcccggagatttccctgtcgccaaccagagcgaggccgttgctgggaaagctgaggcaggggactgctgccttggtgatggttggcacgaaagtaagctcaccggcgctgtcggtggatgcagagatcactgattatgttggcattggtgcaggtagtgggcgtattcgtggcgttgagatgcaggtgcgggctgtgtcgaaaactcacggtgtgcgcagcggaaaagtcctgatcagtaggcctcaggatgcagcattgcttgagcctgaacagccaacaacgttgcgggcggtcccatgacgcgggtgatggcattgtgg

SEQ ID NO: 244 - protein, 255 aa, Corynebacterium glutamicum
LWGDGTPVSLPDLSGLSRAERIDALRSRMSTMGAAVPKFEPSVEESAEQKQDSLAEKQDIVAVPSAFSDLFPGDGLPRRAVTQLVEQPLVVVDFLAHITAQGGHAAVIGWKDLAYAGVIDSGGVCENIIAIPNPGTEPLNVAAVLCEGLDVVVYKGPEISLSPTRARPLLGKLRQGTAALVMVGTKVSSPALSVDAEITDYVGIGAGSGRIRGVEMQVRAVSKTHGVRSGKVLISRPQDAALLEPEQPTTLRAVP

SEQ ID NO: 245 - DNA, 2418 bp, Corynebacterium glutamicum
  CDS (101)..(2395): RXN00485
tcaacttcggcgacgaggtgggcgctatttttcattgtttttcgcgattttcgcttcggttgcattgactgttagcgccactgcgttgacaaattctttggtgtccagtgttaatgatctttttgccaagccgtatgaaaacgctgatcttgtggtcacggtgtctgcgaaaaacgaagattcctttgcagcttttgagcaacaattagctacgacacctggtgttgaagctctggcttttgatcaaaattttgcagcctctgtaaagcaatcagacgggatttacgccagtacttcagtccagtcaatttcggaaggcccactgcagtggcggccaatcctagaaggccgattgccccaaggacctggtgagattgcagtaacaacggccccgggtgcgcctgaagttggtgagcacgtatccattcgcctgtcccaaaacactgaggacactgaggttcttgtggttggcgtggtggagccagcggcgcaggaaactttaggtggcgcaccgttcgttgtggcgtctcctgatgcgctgatggagtggaattcttccggtgtgcggggtgaattccgagtggcaacttccgatcctgcctcgctagaggctgcaagctttagcgacgctacggtggtggttgcttcggcggaggggcacgtcgataagcttgctgattcttatttgggccagcgagatcgctatttcttgctgctcgcagcgtttgtggcagtggctgctgccgtggcgtttttggtggtcttttctgcatattcggtgctcactggtgagcgagttcgcgagttcgggctgattcgttcagtgggcgcatcgacgccgcagattttggggtcagtgatttttgaagccggcatcctcggtgtggtggctgctggttttggtgcgcccgccggattgatggcggcgcgtttgttggcggataatgccgcacgttttggcattcgtgtgcccattgatgtgattgatctgccaagtagcacgatgtggctcatcgctggcgtcggcgtggtgatgtccgtgattgcggcattaccggcagtgttcagtgtgtgcagaaaatccgcagtggaatcactgagtacgcctgctatttcgaggacttccccctggttcggtgcattatggttgctgctcgcgggcattgtgggcgccggcggaatgtgggcgtatgaggcaacctcggactaccgcggcatgcgttcagtggctttatccatcgccggttcaggcgctttggtgtgtgcgttgttgattgccacggcggtgctcgtgccctggttattgcacgtattctccaggattgtgggcggcaccgtcccaacacttcagttgggattggcgtttgcagcaaagcagaaatctcgttcggcggcgctgatcgctgtgattcttgctggttctgcattaagctccgctgttctgcatggccaggcacatatcggcacgcatttggtggccgtggctaaaggcatgggcggcacagacatgatggttacagcgcttgatggggaaatccccgccggaatgctggaggaaatctctagcatcgacggcgtgaaaactgccatcgcgccagccaccaccgctgtggaattggaagattccggcaatttctctgtgctcatgctcgctgaagaagacggagcctccgtgatgcgcgcaggcgatactggtgcaccagctggtggccttgttttgggcagaaactctcctgaccaggatgcttacccggccggccaggctgcaaacatcattgtcgcggataccccaacgcaggcggaaatcttccacagcgacaactacttctccatgatcgacccagcactcgccaccggccccagcaccacacgcaacgtactgatcctgctcgacggcgactccaaccaggcccccgacaacgccacggcgcaggcggtacgcaagaccatttcgcttttcgacggacgatactccatcaccgagggtttctccgcccgccaaaacacttttgaactggtttcccgcatcaccaccatgtccacactgcttgccatcgtggccttagcgatcgctgccgttggcctgatcaacacagtggcactcaccatttctgagcgtgcccgcgatcgttatttgctgcgcaccattggactgacctcaactggtcagattctggtgatggctattgaaatgatcgcgctctcattgccggctgccattgttggtgcagtttcgggaggattcttaggcagattcgttgccagttctgccaccaacaccgctgcgacggcaccacttcaagtagacattctcggcggaacggttctcgcgatggtcgcaggatctgtactgtgcgcgctcatcgtgctggcgaacaaacgacgtcgggtggtttgattataaaatccaaaaatcga

SEQ ID NO: 246 - protein, 765 aa, Corynebacterium glutamicum
VSSVNDLFAKPYENADLVVTVSAKNEDSFAAFEQQLATTPGVEALAFDQNFAASVKQSDGIYASTSVQSISEGPLQWRPILEGRLPQGPGEIAVTTAPGAPEVGEHVSIRLSQNTEDTEVLVVGVVEPAAQETLGGAPFVVASPDALMEWNSSGVRGEFRVATSDPASLEAASFSDATVVVASAEGHVDKLADSYLGQRDRYFLLLAAFVAVAAAVAFLVVFSAYSVLTGERVREFGLIRSVGASTPQILGSVIFEAGILGVVAAGFGAPAGLMAARLLADNAARFGIRVPIDVIDLPSSTMWLIAGVGVVMSVIAALPAVFSVCRKSAVESLSTPAISRTSPWFGALWLLLAGIVGAGGMWAYEATSDYRGMRSVALSIAGSGALVCALLIATAVLVPWLLHVFSRIVGGTVPTLQLGLAFAAKQKSRSAALIAVILAGSALSSAVLHGQAHIGTHLVAVAKGMGGTDMMVTALDGEIPAGMLEEISSIDGVKTAIAPATTAVELEDSGNFSVLMLAEEDGASVMRAGDTGAPAGGLVLGRNSPDQDAYPAGQAANIIVADTPTQAEIFHSDNYFSMIDPALATGPSTTRNVLILLDGDSNQAPDNATAQAVRKTISLFDGRYSITEGFSARQNTFELVSRITTMSTLLAIVALAIAAVGLINTVALTISERARDRYLLRTIGLTSTGQILVMAIEMIALSLPAAIVGAVSGGFLGRFVASSATNTAATAPLQVDILGGTVLAMVAGSVLCALIVLANKRRRVV

SEQ ID NO: 247 - DNA, 2166 bp, Corynebacterium glutamicum
  CDS (101)..(2143): FRXA00485
tgcagcctctgtaaagcaatcagacgggatttacgccagtacttcagtccagtcaatttcggaaggcccactgcagtggcggccaatcctagaaggccgattgccccaaggacctggtgagattgcagtaacaacggccccgggtgcgcctgaagttggtgagcacgtatccattcgcctgtcccaaaacactgaggacactgaggttcttgtggttggcgtggtggagccagcggcgcaggaaactttaggtggcgcaccgttcgttgtggcgtctcctgatgcgctgatggagtggaattcttccggtgtgcggggtgaattccgagtggcaacttccgatcctgcctcgctagaggctgcaagctttagcgacgctacggtggtggttgcttcggcggaggggcacgtcgataagcttgctgattcttatttgggccagcgagatcgctatttcttgctgctcgcagcgtttgtggcagtggctgctgccgtggcgtttttggtggtcttttctgcatattcggtgctcactggtgagcgagttcgcgagttcgggctgattcgttcagtgggcgcatcgacgccgcagattttggggtcagtgatttttgaagccggcatcctcggtgtggtggctgctggttttggtgcgcccgccggattgatggcggcgcgtttgttggcggataatgccgcacgttttggcattcgtgtgcccattgatgtgattgatctgccaagtagcacgatgtggctcatcgctggcgtcggcgtggtgatgtccgtgattgcggcattaccggcagtgttcagtgtgtgcagaaaatccgcagtggaatcactgagtacgcctgctatttcgaggacttccccctggttcggtgcattatggttgctgctcgcgggcattgtgggcgccggcggaatgtgggcgtatgaggcaacctcggactaccgcggcatgcgttcagtggctttatccatcgccggttcaggcgctttggtgtgtgcgttgttgattgccacggcggtgctcgtgccctggttattgcacgtattctccaggattgtgggcggcaccgtcccaacacttcagttgggattggcgtttgcagcaaagcagaaatctcgttcggcggcgctgatcgctgtgattcttgctggttctgcattaagctccgctgttctgcatggccaggcacatatcggcacgcatttggtggccgtggctaaaggcatgggcggcacagacatgatggttacagcgcttgatggggaaatccccgccggaatgctggaggaaatctctagcatcgacggcgtgaaaactgccatcgcgccagccaccaccgctgtggaattggaagattccggcaatttctctgtgctcatgctcgctgaagaagacggagcctccgtgatgcgcgcaggcgatactggtgcaccagctggtggccttgttttgggcagaaactctcctgaccaggatgcttacccggccggccaggctgcaaacatcattgtcgcggataccccaacgcaggcggaaatcttccacagcgacaactacttctccatgatcgacccagcactcgccaccggccccagcaccacacgcaacgtactgatcctgctcgacggcgactccaaccaggcccccgacaacgccacggcgcaggcggtacgcaagaccatttcgcttttcgacggacgatactccatcaccgagggtttctccgcccgccaaaacacttttgaactggtttcccgcatcaccaccatgtccacactgcttgccatcgtggccttagcgatcgctgccgttggcctgatcaacacagtggcactcaccatttctgagcgtgcccgcgatcgttatttgctgcgcaccattggactgacctcaactggtcagattctggtgatggctattgaaatgatcgcgctctcattgccggctgccattgttggtgcagtttcgggaggattcttaggcagattcgttgccagttctgccaccaacaccgctgcgacggcaccacttcaagtagacattctcggcggaacggttctcgcgatggtcgcaggatctgtactgtgcgcgctcatcgtgctggcgaacaaacgacgtcgggtggtttgattataaaatccaaaaatcga

SEQ ID NO: 248 - protein, 681 aa, Corynebacterium glutamicum
LPQGPGEIAVTTAPGAPEVGEHVSIRLSQNTEDTEVLVVGVVEPAAQETLGGAPFVVASPDALMEWNSSGVRGEFRVATSDPASLEAASFSDATVVVASAEGHVDKLADSYLGQRDRYFLLLAAFVAVAAAVAFLVVFSAYSVLTGERVREFGLIRSVGASTPQILGSVIFEAGILGVVAAGFGAPAGLMAARLLADNAARFGIRVPIDVIDLPSSTMWLIAGVGVVMSVIAALPAVFSVCRKSAVESLSTPAISRTSPWFGALWLLLAGIVGAGGMWAYEATSDYRGMRSVALSIAGSGALVCALLIATAVLVPWLLHVFSRIVGGTVPTLQLGLAFAAKQKSRSAALIAVILAGSALSSAVLHGQAHIGTHLVAVAKGMGGTDMMVTALDGEIPAGMLEEISSIDGVKTAIAPATTAVELEDSGNFSVLMLAEEDGASVMRAGDTGAPAGGLVLGRNSPDQDAYPAGQAANIIVADTPTQAEIFHSDNYFSMIDPALATGPSTTRNVLILLDGDSNQAPDNATAQAVRKTISLFDGRYSITEGFSARQNTFELVSRITTMSTLLAIVALAIAAVGLINTVALTISERARDRYLLRTIGLTSTGQILVMAIEMIALSLPAAIVGAVSGGFLGRFVASSATNTAATAPLQVDILGGTVLAMVAGSVLCALIVLANKRRRVV

SEQ ID NO: 249 - DNA, 1149 bp, Corynebacterium glutamicum
  CDS (101)..(1126): RXN00496
ctgcagagatggtgggcagcaccccaggtgctgtacgagttgcccaacacagggcactcacgacacttcgaagcacacttgagcagcaggagaacaagtaatgactcgacgtctacatggtggtgagcaggatggccaggaacacgttaaaggacagctaaagcagctgttcgacgacgacgcgttcttgactgacctgtcccgcggcgttgatccctcagagggcgatgacgccctcgctggcctcctcctcgatttaacaaaggaagctcaggagccgccggcaacaatgccggattggtctactttgctccctggaattttggatcaggatcaggatttgccagtggaatccacttcggacaccacggttatgcaggcatcaaaccctgcaacccaagaattcgcacctgtttctatttctgatacccccaacactgcaactaattcagctgatgcagatgagtccgcaactgttgttccacttgcagcacgccgtgagaagcgtgccaagagcggatcaagcggggttcattcactggatgcttcggcaacccagcgcaaatctcacccattccttagcggtttggtgggtgctgcagctgcaactctagtcatcgcaggcggtggagcagcagtgtacaacgctgatgaaaactccccgttgtatggcatgaatcagcagctgtttggcaatcaagattctccaagcgtggtggagcttgcctccacgctggaagaagttgatagtcgtacagctagtggcgatgtggaaggggcacgtgctctactcgagcaggctcgagcaatgctggatggcatggcacctcctcgaaaggcgccgtcggaggcaacccgaacggttgaatctgaaccaggtactcagacgttgactgcaacggttactgaatccgcaagtccggaaccaccggtcacggaaactcaaactgttacctccaccgaggtacagacagtgacaaccactgcggttgctccaccggtctggactcctaatccagagccaacaaccacagctgccccgacttctacgccttcaactggtggcggtgagggaaccggcaatgatggtgactctggacttgtgccacctcagactcctggaaactaggtaaaaatataaaaactgct

SEQ ID NO: 250 - protein, 342 aa, Corynebacterium glutamicum
MTRRLHGGEQDGQEHVKGQLKQLFDDDAFLTDLSRGVDPSEGDDALAGLLLDLTKEAQEPPATMPDWSTLLPGILDQDQDLPVESTSDTTVMQASNPATQEFAPVSISDTPNTATNSADADESATVVPLAARREKRAKSGSSGVHSLDASATQRKSHPFLSGLVGAAAATLVIAGGGAAVYNADENSPLYGMNQQLFGNQDSPSVVELASTLEEVDSRTASGDVEGARALLEQARAMLDGMAPPRKAPSEATRTVESEPGTQTLTATVTESASPEPPVTETQTVTSTEVQTVTTTAVAPPVWTPNPEPTTTAAPTSTPSTGGGEGTGNDGDSGLVPPQTPGN

SEQ ID NO: 251 - DNA, 502 bp, Corynebacterium glutamicum
  CDS (101)..(502): FRXA00496
ctgcagagatggtgggcagcaccccaggtgctgtacgagttgcccaacacagggcactcacgacacttcgaagcacacttgagcagcaggagaacaagtaatgactcgacgtctacatggtggtgagcaggatggccaggaacacgttaaaggacagctaaagcagctgttcgacgacgacgcgttcttgactgacctgtcccgcggcgttgatccctcagagggcgatgacgccctcgctggcctcctcctcgatttaacaaaggaagctcaggagccgccggcaacaatgccggattggtctactttgctccctggaattttggatcaggatcaggatttgccagtggaatccacttcggacaccacggttatgcaggcatcaaaccctgcaacccaagaattcgcacctgtttctatttctgatacccccaacactgcaactaattcagctgatgcagatgagtccgcaactgttgttccacttgcagcacgccgtgag

SEQ ID NO: 252 - protein, 134 aa, Corynebacterium glutamicum
MTRRLHGGEQDGQEHVKGQLKQLFDDDAFLTDLSRGVDPSEGDDALAGLLLDLTKEAQEPPATMPDWSTLLPGILDQDQDLPVESTSDTTVMQASNPATQEFAPVSISDTPNTATNSADADESATVVPLAARRE

SEQ ID NO: 253 - DNA, 1845 bp, Corynebacterium glutamicum
  CDS (101)..(1822): RXN00503
aatccacgaaggtgcccaagaatcaccaatttcggtcggaactgatccttctttgtccgttgagaccccacaggtgttttaaacatttagtattagttccatgaaaccagtcttctccgttgaccaaatccgacgcgcagaaaacaccctttttgagcttcaggcagatccggatgagctgatgatctccgcggcatcggcggtggccgatgtcgcgttggcaatggtggacggccccgctccagcggtctccagtgaggagtcaatcctgctgctggtcggccccggtggcaacggtggcgacgccttgtatgcaggcgcgttccttgcagaagaaggccaccacgttgatgctttgctgttgggaaacggcaaagtccatcaatcagcattggcatattatgagtctttgggcgggcagatcatttccgattttccccctcactacctctaccgcctggtgattgatggtttgtttggcatcggtggtcggggagggctcaccccagagctggccagtttggtggagtctttttccgcttcaggtatccccattttggcgattgatgtgccgtctggcgtgcatgccgatagtggtgaactgccgcccggcgtgatggtgacggtggaaggatttgataatgatgcaccgatggcgcgtcagaaaattccggcacacattgacgctgatgtcacgatcacgtttggcggtttgagacgcgcccacgcggtcagtcctgcgtgtggtgaagtgctctgtgctgatatcaacatcgctggtggcggcggaaaatcgctgtccgctgagttgagtcaggtgcaggcagaagacgcgaccccgcagatgtttgcctccaaggcgtatcaacggaaagattcgctttttgagcgcgcgaatctcaaagctacggcgccacatatccataggatcggccagcactttaccgtgttgaacatggagcctggcccggatcatgataaatacagtggcggaattgtcggcattgttgcaggtagtggcacctatccaggtgctgctgtgctgtcggtgaaggcggctgtcagggccacaagcgccatggttcgatacgttggccctgcgttaaattttgtcatccagtcgctgccggaggtcgtcgcaacgcaatcacttgccaccgccggccgcgtgcaagcgtgggtgcacggccccggacgcgggctggaggctgagcaatcagccgagcttgcggagcttttgagccggcctgagcctgtgcttatcgacgccgacagcctctcattactccagctctcagcggagcttcggcaggcgttgcgcgagcgaaaagcaccaacggtgctcactccgcacaagggcgaatttgaacgcatcgcagcagaattacgctctgaaggcgtcgagattccccaagcggacaaagatcccattggtgctgcgcaagcgttagctaaagaatttgattgttgcgtactgctcaaggggaaatacaccgtcattgcagctcacgactttgtgcatgcgatcaacgctgggcattcctggttggctacacctggctctggcgatgtgttgtcaggtcttgtcggtgcacacttggctcaaagctacgcagaattaaaccgcttgccggagtttttccccgatgtgaccttgtctgattcggcgatttacacccagattgcacctgctgcgaccatccacgcggttgctgctgggttggccgcacgaaccgaatttgggtttgcgccgacctccgcaagtttgatcgctgatgccatccctgcagcgaccgccaaggtggatttgaagcgaattgtctagctctgcatgaattccgtatg

SEQ ID NO: 254 - protein, 574 aa, Corynebacterium glutamicum
MKPVFSVDQIRRAENTLFELQADPDELMISAASAVADVALAMVDGPAPAVSSEESILLLVGPGGNGGDALYAGAFLAEEGHHVDALLLGNGKVHQSALAYYESLGGQIISDFPPHYLYRLVIDGLFGIGGRGGLTPELASLVESFSASGIPILAIDVPSGVHADSGELPPGVMVTVEGFDNDAPMARQKIPAHIDADVTITFGGLRRAHAVSPACGEVLCADINIAGGGGKSLSAELSQVQAEDATPQMFASKAYQRKDSLFERANLKATAPHIHRIGQHFTVLNMEPGPDHDKYSGGIVGIVAGSGTYPGAAVLSVKAAVRATSAMVRYVGPALNFVIQSLPEVVATQSLATAGRVQAWVHGPGRGLEAEQSAELAELLSRPEPVLIDADSLSLLQLSAELRQALRERKAPTVLTPHKGEFERIAAELRSEGVEIPQADKDPIGAAQALAKEFDCCVLLKGKYTVIAAHDFVHAINAGHSWLATPGSGDVLSGLVGAHLAQSYAELNRLPEFFPDVTLSDSAIYTQIAPAATIHAVAAGLAARTEFGFAPTSASLIADAIPAATAKVDLKRIV

SEQ ID NO: 255 - DNA, 543 bp, Corynebacterium glutamicum
  CDS (101)..(520): RXN00504
aaggtggatttgaagcgaattgtctagctctgcatgaattccgtatgaattcttttctttcaagtggccgagatgtgaagcgcacggttaattgagaggcatgacctacggatttcttgtcaacacagatctcacccaccgcgcgattgactttgatttagaaaacgctgcgaagttcctcggcggtgccgatgatggccgcgtcgctgtcgctttccaagaggatggcaccttgtacgccgctctctacagcgccagcgcaaaagatgagggtgccgcagcaaacccagtagcatcccttggccgcaacgccgctgctaccggtgatggctccttcttctctgatccgaccactgcaatctgtggccctgtgatcttcgtgggggccgaaggcgaagacatcacgttggatgaaattgagcgaattaaggacggcattcgcgccgctcgtaactaccgcgatgattatccagaggaattcaacctgtggcgcaacgctgtatataacctgcgtacggcttaaagtttggctgccatgtgaat

SEQ ID NO: 256 - protein, 140 aa, Corynebacterium glutamicum
MTYGFLVNTDLTHRAIDFDLENAAKFLGGADDGRVAVAFQEDGTLYAALYSASAKDEGAAANPVASLGRNAAATGDGSFFSDPTTAICGPVIFVGAEGEDITLDEIERIKDGIRAARNYRDDYPEEFNLWRNAVYNLRTA

SEQ ID NO: 257 - DNA, 346 bp, Corynebacterium glutamicum
  CDS (101)..(346): FRXA00504
aaggtggatttgaagcgaattgtctagctctgcatgaattccgtatgaattcttttctttcaagtggccgagatgtgaagcgcacggttaattgagaggcatgacctacggatttcttgtcaacacagatctcacccaccgcgcgattgactttgatttagaaaacgctgcgaagttcctcggcggtgccgatgatggccgcgtcgctgtcgctttccaagaggatggcaccttgtacgccgctctctacagcgccagcgcaaaagatgagggtgccgcagcaaacccagtagcatcccttggccgcaacgccgctgctaccggtgatggctccttcttctctgat

SEQ ID NO: 258 - protein, 82 aa, Corynebacterium glutamicum
MTYGFLVNTDLTHRAIDFDLENAAKFLGGADDGRVAVAFQEDGTLYAALYSASAKDEGAAANPVASLGRNAAATGDGSFFSD

SEQ ID NO: 259 - DNA, 618 bp, Corynebacterium glutamicum
  CDS (101)..(595): RXN00505
ttgcggagcgtttagacaccattaactatgaggtagtgtgccgaccaaccggccgaactgtccgcgcatatgtttaagtgaatacgtttaaggagcagcaatgaaatctgagtttccggtatccggcacgaggcgttttgagcatgccgcagatacccaaaattttggggaagaattaggcaggcatctagaagctggcgatgtggtgattttggacggcccgctgggtgctggaaaaaccacatttactcaaggtatcgctcgtggattgcaggtgaaggggcgggtgacatcgccgacgtttgtgatcgcgagggaacaccgctcggaaatcggtgggccagatctgatccacatggatgcctaccgattgctgggcgaagacagcgaggatgctgatccgatcggtgcgctggactctttggatttggataccgatttggacttggctgtggttgttgcggaatggggcggtggcttggtggagcagatcgctgactcgtatcttttgattaccattgatcgagagaccgctgtgcaggaagacccggaatctgaggctcgaattttccattgggaatggcgcgaaggccgctgagaaagttttccacgctaaaa

SEQ ID NO: 260 - protein, 165 aa, Corynebacterium glutamicum
MKSEFPVSGTRRFEHAADTQNFGEELGRHLEAGDVVILDGPLGAGKTTFTQGIARGLQVKGRVTSPTFVIAREHRSEIGGPDLIHMDAYRLLGEDSEDADPIGALDSLDLDTDLDLAVVVAEWGGGLVEQIADSYLLITIDRETAVQEDPESEARIFHWEWREGR

SEQ ID NO: 261 - DNA, 275 bp, Corynebacterium glutamicum
  CDS (1)..(252): FRXA00505
gatctgatccacatggatgcctaccgattgctgggcgaagacagcgaggatgctgatccgatcggtgcgctggactctttggatttggataccgatttggacttggctgtggttgttgcggaatggggcggtggcttggtggagcagatcgctgactcgtatcttttgattaccattgatcgagagaccgctgtgcaggaagacccggaatctgaggctcgaattttccattgggaatggcgcgaaggccgctgagaaagttttccacgctaaaa

SEQ ID NO: 262 - protein, 84 aa, Corynebacterium glutamicum
DLIHMDAYRLLGEDSEDADPIGALDSLDLDTDLDLAVVVAEWGGGLVEQIADSYLLITIDRETAVQEDPESEARIFHWEWREGR

SEQ ID NO: 263 - DNA, 978 bp, Corynebacterium glutamicum
  CDS (101)..(955): RXN00507
gttcatgttgaactattgtgccaccaaccgcggacagaaatacgattggtgccggggttagtgccagtattgccccacgctttcaactatccttaaacacgtggctgagaatctgaacaaacacctgtccaaactgtccaagcgcggaccgcaccgcgtgctggtaggcgatatgaactacgccggcatcccgggcaaaatctacaccccagcagaaggcgacggcatcccaggtgtagctttcggccacgactggatgaaatccatcaagtactaccaccaaactttgcgacacctcgcgtcctggggcatcgctgttgccgccccagacaccgaaaatggcttcatgccagaccacaaaggtttcgcctctgacctcgaatcctccattcagattctcggcggcgtaaaactcggctccggaaacgtcaccgtcaacccagcctgcctcggtgtagtaggccacggcatgggtgctggggctgcagtactatccgcagcaaaccgcgacctcgtgcgcgcagtcggagcaatctacccagcgaaaacctccccctcagcaatcgacgccgccttcgctgtcaaagccccaggcctagtcatcggatcctccagcctcggcctctttgaatccggcgagccagcaaaactcgcagccaactgggccggcgatgtctgctaccgcgaatcagaaaaaggcaaccaacagggcttctctgaagacaccatgttcaaacttgtcgcaggaatcggcagcccacaaaccggagctcaagaaaccgtccgcggcctcctcaccggattccttctccaccaacttgccggagaaaagaaatacaaagcattctccgaaccagacgctgaagctaagaaagttgtctcctacttcggccaggagctgcaggaacatgccttccctaaggacacgtccccattcgcgttccttaacgagaagtagttcgcttttcttagtgggtg

SEQ ID NO: 264 - protein, 285 aa, Corynebacterium glutamicum
VAENLNKHLSKLSKRGPHRVLVGDMNYAGIPGKIYTPAEGDGIPGVAFGHDWMKSIKYYHQTLRHLASWGIAVAAPDTENGFMPDHKGFASDLESSIQILGGVKLGSGNVTVNPACLGVVGHGMGAGAAVLSAANRDLVRAVGAIYPAKTSPSAIDAAFAVKAPGLVIGSSSLGLFESGEPAKLAANWAGDVCYRESEKGNQQGFSEDTMFKLVAGIGSPQTGAQETVRGLLTGFLLHQLAGEKKYKAFSEPDAEAKKVVSYFGQELQEHAFPKDTSPFAFLNEK

SEQ ID NO: 265 - DNA, 978 bp, Corynebacterium glutamicum; identical to SEQ ID NO: 263
  CDS (101)..(955): FRXA00507

SEQ ID NO: 266 - protein, 285 aa, Corynebacterium glutamicum; identical to SEQ ID NO: 264

SEQ ID NO: 267 - DNA, 1632 bp, Corynebacterium glutamicum
  CDS (101)..(1609): RXN00510
acgcttttacccaaacaacccaagccgccgaggaagaagttaaacgattcgacaataccgacaaagtttttggtgccggatttgatgggattgatccgaagtgaatgatcctttagccggctacggagcagtgatctccgcactacaaggcgccagtggtgggatgtatcgcggaccggcgaaatccgaaggccagttgcgcgagatgtaccaaaccatcgaagggctagacaccagctcgttgcgcgaagctgccgaagcagcagtgggcggaacgaacgaagccagaatacaagggtgggtcggcccgctcttgaaattcttcgggacggttggcgggggaatgatcgccacggagatagctgaacgggcagtcgattggttcaaaaaccgtaatgatgtggaagaagtcagcgaagccgctgataaagccgccgatgcgatcgactccactgtcacagagtccgaccagggcatgatgcacattatccagcagctcttggacattgtgtctacgttgacgcagattcttggcagcatggatcgggggaaatttcctcaagaattccgggactgtgtccaaactggagctgatcttattgaccaggcaggggacatgcttgaaggattgtgcgctgatcgagatgatgcgatttcacagtgtttctccgcgttgaccgatcatggaaaacaagtttgtgaaactgagccaaagccgttgtgtagtgcagcttctgggggttcatctggtggagcgacttcttcggctgcggcctcttcaggtggttcaagctcgagcactgctagctctgggagttctggcggatcgagcagtgctgcggatagttcgacgtcgaccaatgctgaatccagtgttgaaaaggaaaagaccacacctgctgccgttgagaaacctgacgagaaaccagtggagaagccggttgaaaagacgccagaaaagccggtagaaaaacctgtcgagaagcaagagtgtgaagaaaagcctgaccctgacccggaaaaatgcaaaacagagccggtcgagtgtgagccaacaccgaaacctgaaacagagcctgaaccaaaaccgacacccacgcccacacccggaacaccaacaccaatacctgagctagagactgaggattgtgaacctggcaaggagacgggcacagactcagaatctgaatcggaagagtgcgcccccgagctcaatgacgttccagaagagtcggatctgattgggcaactcatcaagggagcaatcggtattgggattgttgttgtaggcgttgggctgttggtgaatttcctggagcagtgcgtccctgtgattgaagaagtacctgtgccggagcccgagcctatacctgaacccgctccgcagcctgagccaacttcagtgaaaccaccagagtctgaactagataaggtggctgagcctgcgccgaagccaattccacaagctaattacactgctgctgcagcaactaactattccgctcccgcgcacgctcccgttgtcccaattacgccggcagcacctgaagttccggcagcaccagaagtgcctgcaccggcggttaatcttcacaaggccggcgggtggtagcggtggagtatgcggaattt

SEQ ID NO: 268 - protein, 503 aa, Corynebacterium glutamicum
VNDPLAGYGAVISALQGASGGMYRGPAKSEGQLREMYQTIEGLDTSSLREAAEAAVGGTNEARIQGWVGPLLKFFGTVGGGMIATEIAERAVDWFKNRNDVEEVSEAADKAADAIDSTVTESDQGMMHIIQQLLDIVSTLTQILGSMDRGKFPQEFRDCVQTGADLIDQAGDMLEGLCADRDDAISQCFSALTDHGKQVCETEPKPLCSAASGGSSGGATSSAAASSGGSSSSTASSGSSGGSSSAADSSTSTNAESSVEKEKTTPAAVEKPDEKPVEKPVEKTPEKPVEKPVEKQECEEKPDPDPEKCKTEPVECEPTPKPETEPEPKPTPTPTPGTPTPIPELETEDCEPGKETGTDSESESEECAPELNDVPEESDLIGQLIKGAIGIGIVVVGVGLLVNFLEQCVPVIEEVPVPEPEPIPEPAPQPEPTSVKPPESELDKVAEPAPKPIPQANYTAAAATNYSAPAHAPVVPITPAAPEVPAAPEVPAPAVNLHKAGGW

SEQ ID NO: 269 - DNA, 300 bp, Corynebacterium glutamicum
  CDS (101)..(277): FRXA00509
cttttctggcgtcttttcaaccggcttctccactggtttctcgtcaggtttctcaacggcagcaggtgtggtcttttccttttcaacactggattcagcattggtcgacgtcgaactatccgcagcactgctcgatccgccagaactcccagagctagcagtgctcgagcttgaaccacctgaagaggccgcagccgaagaagtcgctccaccagatgaacccccagaagctgcactacacaacggctttggctcagtttcacaaacttgttttccatgatcggtcaacgcggagaaaca

SEQ ID NO: 270 - protein, 59 aa, Corynebacterium glutamicum
LVDVELSAALLDPPELPELAVLELEPPEEAAAEEVAPPDEPPEAALHNGFGSVSQTCFP

SEQ ID NO: 271 - DNA, 631 bp, Corynebacterium glutamicum
  CDS (101)..(631): FRXA00510
  misc_feature 195,205,208,265,280,282,309,318,330,333,335,338,342,352,355,369,370,372,375,378-385: n = a,t,c, or g
  VARIANT 32,91: Xaa = Ile, Thr, Lys, or Arg
  VARIANT (35): Xaa = Lys or Asn
  VARIANT 36,60: Xaa = His or Gln
  VARIANT (61): Xaa = Leu, Phe, Gly, or Arg
  VARIANT 70,73,78,81: Xaa = Val, Ala, Glu, or Gly
  VARIANT (77): Xaa = Val, Ala, Asp, or Gly
  VARIANT (79): Xaa = Asp, His, Asn, or Tyr
  VARIANT (80): Xaa = Ala, Phe, Ser, or Thr
  VARIANT (84): Xaa = Asp or Glu
  VARIANT (90): Xaa = Ala, Asp, Glu, Gly, or Val
  VARIANT (92): Xaa = Phe, Ser, Tyr, or Cys
  VARIANT (93): Xaa = Cys, Phe, Leu, Trp, or Tyr
  VARIANT (94)..(95): Xaa = any amino acid
gagcagtgctgcggatagttcgacgtcgaccaatgctgaatccagtgttgaaaaggaaaagaccacacctgctgccgttgagaaacctgacgagaaaccagtggagaagccggttgaaaagacgccagaaaagccggtagaaaaacctgtcgagaagcaagagtgtgaagaaaagcctgaccctgacccggaaanaatgcaaaancangagccggtcgagtgtgagccaacaccgaaacctgaaacagagcctgaaccaaaaccngacacccacgcccancnacccggaacaccaacaccaatacctgnagctagagnactgaggattgntgnanacnctgngcaaggagancgnggcacagactcagnnanatnctnnnnnnnngaatcggaagagtgcgcccccgagctcaatgacgttccagaagagtcggatctgattgggcaactcatcaagggagcaatcggtattgggattgttgttgtaggcgttgggctgttggtgaatttcctggagcagtgcgtccctgtgattgaagaagtacctgtgccggagcccgagcctatacctgaacccgctccgcagcctgagccaacttcagtgaaaccaccagagtctgaactagataag

SEQ ID NO: 272 - protein, 177 aa, Corynebacterium glutamicum
  VARIANT 32,91: Xaa = Ile, Thr, Lys, or Arg
  VARIANT (35): Xaa = Lys or Asn
  VARIANT 36,60: Xaa = His or Gln
  VARIANT (61): Xaa = Leu, Phe, Gly, or Arg
  VARIANT 70,73,78,81: Xaa = Val, Ala, Glu, or Gly
  VARIANT (77): Xaa = Val, Ala, Asp, or Gly
  VARIANT (79): Xaa = Asp, His, Asn, or Tyr
  VARIANT (80): Xaa = Ala, Phe, Ser, or Thr
  VARIANT (84): Xaa = Asp or Glu
  VARIANT (90): Xaa = Ala, Asp, Glu, Gly, or Val
  VARIANT (92): Xaa = Phe, Ser, Tyr, or Cys
  VARIANT (93): Xaa = Cys, Phe, Leu, Trp, or Tyr
  VARIANT (94)..(95): Xaa = any amino acid
VEKPVEKTPEKPVEKPVEKQECEEKPDPDPEXMQXXEPVECEPTPKPETEPEPKPDTHAXXPGTPTPIPXARXLRIXXXXXQGXRGTDSXXXXXXESEECAPELNDVPEESDLIGQLIKGAIGIGIVVVGVGLLVNFLEQCVPVIEEVPVPEPEPIPEPAPQPEPTSVKPPESELDK

SEQ ID NO: 273 - DNA, 825 bp, Corynebacterium glutamicum
  CDS (101)..(802): RXN00515
gttgacgcactgaagaagtaaagtctcttcacaaaaagcgctgtgcttcctcacatggaagcacagcgctttttcatatttttattgccataatgggcacatgcgtttttctcgagttcttcccgcacttcttatcaccaccgccgtgagcatcccaacagcatctgctgccacactcaccgccgacaccgacaaggaattgtgcatcgccagcaacaccgacgattccgcggtggttaccttctggaactccattgaagactccgtgcgcgaacaacgcctcgacgaactagacgcccaagatccaggaatcaaagcggcgattgaaagctacatcgcccaagatgacaacgccccaactgctgctgaactgcaagtacgcctcgatgccatcgaatccggcgaaggcctagccatgctcctcccagacgatcccacgctggcagaccccaacgccgaggaaagtttcaaaacggagtacacatacgacgaagccaaagacatcatcagcggattctccagcgatccagccagcgatgtactcagccaacttcaacaagccgccaccaccggcacccgcaccgcagaaatccgcgccgaagtattcgccgaccgcaccgatgattacaacgaatcccaaaccgctcttaaagaggatttccaaaactgcatcgatgccatcgatgacgcccgcccaatcccactgcagtacatcctgattggaggcgccatcgctttggcggtcatcgtcctcgggatcagggcgtggactaactcaaggaagcagtccaagcacagccagtaatacgccaagcaaaaaattgc

SEQ ID NO: 274 - protein, 234 aa, Corynebacterium glutamicum
MRFSRVLPALLITTAVSIPTASAATLTADTDKELCIASNTDDSAVVTFWNSIEDSVREQRLDELDAQDPGIKAAIESYIAQDDNAPTAAELQVRLDAIESGEGLAMLLPDDPTLADPNAEESFKTEYTYDEAKDIISGFSSDPASDVLSQLQQAATTGTRTAEIRAEVFADRTDDYNESQTALKEDFQNCIDAIDDARPIPLQYILIGGAIALAVIVLGIRAWTNSRKQSKHSQ

SEQ ID NO: 275 - DNA, 503 bp, Corynebacterium glutamicum
  CDS (1)..(480): FRXA00515
attgaaagctacatcgcccaagatgacaacgccccaactgctgctgaactgcaagtacgcctcgatgccatcgaatccggcgaaggcctagccatgctcctcccagacgatcccacgctggcagaccccaacgccgaggaaagtttcaaaacggagtacacatacgacgaagccaaagacatcatcagcggattctccagcgatccagccagcgatgtactcagccaacttcaacaagccgccaccaccggcacccgcaccgcagaaatccgcgccgaagtattcgccgaccgcaccgatgattacaacgaatcccaaaccgctcttaaagaggatttccaaaactgcatcgatgccatcgatgacgcccgcccaatcccactgcagtacatcctgattggaggcgccatcgctttggcggtcatcgtcctcgggatcagggcgtggactaactcaaggaagcagtccaagcacagccagtaatacgccaagcaaaaaattgc

SEQ ID NO: 276 - protein, 160 aa, Corynebacterium glutamicum
IESYIAQDDNAPTAAELQVRLDAIESGEGLAMLLPDDPTLADPNAEESFKTEYTYDEAKDIISGFSSDPASDVLSQLQQAATTGTRTAEIRAEVFADRTDDYNESQTALKEDFQNCIDAIDDARPIPLQYILIGGAIALAVIVLGIRAWTNSRKQSKHSQ

SEQ ID NO: 277 - DNA, 298 bp, Corynebacterium glutamicum
  CDS (101)..(298): FRXA00520
gttgacgcactgaagaagtaaagtctcttcacaaaaagcgctgtgcttcctcacatggaagcacagcgctttttcatatttttattgccataatgggcacatgcgtttttctcgagttcttcccgcacttcttatcaccaccgccgtgagcatcccaacagcatctgctgccacactcaccggcgacaccgacaaggaattgtgcatcgccagcaacaccgacgattccgcggtggttaccttctggaactccattgaagactccgtgcgcgaacaacgcctcgacgaactagacgcc

SEQ ID NO: 278 - protein, 66 aa, Corynebacterium glutamicum
MRFSRVLPALLITTAVSIPTASAATLTGDTDKELCIASNTDDSAVVTFWNSIEDSVREQRLDELDA

SEQ ID NO: 279 - DNA, 1887 bp, Corynebacterium glutamicum
  CDS (101)..(1864): RXN00527
ttccttggccccgaagaaattaatcattgtggccgtggtcctgattttgatcattgcggctgcctcgttttattttctgcgttcatcatcgaatgaccaggtgattgccacttctgatgttcgggagatttcctccgagggaatcgtggcgcgtgtgtctgtcaacggaaatattgaagctgcgcgaaccaccaccatttacaccagtctgactgtgccggtcgcgaacttgccggttgcggttggtgaccgtgtggcagctgatcaggtgttggctgagttggatgcctctgccctgcaacgacagttggatgaaactgatgccaacaatgcgcgtgcagccatggcgaaccgcaattccatcgcgcagtcgcagcaagcatatgagcagtccagggaacttcttgatagtggtttgagcccggagatcaactcggcgcggtcctcgttgcgggcgtcctcacaggcatatcaggatgcgatccgcagttttgaagcgaagcagcgagatgtggatggcggattggattccaccatggtcgctcaatcggatgctctcaaggcagctcgtgagcaagcagatgctgctgaaattgaacgactgcgcgcggacttcggactgctcaacaacgatcgcagcaacctcaacgatgtcattggtctgctcgatgagagagaatctttggcttctgcggaatccgaactagctcaagcccgcgctgcaggtgacctagaggcagtcgctgcagctgaagcaaaggttgcaggcctggaacaatcaattgcttccaaaacctccacgtggcctagccaagatcagacttacttgcagtcctacaccgctttggaggaagctgagcgacgcgtcgcatccaccactgaagctctagaaatagccgagcggatctacattgattcactcggaaaagttgactcagaactagccgccgcacagcgcgccgttgccgaagcccactcagcacaacaagacgcagcacttggcctcgagaccgcgcagctttccacccaacaccaattggaagcccaatcaagcgccatcgatgcagctttaggtttggcatcagtagataatgaagccgccaccagatccacgtcccagctgcggatggatatcaacaacaccaccgttcgctccccatactcaggcattgtttcatccgtgcaggcagcccaaggtcaaccagcagccggcgcactgttgagtgttgctgatgattccgaactgaagatcaccgcgaatgtaaaagaagcggagatcagcaacgtcaccatcggatcccgcgtcaccttcactaccccatcgaccggaaccaaagaattcgccggccgagtatccaaagtctcccccattgcagctgccgccagtgccccagctacaggtgaaggagctgccgcaggcgccacaaccaccaacactgacgtcaccttccccatcgaaatttccgtcaccggcgaccgcgaaggcctcaacctcggcggatccgctcgagtacgcatcgtccatgaaatcgcaccacacgtactgaccgttcctttggaagctgtgtacaaaaatgatgacggcaaagacgctgttttgatcatcagcgacgacaacaaagtagaagaagtagaagtaaaaacagctgaatccgatgactttgatatcgcagtcagcggtgctggaatttcagaagacgctcgagtgctcacccagcctggaaactaccggggcctcatcggagaaactgtgaaacttcacgcagatacggtggagcaggcggcggctccttttagtcctgcggccccttttgaccctgcagcccctgccgtttctgccaagcaaaccgtgggccaggtgatttagcctatgagcctcatcgaaat

SEQ ID NO: 280 - protein, 588 aa, Corynebacterium glutamicum
VIATSDVREISSEGIVARVSVNGNIEAARTTTIYTSLTVPVANLPVAVGDRVAADQVLAELDASALQRQLDETDANNARAAMANRNSIAQSQQAYEQSRELLDSGLSPEINSARSSLRASSQAYQDAIRSFEAKQRDVDGGLDSTMVAQSDALKAAREQADAAEIERLRADFGLLNNDRSNLNDVIGLLDERESLASAESELAQARAAGDLEAVAAAEAKVAGLEQSIASKTSTWPSQDQTYLQSYTALEEAERRVASTTEALEIAERIYIDSLGKVDSELAAAQRAVAEAHSAQQDAALGLETAQLSTQHQLEAQSSAIDAALGLASVDNEAATRSTSQLRMDINNTTVRSPYSGIVSSVQAAQGQPAAGALLSVADDSELKITANVKEAEISNVTIGSRVTFTTPSTGTKEFAGRVSKVSPIAAAASAPATGEGAAAGATTTNTDVTFPIEISVTGDREGLNLGGSARVRIVHEIAPHVLTVPLEAVYKNDDGKDAVLIISDDNKVEEVEVKTAESDDFDIAVSGAGISEDARVLTQPGNYRGLIGETVKLHADTVEQAAAPFSPAAPFDPAAPAVSAKQTVGQVI

SEQ ID NO: 281 - DNA, 1887 bp, Corynebacterium glutamicum; identical to SEQ ID NO: 279
  CDS (101)..(1864): FRXA00527

SEQ ID NO: 282 - protein, 588 aa, Corynebacterium glutamicum; identical to SEQ ID NO: 280

SEQ ID NO: 283 - DNA, 1521 bp, Corynebacterium glutamicum
  CDS (101)..(1498): RXN00547
ggtcgtagcctaaacgaccttaaaaaggagccgaccgccgatggaccagaaattggaccagcagaaggtagaccgcgtatcgcccggtgatagtgaaccggtggcacgggattttatcaatgcaatcggcggtcggtttggtcgttttgcgcaggtgggcactcagcggttctggactcccctgcgtgttttgatcaccacttccctggtgtttttggccatggggtttttaacaaaagccaattgcatccagggttctagaggtactgatggtgtggtttctttgaactggtcgggaagtcgccagtacacctcagcctgttacaacgacatcgttccgctctatggggggcgcggaattgatgcgccaggtttcccttatgccttttcgtggcaggaaggtgatctcaccaggtacatggagtacccggtgttgggcggaattttccagtggatttgtggcattatcacgcggtttttgtacccggttgttgatgtcattccgtttcatacgctgcctgaatctggtctttatttcatcgtcaccgcgcttgcgttggcgttcttttgggtgttggtcatccgcatgatggtggagctcactggcaatcgagtgtgggataccgtccttgttgcggcgtctcccctggttgctgtgcatgcgtttaccaactgggatactccagccattgcggcggtgattggtgcgatgcttgcggtgaaacgcggaaaccccttggttgcgggtgtgctgatcggcgcgggtacggcgttcaaattgtggccgctttatcttcttggtgcgtatttggtgctggcggtcaagaataagaatctcaagccgtttatcaccatggctgcagcggctgcggtgacatggctcgtggtgaatgtgccagtgatgatcgcgtaccccaaggcgtggaatgaattcttgcgcctgaaccgggagcgtggtgcggagtggaccacgatttaccaggtcatcgaccgtaatttgccgatcaatttgaatgatccagtgctgcttaatgtgctgagcttcggcttgtttggtgcatcgtgtgtggccattttgatccttgggctcaaggtgcagcgcactccccgagtcgctgagctggcctttttgattgtcgcggcgtttttgctgtttaacaaggtgtggagtcctcagtattcactgtggctggtcccgttggctgttctggcatttcctcagtggaaagtgctgttcccgtggatggttacagacgccatggtgtggccaattttgatgtggcacatgctcggcacggacaacaagggactcccccatgaaatgttggatctcatcgtgatttcccgagatgccttcattgtggtcatgatagtaggtgtaatccggcagatgctcggacgacgtgcagatccggtgatggatgcgcacgccgggcgcgatttgttggccgggcccttcggcgcaggcgagcgtcgaaaagcattgaaggaagtaagttgagcacaacagttttgctggtc

SEQ ID NO: 284 - protein, 466 aa, Corynebacterium glutamicum
VARDFINAIGGRFGRFAQVGTQRFWTPLRVLITTSLVFLAMGFLTKANCIQGSRGTDGVVSLNWSGSRQYTSACYNDIVPLYGGRGIDAPGFPYAFSWQEGDLTRYMEYPVLGGIFQWICGIITRFLYPVVDVIPFHTLPESGLYFIVTALALAFFWVLVIRMMVELTGNRVWDTVLVAASPLVAVHAFTNWDTPAIAAVIGAMLAVKRGNPLVAGVLIGAGTAFKLWPLYLLGAYLVLAVKNKNLKPFITMAAAAAVTWLVVNVPVMIAYPKAWNEFLRLNRERGAEWTTIYQVIDRNLPINLNDPVLLNVLSFGLFGASCVAILILGLKVQRTPRVAELAFLIVAAFLLFNKVWSPQYSLWLVPLAVLAFPQWKVLFPWMVTDAMVWPILMWHMLGTDNKGLPHEMLDLIVISRDAFIVVMIVGVIRQMLGRRADPVMDAHAGRDLLAGPFGAGERRKALKEVS

SEQ ID NO: 285 - DNA, 514 bp, Corynebacterium glutamicum
  CDS (101)..(514): FRXA00547
accacgatttaccaggtcatcgaccgtaatttgccgatcaatttgaatgatccagtgctgcttaatgtgctgagcttcggcttgtttggtgcatcagtgtgtggccattttgatccttgggctcaaggtgcagcgcactccccgagtcgctgagctggcctttttgattgtcgcggcgtttttgctgtttaacaaggtgtggagtcctcagtattcactgtggctggtcccgttggctgttctggcatttcctcagtggaaagtgctgttcccgtggatggttacagacgccatggtgtggccaattttgatgtggcacatgctcggcacggacaacaagggactcccccatgaaatgttggatctcatcgtgatttcccgagatgccttcattgtggtcatgataagtaggtgtaatccggcagatgctcggacgacgtgcaaatccggtgatggatgcgcacgccgggcgcgaattgttggccgggcccttcggcgcaagcgaagcgtcgaa

SEQ ID NO: 286 - protein, 138 aa, Corynebacterium glutamicum
VAILILGLKVQRTPRVAELAFLIVAAFLLFNKVWSPQYSLWLVPLAVLAFPQWKVLFPWMVTDAMVWPILMWHMLGTDNKGLPHEMLDLIVISRDAFIVVMISRCNPADARTTCKSGDGCARRARIVGRALRRKRSVE

SEQ ID NO: 287 - DNA, 713 bp, Corynebacterium glutamicum
  CDS (1)..(690): FRXA00546
ccggtgttgggcggaattttccagtggatttgtggcattatcacgcggtttttgtacccggttgttgatgtcattccgtttcatacgctgcctgaatctggtctttatttcatcgtcaccgcgcttgcgttggcgttcttttgggtgttggtcatccgcatgatggtggagctcactggcaatcgagtgtgggataccgtccttgttgcggcgtctcccctggttgctgtgcatgcgtttaccaactgggatactccagccattgcggcggtgattggtgcgatgcttgcggtgaaacgcggaaaccccttggttgcgggtgtgctgatcggcgcgggtacggcgttcaaattgtggccgctttatcttcttggtgcgtatttggtgctggcggtcaagaataagaatctcaagccgtttatcaccatggctgcagcggctgcggtgacatggctcgtggtgaatgtgccagtgatgatcgcgtaccccaaggcgtggaatgaattcttgcgcctgaaccgggagcgtggtgcggagtggaccacgatttaccaggtcatcgaccgtaatttgccgatcaatttgaatgatccagtgctgcttaatgtgctgagcttcggcttgtttggtgcatcagtgtgtggccattttgatccttgggctcaaggtgcagcgcactccccgagtcgctgagctggcctttttgattgtcg

SEQ ID NO: 288 - protein, 230 aa, Corynebacterium glutamicum
PVLGGIFQWICGIITRFLYPVVDVIPFHTLPESGLYFIVTALALAFFWVLVIRMMVELTGNRVWDTVLVAASPLVAVHAFTNWDTPAIAAVIGAMLAVKRGNPLVAGVLIGAGTAFKLWPLYLLGAYLVLAVKNKNLKPFITMAAAAAVTWLVVNVPVMIAYPKAWNEFLRLNRERGAEWTTIYQVIDRNLPINLNDPVLLNVLSFGLFGASVCGHFDPWAQGAAHSPSR

SEQ ID NO: 289 - DNA, 1059 bp, Corynebacterium glutamicum
  CDS (101)..(1036): RXN00552
ccgccaacaaggcagcaaagctcgatccaattgacgccttgcgttatgagtaaaagcctcgtttttaaggtagccacacatcgcactagactgaagaactgtggctacctcaaaaattcttctttattacgcattcaccccgctctctgaccctaaagcggttcagctgtggcagcgtgagctctgcgagtcactgaatcttcgtggccgcatcctgatctccactcacggcatcaatggaaccgtgggcggagatattgatgattgcaaggcgtacattaaaaagacccgcgagtacccaggtttcaaccgcatgcagtttaagtggtccgagggtggcgctgaggatttcccaaagctcagtgtcaaagtccgcgatgagatcgttgccttcggcgctccagatgagctcaaagtggatgaaaacggcgtcgtcggtggcggcgttcacctgaaaccacagcaggtcaatgagcttgtggaagcccgtggcgatgaagttgtgttctttgacggccgcaacgcaatggaagcccagatcggcaagttcaaggacgctgttgtccctgacgtagaaaccactcatgatttcatcgcagaaattgagtctggaaaatacgacgatctcaaagacaagcctgtggtcacctactgcaccggcggaattcgttgtgagatcctgagttcactcatgatcaaccgtggtttcaaagaggtctaccaaatcgatggcggcatcgttcgctacggcgagcagtttggcaacaagggcctgtgggaaggctccctctacgttttcgataagcgcatgcatatggaattcggcgaggattacaaagaggtcggacactgcatccattgcgatactcccaccaacaaatttgagcactgcctcaacgaagatgattgccgcgagctcgtgttgatgtgccctgattgcttcgccaatgttgagacccgtcattgcaagcgcgaacgctgtgcagcaattgctgcggatttcgctgagcaaggaattgatccgctcgttacttcttaaaaagggtatggtggctgggt

SEQ ID NO: 290 - protein, 312 aa, Corynebacterium glutamicum
VATSKILLYYAFTPLSDPKAVQLWQRELCESLNLRGRILISTHGINGTVGGDIDDCKAYIKKTREYPGFNRMQFKWSEGGAEDFPKLSVKVRDEIVAFGAPDELKVDENGVVGGGVHLKPQQVNELVEARGDEVVFFDGRNAMEAQIGKFKDAVVPDVETTHDFIAEIESGKYDDLKDKPVVTYCTGGIRCEILSSLMINRGFKEVYQIDGGIVRYGEQFGNKGLWEGSLYVFDKRMHMEFGEDYKEVGHCIHCDTPTNKFEHCLNEDDCRELVLMCPDCFANVETRHCKRERCAAIAADFAEQGIDPLVTS

SEQ ID NO: 291 - DNA, 740 bp, Corynebacterium glutamicum
  CDS (1)..(717): FRXA00552
tttaagtggtccgagggtggcgctgaggatttcccaaagctcagtgtcaaagtccgcgatgagatcgttgccttcggcgctccagatgagctcaaagtggatgaaaacggcgtcgtcggtggcggcgttcacctgaaaccacagcaggtcaatgagcttgtggaagcccgtggcgatgaagttgtgttctttgacggccgcaacgcaatggaagcccagatcggcaagttcaaggacgctgttgtccctgacgtagaaaccactcatgatttcatcgcagaaattgagtctggaaaatacgacgatctcaaagacaagcctgtggtcacctactgcaccggcggaattcgttgtgagatcctgagttcactcatgatcaaccgtggtttcaaagaggtctaccaaatcgatggcggcatcgttcgctacggcgagcagtttggcaacaagggcctgtgggaaggctccctctacgttttcgataagcgcatgcatatggaattcggcgaggattacaaagaggtcggacactgcatccattgcgatactcccaccaacaaatttgagcactgcctcaacgaagatgattgccgcgagctcgtgttgatgtgccctgattgcttcgccaatgttgagacccgtcattgcaagcgcgaacgctgtgcagcaattgctgcggatttcgctgagcaaggaattgatccgctcgttacttcttaaaaagggtatggtggctgggt

SEQ ID NO: 292 - protein, 239 aa, Corynebacterium glutamicum
FKWSEGGAEDFPKLSVKVRDEIVAFGAPDELKVDENGVVGGGVHLKPQQVNELVEARGDEVVFFDGRNAMEAQIGKFKDAVVPDVETTHDFIAEIESGKYDDLKDKPVVTYCTGGIRCEILSSLMINRGFKEVYQIDGGIVRYGEQFGNKGLWEGSLYVFDKRMHMEFGEDYKEVGHCIHCDTPTNKFEHCLNEDDCRELVLMCPDCFANVETRHCKRERCAAIAADFAEQGIDPLVTS

SEQ ID NO: 293 - DNA, 1062 bp, Corynebacterium glutamicum
  CDS (101)..(1039): RXN00555
cctggtggatatcattactgagcttgcagaggtgtacggtagctggaaagagaccgacagcggttcttaacagttttctccatctcaactccggaatttgatgaaacaaccccttcgcgtacttatttcttgtcgacccgaagaaaattcgggtggcaaacgtagtgaacaaaatgatgctgtttttgagttcgccgcatggctagctcgtacttcagacatcaatgttcgtggaatcacaactttcatacgcccttggccgtcttcctccatcagtaagctcggaggaaaatatcataagtggtataagaatttagattcttactaccgcagtcgcacgatcaagggactcaaagaggccggagttgagaagtcccaatgggacgatgatgtttcagtttttgtagatggtccttctgaatccacgctgctcacccatgctgctgaagaattcgaagcggacctcattctgcttggctctgatgcgaccgcaccaaaaggccgctttctggccagctccaccgcagatgccctccttcactcctcgcccgtcccactaggacttgtgccgcgaggggtgaagctttccaaaaagggtgtcacccgcgtcaactacgctttcaccaatgaaagcgatgactttgagcaaggtttacgctcttccgcggagctcgccaccaattggaacgttcctcttcggatccttgctttttcacccacaggcattacttccgcaccaacgtcgcggagcttggatatttccactgagctttcctccgagtggcgtgaactaacgctcgccatgcttgatcgagcccgtgatggcgtcctcacagaccacccaaacttgagcgtgagcagtgaaaccggttctggctggggttggagcggtgcaattgatgctttgcgatggaagaaaggtgacctgctgtgcatgggaagccatcgcacagacaccctttcacgtgtctttgtcggttcggaaacaatggaaattatccgaaactctcctgtaccgaccatcatttatcccggtctttaggctctccaacagcagaggac

SEQ ID NO: 294 - protein, 313 aa, Corynebacterium glutamicum
MKQPLRVLISCRPEENSGGKRSEQNDAVFEFAAWLARTSDINVRGITTFIRPWPSSSISKLGGKYHKWYKNLDSYYRSRTIKGLKEAGVEKSQWDDDVSVFVDGPSESTLLTHAAEEFEADLILLGSDATAPKGRFLASSTADALLHSSPVPLGLVPRGVKLSKKGVTRVNYAFTNESDDFEQGLRSSAELATNWNVPLRILAFSPTGITSAPTSRSLDISTELSSEWRELTLAMLDRARDGVLTDHPNLSVSSETGSGWGWSGAIDALRWKKGDLLCMGSHRTDTLSRVFVGSETMEIIRNSPVPTIIYPGL

SEQ ID NO: 295 - DNA, 914 bp, Corynebacterium glutamicum
  CDS (1)..(891): FRXA00555
tcgggtggcaaacgtagtgaacaaaatgatgctgtttttgagttcgccgcatggctagctcgtacttcagacatcaatgttcgtggaatcacaactttcatacgcccttggccgtcttcctccatcagtaagctcggaggaaaatatcataagtggtataagaatttagattcttactaccgcagtcgcacgatcaagggactcaaagaggccggagttgagaagtcccaatgggacgatgatgtttcagtttttgtagatggtccttctgaatccacgctgctcacccatgctgctgaagaattcgaagcggacctcattctgcttggctctgatgcgaccgcaccaaaaggccgctttctggccagctccaccgcagatgccctccttcactcctcgcccgtcccactaggacttgtgccgcgaggggtgaagctttccaaaaagggtgtcacccgcgtcaactacgctttcaccaatgaaagcgatgactttgagcaaggtttacgctcttccgcggagctcgccaccaattggaacgttcctcttcggatccttgctttttcacccacaggcattacttccgcaccaacgtcgcggagcttggatatttccactgagctttcctccgagtggcgtgaactaacgctcgccatgcttgatcgagcccgtgatggcgtcctcacagaccacccaaacttgagcgtgagcagtgaaaccggttctggctggggttggagcggtgcaattgatgctttgcgatggaagaaaggtgacctgctgtgcatgggaagccatcgcacagacaccctttcacgtgtctttgtcggttcggaaacaatggaaattatccgaaactctcctgtaccgaccatcatttatcccggtctttaggctctccaacagcagaggac

SEQ ID NO: 296 - protein, 297 aa, Corynebacterium glutamicum
SGGKRSEQNDAVFEFAAWLARTSDINVRGITTFIRPWPSSSISKLGGKYHKWYKNLDSYYRSRTIKGLKEAGVEKSQWDDDVSVFVDGPSESTLLTHAAEEFEADLILLGSDATAPKGRFLASSTADALLHSSPVPLGLVPRGVKLSKKGVTRVNYAFTNESDDFEQGLRSSAELATNWNVPLRILAFSPTGITSAPTSRSLDISTELSSEWRELTLAMLDRARDGVLTDHPNLSVSSETGSGWGWSGAIDALRWKKGDLLCMGSHRTDTLSRVFVGSETMEIIRNSPVPTIIYPGL

SEQ ID NO: 297 - DNA, 498 bp, Corynebacterium glutamicum
  CDS (101)..(475): RXN00560
aaggacgacttctggggagcggtgtggattctcacggggattctcatgcggattatcagacatatggacactttaacggttcgtactaggctgatgcttcatgaggattgatccgctggaaacccggcaagccgtattggccgtcaaagactggattgaaggggagggagacgtcaaaaagcctggtcgtgcggcacttgccgccgcaactcgcctgagcgtccgactgctcgcgcaacacgcgccgggaaacagcgtggaggtgcgggtacccccatttgttgcggtgcaatgcatagaggggccaaaacatacacgcggcacaccacccaacgtggtggagaccgacgccaagacctggttacgcttagcacctgggcaaaccacatttgatgcagaatttgaaagcggaaaaattagcgcatcaggtacccgagccaaagagattgcggactggttaccagtggtcaaactttagatttcctaatgctcattagt

SEQ ID NO: 298 - protein, 125 aa, Corynebacterium glutamicum
MRIDPLETRQAVLAVKDWIEGEGDVKKPGRAALAAATRLSVRLLAQHAPGNSVEVRVPPFVAVQCIEGPKHTRGTPPNVVETDAKTWLRLAPGQTTFDAEFESGKISASGTRAKEIADWLPVVKL

SEQ ID NO: 299 - DNA, 337 bp, Corynebacterium glutamicum
  CDS (101)..(337): FRXA00560
aaggacgacttctggggagcggtgtggattctcacggggattctcatgcggattatcagacatatggacactttaacggttcgtactaggctgatgcttcatgaggattgatccgctggaaacccggcaagccgtattggccgtcaaagactggattgaaggggagggagacgtcaaaaagcctggtcgtgcggcacttgccgccgcaactcgcctgagcgtccgactgctcgcgcaacacgcgccgggaaacagcgtggaggtgcgggtacccccatttgttgcggtgcaatgcatagaggggccaaaacatacacgcggcacaccacccaacgtg

SEQ ID NO: 300 - protein, 79 aa, Corynebacterium glutamicum
MRIDPLETRQAVLAVKDWIEGEGDVKKPGRAALAAATRLSVRLLAQHAPGNSVEVRVPPFVAVQCIEGPKHTRGTPPNV

SEQ ID NO: 301 - DNA, 1002 bp, Corynebacterium glutamicum
  CDS (101)..(979): RXN00574
aactgctgggcactactgagattcccatgtgggatgtggaccggtggcaaccatcgcttctcaagcccggtgattcagttcgatttgtgcaggtgaagaaatgagcttcaaagtaatttccactggcccccaagccatcttccaagaccgaggtcgcttcggttttgccagcgctggtgttggaacctcaggatcctttgatcgtttatccgctgctcgcgcgaatcacgctttaggtaatgatcccaatgcaaccgtggtagagattctgctcggtggctttgaggtggaggcgttgcacaccacctcgatcgtgttcacgggaactgaagctgaagtgatggttcgaacggctggtggacaatccaaaaatgccaccaccaacaccatcatcgatgttgcagctggtgaacgtatccgcgtcgagcccgcaacctatggcatgcgtgcctactttgctgctcgcggtggatttgcagtaaaaaaaactttgggatctgcttcaaccgatctgatctcccacatgggcccttgcccgatcgagcccggggatgtcattgacgtagcaacagacattgcagattctcagtggtggccaaaacttcggcaactgcccaccttatggaaacgcatgccaacagaaacgcttaccgtcatccgaggtccacgtgacaaatggttcacgcaagaatccctcaacaacttttttactcaggtgtttacggtgagcaatgactccaaccggattggtttgcgcatgcactcaagcgagccgatccaacatcgtgtggaaggcgagctgaaaagtgaaggaatggtccgggggtccatccagattccgcctggtggaaaccccgtggtgtttggtcccgatcatcctgtgaccggtggctatccagtaatagcagtacttacatcaaggtcgtgtgatcgttcggcccagctgttgccgggcgataaagtcagatttaaattgctttaggaactttgagcttgctctgg

SEQ ID NO: 302 - protein, 293 aa, Corynebacterium glutamicum
MSFKVISTGPQAIFQDRGRFGFASAGVGTSGSFDRLSAARANHALGNDPNATVVEILLGGFEVEALHTTSIVFTGTEAEVMVRTAGGQSKNATTNTIIDVAAGERIRVEPATYGMRAYFAARGGFAVKKTLGSASTDLISHMGPCPIEPGDVIDVATDIADSQWWPKLRQLPTLWKRMPTETLTVIRGPRDKWFTQESLNNFFTQVFTVSNDSNRIGLRMHSSEPIQHRVEGELKSEGMVRGSIQIPPGGNPVVFGPDHPVTGGYPVIAVLTSRSCDRSAQLLPGDKVRFKLL

SEQ ID NO: 303 - DNA, 1002 bp, Corynebacterium glutamicum; identical to SEQ ID NO: 301
  CDS (101)..(979): FRXA00574

SEQ ID NO: 304 - protein, 293 aa, Corynebacterium glutamicum; identical to SEQ ID NO: 302

SEQ ID NO: 305 - DNA, 573 bp, Corynebacterium glutamicum
  CDS (101)..(550): RXN00589
ccgttatctccgtaactgttgtttctgcagaaccatacaactcagcaaaagccgcgacactccgcggcaaaaactaaccaaggatttaaaagtcttcaaaatgacaactctttcacgtaagttcttcgtttctgctaccacagccctggcggcagtcgcactggttgcgtgttcccctaatgagattgattctgaactgaaggtgccaacggcaactggcgtttctttaccttcgaagaacgtttccgcgacctcaactgctactacagatgaggatgcgcctggctacattgattgcgtagccgcaccaactcagcaacctgctgaaatctcactaaactgtgcaatggatattgatcggctcacggatatttcttggagcgaatgggatactgattccgcaactggaaccggtacccgcatcgtaaccgctgcaaatggtcaagagaccgaaaccgaagatattgaggtgaagctttccttccccaccgagtcttcccaaggcctagtgttcactcaggtcaccgtcgatggacaggttctcttcctctaatcctccataattagagagcg

SEQ ID NO: 306 - protein, 150 aa, Corynebacterium glutamicum
MTTLSRKFFVSATTALAAVALVACSPNEIDSELKVPTATGVSLPSKNVSATSTATTDEDAPGYIDCVAAPTQQPAEISLNCAMDIDRLTDISWSEWDTDSATGTGTRIVTAANGQETETEDIEVKLSFPTESSQGLVFTQVTVDGQVLFL

SEQ ID NO: 307 - DNA, 463 bp, Corynebacterium glutamicum
  CDS (101)..(463): FRXA00589
ccgttatctccgtaactgttgtttctgcagaaccatacaactcagcaaaagccgcgacactccgcggcaaaaactaaccaaggatttaaaagtcttcaaaatgacaactctttcacgtaagttcttcgtttctgctaccacagccctggcggcagtcgcactggttgcgtgttcccctaatgagattgattctgaactgaaggtgccaacggcaactggcgtttctttaccttcgaagaacgtttccgcgacctcaactgctactacagatgaggatgcgcctggctacattgattgcgtagccgcaccaactcagcaacctgctgaaatctcactaaactgtgcaatggatattgatcggctcacggatatttcttggagcgaatgggatactgattccgcaactggaaccggtacccgcatcgtaaccgctgcaaatggtcaagagaccgaaaccgaagat

SEQ ID NO: 308 - protein, 121 aa, Corynebacterium glutamicum
MTTLSRKFFVSATTALAAVALVACSPNEIDSELKVPTATGVSLPSKNVSATSTATTDEDAPGYIDCVAAPTQQPAEISLNCAMDIDRLTDISWSEWDTDSATGTGTRIVTAANGQETETED

SEQ ID NO: 309 - DNA, 468 bp, Corynebacterium glutamicum
  CDS (101)..(445): RXN00616
aaccgcaacctcgcgcacttggagtgaaaattctcatcttcatttcatcttggtgcctaacaatggaatacagattgagttgatcaaaggagaacccccaatgaaatcactcccccgtttcgccccactgattacgattctggctctgctcgtactcgttgccatcggaggatctgcactggcaaataatcgtgctacccctaatgtggaaagtgaacccgccacggtcaaccagcgttccactcccacaacttccgcgtatgagccccctgctacagaatctccggaagaaccaaccacacaaattcaagaatccccagtacaacccccagttcctgcccccgctcaaattcctcaagccccacaagttccactcaattatcagtactatgacgatgactgggacgacgacgatgatgacttcgacgacgactgggacgacgactaactaacccctgaggcactttc

SEQ ID NO: 310 - protein, 115 aa, Corynebacterium glutamicum
MKSLPRFAPLITILALLVLVAIGGSALANNRATPNVESEPATVNQRSTPTTSAYEPPATESPEEPTTQIQESPVQPPVPAPAQIPQAPQVPLNYQYYDDDWDDDDDDFDDDWDDD

SEQ ID NO: 311 - DNA, 468 bp, Corynebacterium glutamicum; identical to SEQ ID NO: 309
  CDS (101)..(445): FRXA00616

SEQ ID NO: 312 - protein, 115 aa, Corynebacterium glutamicum; identical to SEQ ID NO: 310

SEQ ID NO: 313 - DNA, 756 bp, Corynebacterium glutamicum
  CDS (101)..(733): RXN00647
tgcattcttcccacaatgacatgagcttattgcaacatcgtgggtaaagttgaatcgagaagtcgagaaataaccgaccgatgaaagagttgagacgataatgggcatcttcgaagccatccgagccgcacgcgcgaagaccaaagctgagatcaaagcagccgaggcaaaagtaaaaactgaggcgaaaaacaaagcaaagctagatctcaagcgcgagaagcttcttgtccagcaggaaaagaatctgctcaaggttgaagaaaagggcctgaagaagcgcaacaagcatgagctgaagatggccaaaaatatccttgagcaaaagcgccaaggacgcctaaacaaagacaaggtgaagcgctgggctggcaccgcacgtgtgctcactccactactgctgcctattatttatcgactctccaccgaagcacgcgatcaggttgttaagggacgtgcccgtcgtgcaggtgtcaccgcggagcagcttagccaattcgcaggtcacgcagcagcgctgaaggctcgtattcaaggtgttcgcgaaaccgcaaagaactccagcctccctgctggctttgtacgcgatgttgaagagcgtctcaatgagctcgaggctgctgcgaataactctgagttcatgtctccacagcagaggaaccgtgcgcaccagtcgatcagtcgtgatctgaaccaggtgtcagatcagattcaggatcgactactggacaagtagctgctggtcgagtcgctgcc

SEQ ID NO: 314 - protein, 211 aa, Corynebacterium glutamicum
MGIFEAIRAARAKTKAEIKAAEAKVKTEAKNKAKLDLKREKLLVQQEKNLLKVEEKGLKKRNKHELKMAKNILEQKRQGRLNKDKVKRWAGTARVLTPLLLPIIYRLSTEARDQVVKGRARRAGVTAEQLSQFAGHAAALKARIQGVRETAKNSSLPAGFVRDVEERLNELEAAANNSEFMSPQQRNRAHQSISRDLNQVSDQIQDRLLDK

SEQ ID NO: 315 - DNA, 756 bp, Corynebacterium glutamicum; identical to SEQ ID NO: 313
  CDS (101)..(733): FRXA00647

SEQ ID NO: 316 - protein, 211 aa, Corynebacterium glutamicum; identical to SEQ ID NO: 314

SEQ ID NO: 317 - DNA, 888 bp, Corynebacterium glutamicum
  CDS (101)..(865): RXN00653
gttgagattcgcctaacaaagattttggacgaaaacagtaacgatgacagccacgttaagcgcggaatcttctcgcaatggtaaaaagccgcggcctcgagtgagtgtttcccaggttgttggtgaaatcttgctcaccgtaggcattttggccttgttattcgcatactatgaggcctattggaccaacgtggaatctgggaaattacaagaatcggctggtcaaaagcttgatgaagactggaatgaagctcgggtgaatcctcgacaaaagctcaccccggaacttggtgaggcatttgcccggatgtatgttccagctttcggctctgacttcaacttcgcagtgattgaaggaaccgatgaggaagaccttcttgccggtcctggccgttatgtggattcccaaatgcctggtgaagccggaaactttgcagtggcaggccaccgagtgggcaagggtgcgccattcaatgatctaggaaacctggaagtctgcgatgcgatcgtggtggagacttacaattcctgggatgtgtaccgcgtgatgccgatgtccaccaacggtgcagatcgtgcagcagaagctgcggattgcttcaacgaaaaccaggtcagccgcatggctgaaggtgactatgtgaatgtgtccggacgaagcatcaccactccggatcgcatcgatgccacctaccccacaccgggcgtcttcgacactgcagtgcgtgaaggatcagaagctctgcttaccttgaccacgtgtcacccgcagttctccaacgctgagcgcatgattgtgcacgcaatgttggtggaagaaatcgataaatcaagtggcgaacgccctgcagctttggaggaaaactaaatgtattcacttctgtggca

SEQ ID NO: 318 - protein, 255 aa, Corynebacterium glutamicum
VSVSQVVGEILLTVGILALLFAYYEAYWTNVESGKLQESAGQKLDEDWNEARVNPRQKLTPELGEAFARMYVPAFGSDFNFAVIEGTDEEDLLAGPGRYVDSQMPGEAGNFAVAGHRVGKGAPFNDLGNLEVCDAIVVETYNSWDVYRVMPMSTNGADRAAEAADCFNENQVSRMAEGDYVNVSGRSITTPDRIDATYPTPGVFDTAVREGSEALLTLTTCHPQFSNAERMIVHAMLVEEIDKSSGERPAALEEN

SEQ ID NO: 319 - DNA, 888 bp, Corynebacterium glutamicum; identical to SEQ ID NO: 317
  CDS (101)..(865): FRXA00653

SEQ ID NO: 320 - protein, 255 aa, Corynebacterium glutamicum; identical to SEQ ID NO: 318

SEQ ID NO: 321 - DNA, 1392 bp, Corynebacterium glutamicum
  CDS (101)..(1369): RXN00662
ccctcatcatagttttaaatctggggcagaggcgggaatttaaacacctctgatacagcgtttactggctatagtgttgcgcgtgccaaatcgagttcctgtgtcaaccattccgctgaatcgtctagccgttatcgctgccatcattggtgtcggtaccgggctgtttgttgctgcactgaactggtctgccattggcgtggagcgtttagtttatggcgctgaccatttgcataattacaatccggtggccaatgtgtcgccacttcgcctgtccatcacggtgattgtgcttagcgtggtggcctcctgggcgtggttttttgtgcaccgcacggggccgaaagaggtttcgattgtgggtgcgatccggggcgagaagatgccgattttggagaccatagcgtccgcatttttgcaggtcaccacggttgctgcgggtgcgccggtgggtgcagagaacgctccacgtattgctggagccttggtgggagagcggtttagtcggtggttgcagctcgatattgatgcaaagcgcatcttggtggcctctgccgcgggagctggtttgggagcaagcttccaccttcccctagcaggcgtgctgtttgcccttgaggtcctactggttgaggcctccactcggaccgtggttatcgcaattatcaccacgaccgccgccgttgccaccactggatttttcgtgcaaaccccagatgtgttcagcactgtcccgctgacggaaagcccatggatgctgcttgccgcgatggtcaccggagtagtcgccggcatgtgcgggcactggttttcagcggcggcgcacaaaatggcgcaggcctcgcccaagggtgtgaagattttgtggcagatgccgttgggtttcgtggtgatcgctgcggtgatttatttcttccccgaaaccctggcgaatccccgttggcttgccgattccatgctcggcgatggcctgatcctcagcaccattttattggtacttgttctgcgcaccgccatgtttttgctcgccttccgcgtgggcatggtcggcggtaacctgatccccgcattcgcactcggatccatggtcggtggggtagtgggtgctgtattggaacccatcactaacgtcccgatcgccgcttttgcgctgcttggcgccgccgcatttttgtccaccaccatggcagcgccactgttcgggctcatcgccgcagtggaattcaccgacatggaagcccaaggctaccttccgattttcctcgcagtagcctccgcggtcctcgccgtgcgcgtgtggtctgtcatcgccaagcacgagctccgcgccatcccgatcacgtacgcgagctggacgggcgagcttaaataagcttgtcgacgcctccctcc

SEQ ID NO: 322 - protein, 423 aa, Corynebacterium glutamicum
VSTIPLNRLAVIAAIIGVGTGLFVAALNWSAIGVERLVYGADHLHNYNPVANVSPLRLSITVIVLSVVASWAWFFVHRTGPKEVSIVGAIRGEKMPILETIASAFLQVTTVAAGAPVGAENAPRIAGALVGERFSRWLQLDIDAKRILVASAAGAGLGASFHLPLAGVLFALEVLLVEASTRTVVIAIITTTAAVATTGFFVQTPDVFSTVPLTESPWMLLAAMVTGVVAGMCGHWFSAAAHKMAQASPKGVKILWQMPLGFVVIAAVIYFFPETLANPRWLADSMLGDGLILSTILLVLVLRTAMFLLAFRVGMVGGNLIPAFALGSMVGGVVGAVLEPITNVPIAAFALLGAAAFLSTTMAAPLFGLIAAVEFTDMEAQGYLPIFLAVASAVLAVRVWSVIAKHELRAIPITYASWTGELK

SEQ ID NO: 323 - DNA, 1392 bp, Corynebacterium glutamicum; identical to SEQ ID NO: 321
  CDS (101)..(1369): FRXA00662

SEQ ID NO: 324 - protein, 423 aa, Corynebacterium glutamicum; identical to SEQ ID NO: 322

SEQ ID NO: 325 - DNA, 1038 bp, Corynebacterium glutamicum
  CDS (101)..(1015): RXN00666
agtggtgaatgctggataagtttttaacatgtctagtgtagtcggggaaggcccaaaaccacgattgagcgtgcttgatctcgtcgcgctgagtgaagggatgacggccggcgaggccattgcacacagtgttcgcgctgcgcagatcgccgaagagcacaattatgcgcgtttctgggtggcggagcaccacaactcggaaggcttggcatcttccgcgacgacgctgctcatgggtcatattgcaggccacacttcacgcattcgcgttggctccggtggcatcatgatgcccaaccactccgcgctgcacgtcgccgaagaactcggcacccttgaggccatttaccccggccgcatcgaggccggcctagggcgcgcaccaggaaccgaccccatgacggcgcgggaattgggtcgggcaagttcgcttgtcgacgacgtcctctccacaatcgtctccctccagaattatttggacacccccgaagaacgcccgaacatcatcgcgcatccaggaataaattcccgtgtgccgctattcatgctgggatcttccctcaacggcgctgcgatggccgctaaattagaccttccattcgccttcgccagccacttcgcacccttccaaatggggcccgccatcgcctcctatcgcgaactagcagccaatccttatgtcatggccgcagcgaatgtcctggtgtgcgacaccgaggaagaagccgaattccagatctccacactgcaccaaatgttcgccggaatcgtgacgaactcccgcggcaaacttgccccaccagtgcggaatctgaaagacaaactcgacccgatgatctggaaacacatcgaagattcattggaaatgactttcatcggaacagccgaatcagtggtattacaactgcaggaattcgctgatcgctacaagttagatgagatcattacagtcacctactcctacgaccccgaagtcaggttccgctccatagctgcacttggcacggcatggaattagtgtcaaaagcctcaaaaata

SEQ ID NO: 326 - protein, 305 aa, Corynebacterium glutamicum
MTAGEAIAHSVRAAQIAEEHNYARFWVAEHHNSEGLASSATTLLMGHIAGHTSRIRVGSGGIMMPNHSALHVAEELGTLEAIYPGRIEAGLGRAPGTDPMTARELGRASSLVDDVLSTIVSLQNYLDTPEERPNIIAHPGINSRVPLFMLGSSLNGAAMAAKLDLPFAFASHFAPFQMGPAIASYRELAANPYVMAAANVLVCDTEEEAEFQISTLHQMFAGIVTNSRGKLAPPVRNLKDKLDPMIWKHIEDSLEMTFIGTAESVVLQLQEFADRYKLDEIITVTYSYDPEVRFRSIAALGTAWN

SEQ ID NO: 327 - DNA, 487 bp, Corynebacterium glutamicum
  CDS (101)..(487): FRXA00666
agtggtgaatgctggataagtttttaacatgtctagtgtagtcggggaaggcccaaaaccacgattgagcgtgcttgatctcgtcgcgctgagtgaagggatgacggccggcgaggccattgcacacagtgttcgcgctgcgcagatcgccgaagagcacaattatgcgcgtttctgggtggcggagcaccacaactcggaaggcttggcatcttccgcgacgacgctgctcatgggtcatattgcaggccacacttcacgcattcgcgttggctccggtggcatcatgatgcccaaccactccgcgctgcacgtcgccgaagaactcggcacccttgaggccatttaccccggccgcatcgaggccggcctagggcgcgcaccaggaaccgaccccatgacggcgcgggaattgggtcgggcaagttcgcttgtcgacgacgtcctctccacaatcgtctccctccagaattatttggacaccccc

SEQ ID NO: 328 - protein, 129 aa, Corynebacterium glutamicum
MTAGEAIAHSVRAAQIAEEHNYARFWVAEHHNSEGLASSATTLLMGHIAGHTSRIRVGSGGIMMPNHSALHVAEELGTLEAIYPGRIEAGLGRAPGTDPMTARELGRASSLVDDVLSTIVSLQNYLDTP

SEQ ID NO: 329 - DNA, 750 bp, Corynebacterium glutamicum
  CDS (101)..(727): RXN00704
tcaaattctgcgcacaaagtgttctaagacgacgtctgcccatcggcgctctaatgcacattacagcgtttacagaattgaaaatgaaaggttcaaagccttgaccattacttttagccgcgttgctctgaccaccctggcagtcaccgcaaccactttgtccctgagcactgctgcgaatgcacagtcttccttgttggataagactcttgatgcccgtcagtgcatcgatgcagacaacgtctgggtctcagttgactatggtgcagattccgaaaaagaaccagagggcgcatgtgccaccgagttcactgatggtgttgtagctcttgaatctgctgggttcaaactgacctttgacgaatctgaaatgggcaaatacatgaccggtatcaacggagttgttcctgattgggttgaaactggaacttactggagttactactctggtgaagtcgcagatgattacagcgtggactacacctactacgaggttggtgcatctaattctgaacctgaaggtggaactgttgaggcttgggttgttggcaccggcgaggaaacaccagcactcgagactcttcctgaaactccagcagcaaccggatcttctgaagacggcggctggattgcagtcatcgcaggtcttctcgcactgatcggtggtggagttgcagctttgtaccagggcttgatcactatcccaggtctggttctgcctaagttttaagcaacctaacctaaagcttc

SEQ ID NO: 330 - protein, 209 aa, Corynebacterium glutamicum
LTITFSRVALTTLAVTATTLSLSTAANAQSSLLDKTLDARQCIDADNVWVSVDYGADSEKEPEGACATEFTDGVVALESAGFKLTFDESEMGKYMTGINGVVPDWVETGTYWSYYSGEVADDYSVDYTYYEVGASNSEPEGGTVEAWVVGTGEETPALETLPETPAATGSSEDGGWIAVIAGLLALIGGGVAALYQGLITIPGLVLPKF

SEQ ID NO: 331 - DNA, 636 bp, Corynebacterium glutamicum
  CDS (101)..(613): FRXA00704
tcaaattctgcgcacaaagtgttctaagacgacgtctgcccatcggcgctctaatgcacattacagcgtttacagaattgaaaatgaaaggttcaaagccttgaccattacttttagccgcgttgctctgaccaccctggcagtcaccgcaaccactttgtccctgagcactgctgcgaatgcacagtcttccttgttggataagactcttgatgcccgtcagtgcatcgatgcagacaacgtctgggtctcagttgactatggtgcagattccgaaaaagaaccagagggcgcatgtgccaccgagttcactgatggtgttgtagctcttgaatctgctgggttcaaactgacctttgacgaatctgaaatgggcaaatacatgaccggtatcaacggagttgttcctgattgggttgaaactggaacttactggagttactactctggtgaagtcgcagatgattacagcgtggactacacctactacgaggttggtgcatctaattctgaacctgaaggtggaactgttgaggcttgggttgttggcaccggcgaggaaacaccagcactcgagactctttctgaaacttcagcagcaaccggatcttcttaagacggcggctggattgcagt

SEQ ID NO: 332 - protein, 171 aa, Corynebacterium glutamicum
LTITFSRVALTTLAVTATTLSLSTAANAQSSLLDKTLDARQCIDADNVWVSVDYGADSEKEPEGACATEFTDGVVALESAGFKLTFDESEMGKYMTGINGVVPDWVETGTYWSYYSGEVADDYSVDYTYYEVGASNSEPEGGTVEAWVVGTGEETPALETLSETSAATGSS

SEQ ID NO: 333 - DNA, 819 bp, Corynebacterium glutamicum
  CDS (101)..(796): RXN00712
tgttgcgcgttaataaggaacaatatcggtgtgattcgcgatatattaatcagcttgttttcccagcataagtagtcgcctagtttaggaggtacatggcatgtccctacgcaagaatctcgccctcggaagcagcacagtactactcacagccgtgctaagcgggtgtgtttcccttgatgagcgctccactgatacatccacggagaatgtcaccacggtaactgccacactcacttccaccgccgcagcagaacccaccactagaacgactgtgcaaagtgctacagaagcctccactactgcaccagtgcaatgcaatttggatccccgtacctcggattttgggccatatcttgcacaatctcgcaccccggttggtgagctagctggatctgcagattccgtcgtgcaggttcctgactggttctatcacttccaaatgggcgacaacggctacgattcctgttccaagctcagctatgtggttctcaacggttccaatggagacgccgaacgttctactggaacgggtgctgcgatcgccgacgtggtggtgctgtttatcgacggccatatggttgctcgtcctgctccttttgaaatgaagaccgtggaatccgtcaccagagtgtcagattcagaaatccaagttgtttacggacatgccggccgatctactgccgaaggtgttacggactatttcacctttaacttcttcgttgacaacggcgttctttcaggacgcggcgatctcccagaacacatcgatactcacatgcgtctatatctgctgtagccccatctaaaaactcttga

SEQ ID NO: 334 - protein, 232 aa, Corynebacterium glutamicum
MSLRKNLALGSSTVLLTAVLSGCVSLDERSTDTSTENVTTVTATLTSTAAAEPTTRTTVQSATEASTTAPVQCNLDPRTSDFGPYLAQSRTPVGELAGSADSVVQVPDWFYHFQMGDNGYDSCSKLSYVVLNGSNGDAERSTGTGAAIADVVVLFIDGHMVARPAPFEMKTVESVTRVSDSEIQVVYGHAGRSTAEGVTDYFTFNFFVDNGVLSGRGDLPEHIDTHMRLYLL

SEQ ID NO: 335 - DNA, 572 bp, Corynebacterium glutamicum
  CDS (1)..(549): FRXA00712
gcagcagaacccaccactagaacgactgtgcaaagtgctacagaagcctccactactgcaccagtgcaatgcaatttggatccccgtacctcggattttgggccatatcttgcacaatctcgcaccccggttggtgagctagctggatctgcagattccgtcgtgcaggttcctgactggttctatcacttccaaatgggcgacaacggctacgattcctgttccaagctcagctatgtggttctcaacggttccaatggagacgccgaacgttctactggaacgggtgctgcgatcgccgacgtggtggtgctgtttatcgacggccatatggttgctcgtcctgctccttttgaaatgaagaccgtggaatccgtcaccagagtgtcagattcagaaatccaagttgtttacggacatgccggccgatctactgccgaaggtgttacggactatttcacctttaacttcttcgttgacaacggcgttctttcaggacgcggcgatctcccagaacacatcgatactcacatgcgtctatatctgctgtagccccatctaaaaactcttga

SEQ ID NO: 336 - protein, 183 aa, Corynebacterium glutamicum
AAEPTTRTTVQSATEASTTAPVQCNLDPRTSDFGPYLAQSRTPVGELAGSADSVVQVPDWFYHFQMGDNGYDSCSKLSYVVLNGSNGDAERSTGTGAAIADVVVLFIDGHMVARPAPFEMKTVESVTRVSDSEIQVVYGHAGRSTAEGVTDYFTFNFFVDNGVLSGRGDLPEHIDTHMRLYLL

SEQ ID NO: 337 - DNA, 789 bp, Corynebacterium glutamicum
  CDS (101)..(766): RXN00720
ctgatctatacgtcctgttgaagtagagaagctttctggtcaagttccttgagtatggtggtcgaagaccagcactccagattcaaggaacttataaaacatggcatcaccgcgccgcccacaggttgcagcaccacgcatcaaagaacttcgcctaacaggccttgacaacgctgaccctcaagacatcgaatcgaatgagcagatagagtcatgccgttttaacgaggccgagctttccgaacgcgatctttctggtgctggtttcattgaatgtgaattccttgggctggaagcacacgaaaccgagctacgccgggctcaattcgtggaaacacgcatcgaaagagccaatgctccatcttttaaggcagcccgctccatctggcgcaacgcaacgatttccgactcccgctttggtgccgtcgaaatgtatgaagcaaccgtccaagctttgaaaatctctgattctaagctgtcgtttgtcaatctgcggggtgcatcgttacgggatgtgctctttgagaactgtgtcatcgacgagcttgatcttggccaagccagagcagaacgcatcgcttttaaagactgcacggtgcattcgctcacctttgatcatgccgtgctcagcaatgtggatcttcgcggtttagatatcgagcgcatcagtggcgtggagtccatgtccggaaccgtgatctcatccctgcaggctgctgacctgtcgggagcatttgcacggcatttaggaattactgtaaacgattagaaatccgctcttttgaacaa

SEQ ID NO: 338 - protein, 222 aa, Corynebacterium glutamicum
MASPRRPQVAAPRIKELRLTGLDNADPQDIESNEQIESCRFNEAELSERDLSGAGFIECEFLGLEAHETELRRAQFVETRIERANAPSFKAARSIWRNATISDSRFGAVEMYEATVQALKISDSKLSFVNLRGASLRDVLFENCVIDELDLGQARAERIAFKDCTVHSLTFDHAVLSNVDLRGLDIERISGVESMSGTVISSLQAADLSGAFARHLGITVND

SEQ ID NO: 339 - DNA, 789 bp, Corynebacterium glutamicum; identical to SEQ ID NO: 337
  CDS (101)..(766): FRXA00720

SEQ ID NO: 340 - protein, 222 aa, Corynebacterium glutamicum; identical to SEQ ID NO: 338

SEQ ID NO: 341 - DNA, 1088 bp, Corynebacterium glutamicum
  CDS (1)..(1065): RXN00722
gctgttctccgagaagccggagttgttgatgccgggggacagggcctagttattctcctggagtccctggccgaacaaatcaacggaaacccacctcaccatccatcgcaccacagtgaaccagccgaagaaccctccttccacggcaaaaccggcgacctagaagtgatgttttacattgcatgcgactccgcgcaaacactcgatgctctccacaacgaacttgaaacactaggcgacagcctgctcatcgcccgagaaaccaatacccgcggcaccgttcacatccattcgcgccgggcaggcgaggtcatccaaaaagcatttgccgcaggagacgtcagcgaactccgccttgaaatcctccccgatacttccggcagcttcacggaagaaccacgccgggtcctcatggctgtcgcacctgacggcctggtggcggagctgtaccgcagcgctggagtgaaggtggtggcccgcaacatcgcgcaatccaagtctgatgatgtggtggcaaagatcgtttccatcgcgcgcaagtctggtgccgatgaggtgatcttgctgcccaacggtcttttgaccaagcgtgagctggtttccattgagcgttccagccatgcttttgagcaaagtgtggttattttgcctactgccacgttggttgcaggtcttgcagcggtgtccgttcatgagccagcgcaacccctggcggtggattcctatgccatggcagaggccgccggttccatgcgcacggccacgatccgcgccgccaccagcgccgcgctcacccaggccggcgcatgctccaagggtgatctattaagcttcatcggcccggagatagctctggtctccgaggagctcaacgacgcgctatcgcgcaccgctttaaggcttctcgacggctccagcgagcaaattacccttctcatagcgcaagaccgtcagtccgccttcgacgaagatgttttccgccgtggcctgggaactcacacggatgtggagatcacggtctatcctgctactggaatggagaatctggtagagatcggagtggagtagccacatgttgggttggcatg

SEQ ID NO: 342 - protein, 355 aa, Corynebacterium glutamicum
AVLREAGVVDAGGQGLVILLESLAEQINGNPPHHPSHHSEPAEEPSFHGKTGDLEVMFYIACDSAQTLDALHNELETLGDSLLIARETNTRGTVHIHSRRAGEVIQKAFAAGDVSELRLEILPDTSGSFTEEPRRVLMAVAPDGLVAELYRSAGVKVVARNIAQSKSDDVVAKIVSIARKSGADEVILLPNGLLTKRELVSIERSSHAFEQSVVILPTATLVAGLAAVSVHEPAQPLAVDSYAMAEAAGSMRTATIRAATSAALTQAGACSKGDLLSFIGPEIALVSEELNDALSRTALRLLDGSSEQITLLIAQDRQSAFDEDVFRRGLGTHTDVEITVYPATGMENLVEIGVE

SEQ ID NO: 343 - DNA, 542 bp, Corynebacterium glutamicum
  CDS (16)..(519): FRXA00722
ccccccccggtgatcttgctgcccaacggtcttttgaccaagcgtgagctggtttccattgagcgttccagccatgcttttgagcaaagtgtggttattttgcctactgccacgttggttgcaggtcttgcagcggtgtccgttcatgagccagcgcaacccctggcggtggattcctatgccatggcagaggccgccggttccatgcgcacggccacgatccgcgccgccaccagcgccgcgctcacccaggccggcgcatgctccaagggtgatctattaagcttcatcggcccggagatagctctggtctccgaggagctcaacgacgcgctatcgcgcaccgctttaaggcttctcgacggctccagcgagcaaattacccttctcatagcgcaagaccgtcagtccgccttcgacgaagatgttttccgccgtggcctgggaactcacacggatgtggagatcacggtctatcctgctactggaatggagaatctggtagagatcggagtggagtagccacatgttgggttggcatg

SEQ ID NO: 344 - protein, 168 aa, Corynebacterium glutamicum
LLPNGLLTKRELVSIERSSHAFEQSVVILPTATLVAGLAAVSVHEPAQPLAVDSYAMAEAAGSMRTATIRAATSAALTQAGACSKGDLLSFIGPEIALVSEELNDALSRTALRLLDGSSEQITLLIAQDRQSAFDEDVFRRGLGTHTDVEITVYPATGMENLVEIGVE

SEQ ID NO: 345 - DNA, 1101 bp, Corynebacterium glutamicum
  CDS (101)..(1078): RXN00729
ttcagcacagatcaccctttgccagctaccgacttagtttcgtaacacgtatagtgggaggcgttttgccagacgccaaagaaagataattggattacctatgagcgccaccaaccctgatgccctagacgtgcagcacgtctatcccatcaagacgaaaaagactccacttgcggtgattttcaacatcattagcggtggtttgattggaatggcggagttggtgccaggaatttccggcggaactgtcgctttggttcttggaatttatgagcgcgcactgcacaacggtgatctcctcattgatctgatcaaggtgttgatcaaggaccgctcgaaggttaaggaagctgcggcgaaaatcgactggtggttcctcggcgctatcggcgttggcatggtcgtgatggtcttctcgatgtcatcgattttgcatacagttgttgaggactacccagagatcactcgcggtctgttccttggaatggttgccgtgtctatccttgttccgttgggaatgatggatatgcgggatgccaagaagcgcctcgcaatcgtcatcccgctatttataatctgcgccatgctgggattctttggaacatccttcactagtgcgcctcgcaccgatccttcactgatctttgtcttcatctgtgctgcgatcgctgtgtgtgctcttgttcttcctggtgtttcaggatcattcttcttgctggcggtcggtatgtacgcgccaatcatggaatctctgtccaaccgtgacttgtcggtcatcggcgtgttcttgcttggcgcgctcaccggtgtgatcttgtttgtgaaggttttgtcttatgttctcgagcaccaccgcaccatcacgctgaccatcatggctggtctcatgctgggttcacttcgtgcgctgtggccttggcaggacggtgacgctaatctacttgctcctggcgataacgccgtgatgattttcagcatcatcattcttggtggcgcgattgtcgctgctttgatgtttgctgagcgtgtgtcttccaagaacattgattctgagaccgtggcagaagagcacccgcgctaaataagaactccacaaagaaa

SEQ ID NO: 346 - protein, 326 aa, Corynebacterium glutamicum
MSATNPDALDVQHVYPIKTKKTPLAVIFNIISGGLIGMAELVPGISGGTVALVLGIYERALHNGDLLIDLIKVLIKDRSKVKEAAAKIDWWFLGAIGVGMVVMVFSMSSILHTVVEDYPEITRGLFLGMVAVSILVPLGMMDMRDAKKRLAIVIPLFIICAMLGFFGTSFTSAPRTDPSLIFVFICAAIAVCALVLPGVSGSFFLLAVGMYAPIMESLSNRDLSVIGVFLLGALTGVILFVKVLSYVLEHHRTITLTIMAGLMLGSLRALWPWQDGDANLLAPGDNAVMIFSIIILGGAIVAALMFAERVSSKNIDSETVAEEHPR

SEQ ID NO: 347 - DNA, 665 bp, Corynebacterium glutamicum
  CDS (1)..(642): FRXA00729
acagttgttgaggactaccaagagttcactcgcggtctgttccttggaatggttgccgtgtctatccttgttccgttgggaatgatggatatgcgggatgccaagaagcgcctcgcaatcgtcatcccgctatttataatctgcgccatgctgggattctttggaacatccttcactagtgcgcctcgcaccgatccttcactgatctttgtcttcatctgtgctgcgatcgctgtgtgtgctcttgttcttcctggtgtttcaggatcattcttcttgctggcggtcggtatgtacgcgccaatcatggaatctctgtccaaccgtgacttgtcggtcatcggcgtgttcttgcttggcgcgctcaccggtgtgatcttgtttgtgaaggttttgtcttatgttctcgagcaccaccgcaccatcacgctgaccatcatggctggtctcatgctgggttcacttcgtgcgctgtggccttggcaggacggtgacgctaatctacttgctcctggcgataacgccgtgatgattttcagcatcatcattcttggtggcgcgattgtcgctgctttgatgtttgctgagcgtgtgtcttccaagaacattgattctgagaccgtggcagaagagcacccgcgctaaataagaactccacaaagaaa

SEQ ID NO: 348 - protein, 214 aa, Corynebacterium glutamicum
TVVEDYQEFTRGLFLGMVAVSILVPLGMMDMRDAKKRLAIVIPLFIICAMLGFFGTSFTSAPRTDPSLIFVFICAAIAVCALVLPGVSGSFFLLAVGMYAPIMESLSNRDLSVIGVFLLGALTGVILFVKVLSYVLEHHRTITLTIMAGLMLGSLRALWPWQDGDANLLAPGDNAVMIFSIIILGGAIVAALMFAERVSSKNIDSETVAEEHPR

SEQ ID NO: 349 - DNA, 706 bp, Corynebacterium glutamicum
  CDS (101)..(706): FRXA02867
ttcagcacagatcaccctttgccagctaccgacttagtttcgtaacacgtatagtgggaggcgttttgccagacgccaaagaaagataattggattacctatgagcgccaccaaccctgatgccctagacgtgcagcacgtctatcccatcaagacgaaaaagactccacttgcggtgattttcaacatcattagcggtggtttgattggaatggcggagttggtgccaggaatttccggcggaactgtcgctttggttcttggaatttatgagcgcgcactgcacaacggtgatctcctcattgatctgatcaaggtgttgatcaaggaccgctcgaaggttaaggaagctgcggcgaaaatcgactggtggttcctcggcgctatcggcgttggcatggtcgtgatggtcttctcgatgtcatcgattttgcatacagttgttgaggactacccagagatcactcgcggtctgttccttggaatggttgccgtgtctatccttgttccgttgggaatgatggatatgcgggatgccaagaagcgcctcgcaatcgtcatcccgctatttataatctgcgccatgctgggattctttggaacatccttcactagtgcgcctcgcaccgatccttcactgatctttgtcttcatctgtgctgcgatcgctgtgtgtgctcttgttcttcctggtgttcaggatcac

SEQ ID NO: 350 - protein, 202 aa, Corynebacterium glutamicum
MSATNPDALDVQHVYPIKTKKTPLAVIFNIISGGLIGMAELVPGISGGTVALVLGIYERALHNGDLLIDLIKVLIKDRSKVKEAAAKIDWWFLGAIGVGMVVMVFSMSSILHTVVEDYPEITRGLFLGMVAVSILVPLGMMDMRDAKKRLAIVIPLFIICAMLGFFGTSFTSAPRTDPSLIFVFICAAIAVCALVLPGVQDH

SEQ ID NO: 351 - DNA, 930 bp, Corynebacterium glutamicum
  CDS (101)..(907): RXN00730
tggtgcaataaccttaagtgaggctggattttgcgttggcaggcgctcgggttttgttttatccggcatgggctcgggagggactttaaaataaacagctatgtcgagccaacaaacgatcttcatcattttgctctttgccgcagtgattctcatttccatagtaatgattacagctgccttcaaaacccggaaaaagcgctttgccgcgcgggctgaaggaatggccaaccctacaattcctgcgccaactgtgccgtggcagcgcttcgccggagcacttgcagccttgtacgctaggcctgaatggcacaagacccgcggagcgaaacgagtgtactcagctgaacagacttattttgggtttgtctcagcaatgccactggggatggtgcaaaacatgctgcaaacagactggggtgtgaaaaagtctgagcatgcagttgatcagctttctaaaggagtggaagtgatcgttggggtagccgcaggcaactggcgtaaaaacggagtatcacccgcacaagtggaagaggcaggccagcggttagcagctgaaggattggctcatccacactttgttgtattccaaaagcagcttcaacaggcagatccaaatgcagaatatgatctcgatgtgctcgcatttgatatcgcacgcgtagccaacctccttcgctgggctgcttatacagatctgttgctccctgcagaagcccgttggttccaagaccagctgggaattgcggctgctgtgtcctttgggagctgggaagaatacggagagcgatacgtccgtggactacagaagaacttcaagggcggaaacaagccatatatcgaaggagaacgctggctcaacactgaggctgaaagtccatggaagacccaaaagtggattagcgcctaactgctcatgagctaagcggc

SEQ ID NO: 352 - protein, 269 aa, Corynebacterium glutamicum
MSSQQTIFIILLFAAVILISIVMITAAFKTRKKRFAARAEGMANPTIPAPTVPWQRFAGALAALYARPEWHKTRGAKRVYSAEQTYFGFVSAMPLGMVQNMLQTDWGVKKSEHAVDQLSKGVEVIVGVAAGNWRKNGVSPAQVEEAGQRLAAEGLAHPHFVVFQKQLQQADPNAEYDLDVLAFDIARVANLLRWAAYTDLLLPAEARWFQDQLGIAAAVSFGSWEEYGERYVRGLQKNFKGGNKPYIEGERWLNTEAESPWKTQKWISA

SEQ ID NO: 353 - DNA, 356 bp, Corynebacterium glutamicum
  CDS (1)..(333): FRXA00730
cactttgttgtattccaaaagcagcttcaacaggcagatccaaatgcagaatatgatctcgatgtgctcgcatttgatatcgcacgcgtagccaacctccttcgctgggctgcttatacagatctgttgctccctgcagaagcccgttggttccaagaccagctgggaattgcggctgctgtgtcctttgggagctgggaagaatacggagagcgatacgtccgtggactacagaagaacttcaagggcggaaacaagccatatatcgaaggagaacgctggctcaacactgaggctgaaagtccatggaagacccaaaagtggattagcgcctaactgctcatgagctaagcggc

SEQ ID NO: 354 - protein, 111 aa, Corynebacterium glutamicum
HFVVFQKQLQQADPNAEYDLDVLAFDIARVANLLRWAAYTDLLLPAEARWFQDQLGIAAAVSFGSWEEYGERYVRGLQKNFKGGNKPYIEGERWLNTEAESPWKTQKWISA

SEQ ID NO: 355 - DNA, 2619 bp, Corynebacterium glutamicum
  CDS (101)..(2596): RXN00731
ttgataccgtggccggtggacattccttccaggtgtggcgcgtggctttagcgaatacttttgattgggttgccaagcgcggcggattgcaggtttaacaatgaaagacgcttcacagtcctacttattattcggtctgagatggctgggcaggtccctgcgtttcgcaccgttaagcctgctcatgatcgttgtcatgcggggtttgagggaagtgtttggcgccgaagatcccgcaaatagctctttggtagacaaccttgggctcaccctgccgtggtctcttaatgatccgcattttctcaccgcagggtttagcgcttccaccaccacagcagcgctcatgtccacgttgtggatcatcgtgtttgcggtgccctctgaacggattctgggcagcctcaaattcgcgatcacagcagcgcttatccacatcacttccattccgctgggcatcggcatcgcccacctcatcgaagaagccgatctcaaccgctggggcaacaacatgttggccgatgtgctgctcaccccagatttctgggtcttcggcgtcgccgctttcgcatccgcctccatgccactgctctggcgacggcgcacccgattgttcctctttactatcaccttgacgctgctgctttatacgggcacgcttgccgacgtcaccatgctcaccgcgaccatcatcggcaccgttgccggcgagttgaacaggcatcggaaaaccccaggtggccgctggcttcccggttccctcaccgtgcgtgaagcgcgcattatgacggccattttggtcactgccgtagcagcaggtccagtgcttgctgcgcttaatccactcacccacggccctttttccagtgcaacgaaattgatctggcagccccttgtcactgaagaacacatgcatcacctctgccacacagacagcacctctgatgcatgccaaggtgcgcttgatcagctccaacagcacggtgttggcccttccgttgccaacctgattccactgatcctcaccgtggtccttgcgatggggcttagccgcggacgtcgacttgcatggattttggcggttttggcccagctcatttccatcgcagtgttgatgttccagctgaccaaactatcggctgattccaccgatcttctatggtcagtcaatgcctttagcgtgatcgttccttggctggtggcgctcgccgtcttggtgttttcccgccgtgcattccaggtgaagattgataccacccggatttctaaatccttaggcgctctcatggttacatggttggcaacggcagcattgtggatccttgccacattgttcctgccacacgcattccacccacatccaacattggggctggctttcaaagaactccccttccgctatctcccaccaactatcgaaacggtgttaagccatcaactcttccccagaagccctgctgggtgggcagtgtttgaatggactggaacgctattctggctggtcgtagcagcaactctttatcatctgctcatgggtgtgcccagcaacaaagcgcacgaggaccaagaaaacgcagcgactctcctgcgctctggcagcggcgatcacttgtcctggatgaccatttggggtggcaatacgtattggtgggcaccagaaaatgcaggatatgtggcctaccgcgtgaaaaggggcatcgcaattacattgggtgagcctattctgggtccggattcatccgtctctaaagcagagctggccgcacagtttgaagaatttgccagcaaccaaggctggattgttgcgtggtattccgtttgtgaagaattctcaaaggaacgcatcaacgctggccaccacacacttcgtgtggctgaggaagcagtcttaagctcagctaatgcggatttcaaaggtaagcacttccaaaatgtccgcaccgcccgaaaccgcgcggccaaagagggcgtaagttccatctggacaacctgggctgatttgagtgccgaaatgcagcacaagatcatcacgctgtcggaagaatgggtctctgataaagctctgccggagatgggcttcacgcttggcactgtcaacgagctctcagatccagatacctatcttcttctcgcgattgatgaggaagagcatctgcacggtgtgaccagttggttgccggtctatgaaaaaggacgcatcgtcggctacacacttgatgtgatgcgccgtgatccgcaaggctttaaatctgtcatcgagtttctcatttccgaggccgtcgttatcgcaagggatcacgatctggaatggatgtcgatgtccggcgctcctttgagtacgcccccaggtgtggccgacgacggcaccatcggacaaattttggagcttttgggccgagcaatggagccgttctacggtttccgttccctcgctgcgtccaagaacaaattccacccagaacaccacggttggtacttgtgttaccgcgatgaattatcgttaccaagcattggccttgccgttgctgcctgctacctcaacgagtttccgctgccgaattggctgaaaaagaccgccacttccgccccaagccacagctagaaaaacgcgtaaccttggtg

SEQ ID NO: 356 - protein, 832 aa, Corynebacterium glutamicum
MKDASQSYLLFGLRWLGRSLRFAPLSLLMIVVMRGLREVFGAEDPANSSLVDNLGLTLPWSLNDPHFLTAGFSASTTTAALMSTLWIIVFAVPSERILGSLKFAITAALIHITSIPLGIGIAHLIEEADLNRWGNNMLADVLLTPDFWVFGVAAFASASMPLLWRRRTRLFLFTITLTLLLYTGTLADVTMLTATIIGTVAGELNRHRKTPGGRWLPGSLTVREARIMTAILVTAVAAGPVLAALNPLTHGPFSSATKLIWQPLVTEEHMHHLCHTDSTSDACQGALDQLQQHGVGPSVANLIPLILTVVLAMGLSRGRRLAWILAVLAQLISIAVLMFQLTKLSADSTDLLWSVNAFSVIVPWLVALAVLVFSRRAFQVKIDTTRISKSLGALMVTWLATAALWILATLFLPHAFHPHPTLGLAFKELPFRYLPPTIETVLSHQLFPRSPAGWAVFEWTGTLFWLVVAATLYHLLMGVPSNKAHEDQENAATLLRSGSGDHLSWMTIWGGNTYWWAPENAGYVAYRVKRGIAITLGEPILGPDSSVSKAELAAQFEEFASNQGWIVAWYSVCEEFSKERINAGHHTLRVAEEAVLSSANADFKGKHFQNVRTARNRAAKEGVSSIWTTWADLSAEMQHKIITLSEEWVSDKALPEMGFTLGTVNELSDPDTYLLLAIDEEEHLHGVTSWLPVYEKGRIVGYTLDVMRRDPQGFKSVIEFLISEAVVIARDHDLEWMSMSGAPLSTPPGVADDGTIGQILELLGRAMEPFYGFRSLAASKNKFHPEHHGWYLCYRDELSLPSIGLAVAACYLNEFPLPNWLKKTATSAPSHS

SEQ ID NO: 357 - DNA, 2495 bp, Corynebacterium glutamicum
  CDS (1)..(2472): FRXA00731
ttattattcggtctgagatggctgggcaggtccctgcgtttcgcaccgttaagcctgctcatgatcgttgtcatgcggggtttgagggaagtgtttggcgccgaagatcccgcaaatagctctttggtagacaaccttgggctcaccctgccgtggtctcttaatgatccgcattttctcaccgcagggtttagcgcttccaccaccacagcagcgctcatgtccacgttgtggatcatcgtgtttgcggtgccctctgaacggattctgggcagcctcaaattcgcgatcacagcagcgcttatccacatcacttccattccgctgggcatcggcatcgcccacctcatcgaagaagccgatctcaaccgctggggcaacaacatgttggccgatgtgctgctcaccccagatttctgggtcttcggcgtcgccgctttcgcatccgcctccatgccactgctctggcgacggcgcacccgattgttcctctttactatcaccttgacgctgctgctttatacgggcacgcttgccgacgtcaccatgctcaccgcgaccatcatcggcaccgttgccggcgagttgaacaggcatcggaaaaccccaggtggccgctggcttcccggttccctcaccgtgcgtgaagcgcgcattatgacggccattttggtcactgccgtagcagcaggtccagtgcttgctgcgcttaatccactcacccacggccctttttccagtgcaacgaaattgatctggcagccccttgtcactgaagaacacatgcatcacctctgccacacagacagcacctctgatgcatgccaaggtgcgcttgatcagctccaacagcacggtgttggcccttccgttgccaacctgattccactgatcctcaccgtggtccttgcgatggggcttagccgcggacgtcgacttgcatggattttggcggttttggcccagctcatttccatcgcagtgttgatgttccagctgaccaaactatcggctgattccaccgatcttctatggtcagtcaatgcctttagcgtgatcgttccttggctggtggcgctcgccgtcttggtgttttcccgccgtgcattccaggtgaagattgataccacccggatttctaaatccttaggcgctctcatggttacatggttggcaacggcagcattgtggatccttgccacattgttcctgccacacgcattccacccacatccaacattggggctggctttcaaagaactccccttccgctatctcccaccaactatcgaaacggtgttaagccatcaactcttccccagaagccctgctgggtgggcagtgtttgaatggactggaacgctattctggctggtcgtagcagcaactctttatcatctgctcatgggtgtgcccagcaacaaagcgcacgaggaccaagaaaacgcagcgactctcctgcgctctggcagcggcgatcacttgtcctggatgaccatttggggtggcaatacgtattggtgggcaccagaaaatgcaggatatgtggcctaccgcgtgaaaaggggcatcgcaattacattgggtgagcctattctgggtccggattcatccgtctctaaagcagagctggccgcacagtttgaagaatttgccagcaaccaaggctggattgttgcgtggtattccgtttgtgaagaattctcaaaggaacgcatcaacgctggccaccacacacttcgtgtggctgaggaagcagtcttaagctcagctaatgcggatttcaaaggtaagcacttccaaaatgtccgcaccgcccgaaaccgcgcggccaaagagggcgtaagttccatctggacaacctgggctgatttgagtgccgaaatgcagcacaagatcatcacgctgtcggaagaatgggtctctgataaagctctgccggagatgggcttcacgcttggcactgtcaacgagctctcagatccagatacctatcttcttctcgcgattgatgaggaagagcatctgcacggtgtgaccagttggttgccggtctatgaaaaaggacgcatcgtcggctacacacttgatgtgatgcgccgtgatccgcaaggctttaaatctgtcatcgagtttctcatttccgaggccgtcgttatcgcaagggatcacgatctggaatggatgtcgatgtccggcgctcctttgagtacgcccccaggtgtggccgacgacggcaccatcggacaaattttggagcttttgggccgagcaatggagccgttctacggtttccgttccctcgctgcgtccaagaacaaattccacccagaacaccacggttggtacttgtgttaccgcgatgaattatcgttaccaagcattggccttgccgttgctgcctgctacctcaacgagtttccgctgccgaattggctgaaaaagaccgccacttccgccccaagccacagctagaaaaacgcgtaaccttggtg

SEQ ID NO: 358 - protein, 824 aa, Corynebacterium glutamicum
LLFGLRWLGRSLRFAPLSLLMIVVMRGLREVFGAEDPANSSLVDNLGLTLPWSLNDPHFLTAGFSASTTTAALMSTLWIIVFAVPSERILGSLKFAITAALIHITSIPLGIGIAHLIEEADLNRWGNNMLADVLLTPDFWVFGVAAFASASMPLLWRRRTRLFLFTITLTLLLYTGTLADVTMLTATIIGTVAGELNRHRKTPGGRWLPGSLTVREARIMTAILVTAVAAGPVLAALNPLTHGPFSSATKLIWQPLVTEEHMHHLCHTDSTSDACQGALDQLQQHGVGPSVANLIPLILTVVLAMGLSRGRRLAWILAVLAQLISIAVLMFQLTKLSADSTDLLWSVNAFSVIVPWLVALAVLVFSRRAFQVKIDTTRISKSLGALMVTWLATAALWILATLFLPHAFHPHPTLGLAFKELPFRYLPPTIETVLSHQLFPRSPAGWAVFEWTGTLFWLVVAATLYHLLMGVPSNKAHEDQENAATLLRSGSGDHLSWMTIWGGNTYWWAPENAGYVAYRVKRGIAITLGEPILGPDSSVSKAELAAQFEEFASNQGWIVAWYSVCEEFSKERINAGHHTLRVAEEAVLSSANADFKGKHFQNVRTARNRAAKEGVSSIWTTWADLSAEMQHKIITLSEEWVSDKALPEMGFTLGTVNELSDPDTYLLLAIDEEEHLHGVTSWLPVYEKGRIVGYTLDVMRRDPQGFKSVIEFLISEAVVIARDHDLEWMSMSGAPLSTPPGVADDGTIGQILELLGRAMEPFYGFRSLAASKNKFHPEHHGWYLCYRDELSLPSIGLAVAACYLNEFPLPNWLKKTATSAPSHS

SEQ ID NO: 359 - DNA, 386 bp, Corynebacterium glutamicum
  CDS (1)..(363): RXN00738
tgtcaagaggagacggatggcttttttgattttgggcgcgatatgcggcccggtgagcgccggtcgtatggcactttgcttaacgacgccacgacgcaggtgtcgcacatcctcggcaatgccttcacccgatctgggctcaacgctgagtacgcgaatctttatggtcaggcgttggtgggcatggtgtcgatgacggcgcaatggtggttggatgagcgcactccgccgaaggaagaagttgccgcacatattgttaatctttgttggaatggtttgacggggatggaagccgatccgaagttaactcccatcagttctgctgagggtgcgatttttggtcaagaaaaggagagtgaagcgtgacacctatgctcgcggggctg

SEQ ID NO: 360 - protein, 121 aa, Corynebacterium glutamicum
CQEETDGFFDFGRDMRPGERRSYGTLLNDATTQVSHILGNAFTRSGLNAEYANLYGQALVGMVSMTAQWWLDERTPPKEEVAAHIVNLCWNGLTGMEADPKLTPISSAEGAIFGQEKESEA

SEQ ID NO: 361 - DNA, 388 bp, Corynebacterium glutamicum
  CDS (78)..(365): FRXA00738
catgcccctattagacggatggcttttttgattttgggcgcgatatgcggcccggtgagcgccggtcgtatggcactttgcttaacgacgccacgacgcaggtgtcgcacatcctcggcaatgccttcacccgatctgggctcaacgctgagtacgcgaatctttatggtcaggcgttggtgggcatggtgtcgatgacggcgcaatggtggttggatgagcgcactccgccgaaggaagaagttgccgcacatattgttaatctttgttggaatggtttgacggggatggaagccgatccgaagttaactcccatcagttctgctgagggtgcgatttttggtcaagaaaaggagagtgaagcgtgacacctatgctcgcggggctg

SEQ ID NO: 362 - protein, 96 aa, Corynebacterium glutamicum
LLNDATTQVSHILGNAFTRSGLNAEYANLYGQALVGMVSMTAQWWLDERTPPKEEVAAHIVNLCWNGLTGMEADPKLTPISSAEGAIFGQEKESEA

SEQ ID NO: 363 - DNA, 561 bp, Corynebacterium glutamicum
  CDS (101)..(538): RXN00750
tttaaacaaaagcgataacaatgaaccgatggtgtctacgacagaaccgactcccccacccactaacaccccaccagaaaataacacctcgaccgaacctatggactggtcgatcattattaatgtgcttgccgttgctactgtcgtgatactcacccttatcatcgcagctgcattatataggggtttcacacgcaacaaaataaaaaaacttgaagctatacgagaagcccagcaacacgaacgcgacaatcccactatccgcattgctgatcttcgcggcatcatggatactcaccactacatctacaccgacgtcatggttacacgtgcacatgaactcatgattactgcacccgcattctttgatgtcactctccccgaagcagtgctctacgaagatactaaacgtgctgctcatgatgcccttaacggctataaagacaccactgtcgctagtgcagagaagatcatgcttgtagatgcagtcaccgcagcatggactctctattccacaaaagcaaacaccggatccacgtgatccgagagccgagtaccgct

SEQ ID NO: 364 - protein, 146 aa, Corynebacterium glutamicum
MDWSIIINVLAVATVVILTLIIAAALYRGFTRNKIKKLEAIREAQQHERDNPTIRIADLRGIMDTHHYIYTDVMVTRAHELMITAPAFFDVTLPEAVLYEDTKRAAHDALNGYKDTTVASAEKIMLVDAVTAAWTLYSTKANTGST

SEQ ID NO: 365 - DNA, 561 bp, Corynebacterium glutamicum; identical to SEQ ID NO: 363
  CDS (101)..(538): FRXA00750

SEQ ID NO: 366 - protein, 146 aa, Corynebacterium glutamicum; identical to SEQ ID NO: 364

SEQ ID NO: 367 - DNA, 999 bp, Corynebacterium glutamicum
  CDS (101)..(976): RXN00762
gatgctgcgatggtcacaagtcgttttctggatttttccacatctatatctttaccccacgttcctgcaagagattcaaacttggggctaacctggggacatgaatacttccgatcgtattaaaagcactcaaatcgcgctggatcgtgacctccgtgagcaggcactattgcttttgaaggaggttcgcgcagttgatggcgtggatgctttatcagaacaatttgtccgtgggcttgcagaacccggacttgttcactcccatttaatagtcacgctcaatagcgagctggttggcctcgcggccgcggatgaggaaaccacggaactggctgtccacccggcgcacaggcgtcagggaatcggtaaggcgcttatcgacgccgcccccacctcatcaatctgggcgcatggaaatacagcaggtgcacaagcgttggcatccaccctgcgtatgaagaagactcgcgagcttctggtgatggagatttccgacagggcgctcgatgactctgcagcatacaaagatccagatggaattacacacagtagtttggcgaatgcccctgtggagaaatcagtagctgaggctaaatggcttcaatccaacaacgaagcattcgactggcatcccgagcagggcggatggacaactcatcggttggcgcaggctcagaaagccgattggtacaaggactctgacgtgttattcctctgggacggcgaagagatcgttggcttccactgggtaaagcagcacagtccagaattacaagagatttacgtagttggcctttcttcagcctaccgtggtcgcggcttgggagatccgcttgttcgcctcggactgcatcacatgagggctcatggtgctcgaaaagtgattctttatgtggaagctggcaacactccggcagtcgcggcatacgaaaaactgggattcactgtcgcggaaagccacgtagtttacgaaaagtaaaaaagagacttgctaaaaac

SEQ ID NO: 368 - protein, 292 aa, Corynebacterium glutamicum
MNTSDRIKSTQIALDRDLREQALLLLKEVRAVDGVDALSEQFVRGLAEPGLVHSHLIVTLNSELVGLAAADEETTELAVHPAHRRQGIGKALIDAAPTSSIWAHGNTAGAQALASTLRMKKTRELLVMEISDRALDDSAAYKDPDGITHSSLANAPVEKSVAEAKWLQSNNEAFDWHPEQGGWTTHRLAQAQKADWYKDSDVLFLWDGEEIVGFHWVKQHSPELQEIYVVGLSSAYRGRGLGDPLVRLGLHHMRAHGARKVILYVEAGNTPAVAAYEKLGFTVAESHVVYEK

SEQ ID NO: 369 - DNA, 1242 bp, Corynebacterium glutamicum
  CDS (101)..(1219): RXN00768
tcaagcgccataacgcctgattatgcacggttaaggcgcatctcgctcactggtgctaaccacttgcgcttttggaaggaataacccttcctgtcagattgtgggtactatcgaagacgtggctaacgaacaaatcgaggtcgcgaacaacactgatcagattcctgcaggatacaagtcccctcttctttctagaagtggtgcggcagaagcgcagggcgctgctgctcaagcaggtactgaaggtgtcgcgtggcattacggttcccctctcgtcgagcaacgcatcttcgaaactggcacgggcttagttgaccgttctaatcgcaaggtgatcaaagtcgaagggcctgatgcccccacgttcctcaataatattttgtcccaaaaggttgattccgttgaaaacggctttactgccggtgccctggatttggatgcgcagggtcgtattcaacacacaatgcaggtaactgtcgtcgatggggttttctacctcgacacgtccgcggcggagtttgataccctcatcggtttcttgaccaagatgattttctggtcggaagtcaccgtccaggaagccgatctggcgatcatcactctgctcggccaggaaattgcccttccggacgcggtctttgcccgtagggtcgattggaatgggccatcgcgtatcgacgtcgccatccggcgtgaaaacctggaggagggcgtcgacaagctcttagaagctggcgcaaagctcaccggtctcatggcttacacggccgagcgcgtgaaggcgttggagcccgctgcgggcgtggatttggatgataagaccattccccatgaaatcccccattggattggccgtggcgaacatttaggcgctgtgcatttgaccaagggttgctaccgcgggcaggaaactgtcgcgcgcgttgataatcttgggcgttccccgcgcgtgctggttctgcttcatcttgacggttccgcaccgctggatcctgtgactggcgctgaaatcaaggccggtgcgcgcaccgttggtcgtctgggcaccgttgtccatgacgccgattacgggccgatcgctctcgggctggttaagcgcagcgctttggataaagaacttcacatcgatgatgtctctgtaaacgtcgaccgcgatctgcttcctgcggaggaaagtgaacaacgcggacgcgcagcgatcaataagctcaagggtctttaactaaaacgatttatagcgaa

SEQ ID NO: 370 - protein, 373 aa, Corynebacterium glutamicum
VGTIEDVANEQIEVANNTDQIPAGYKSPLLSRSGAAEAQGAAAQAGTEGVAWHYGSPLVEQRIFETGTGLVDRSNRKVIKVEGPDAPTFLNNILSQKVDSVENGFTAGALDLDAQGRIQHTMQVTVVDGVFYLDTSAAEFDTLIGFLTKMIFWSEVTVQEADLAIITLLGQEIALPDAVFARRVDWNGPSRIDVAIRRENLEEGVDKLLEAGAKLTGLMAYTAERVKALEPAAGVDLDDKTIPHEIPHWIGRGEHLGAVHLTKGCYRGQETVARVDNLGRSPRVLVLLHLDGSAPLDPVTGAEIKAGARTVGRLGTVVHDADYGPIALGLVKRSALDKELHIDDVSVNVDRDLLPAEESEQRGRAAINKLKGL

SEQ ID NO: 371 - DNA, 567 bp, Corynebacterium glutamicum
  CDS (101)..(544): FRXA00768
gacgtcgccatccggcgtgaaaacctggaggagggcgtcgacaagctcttagaagctggcgcaaagctcaccggtctcatggcttacacggcccgagcgcgtgaaggcgttggagcccgctgcgggcgtggatttggatgataagaccattccccatgaaatcccccattggattggccgtggcgaacatttaggcgctgtgcatttgaccaagggttgctaccgcgggcaggaaactgtcgcgcgcgttgataatcttgggcgttccccgcgcgtgctggttctgcttcatcttgacggttccgcaccgctggatcctgtgactggcgctgaaatcaaggccggtgcgcgcaccgttggtcgtctgggcaccgttgtccatgacgccgattacgggccgatcgctctcgggctggttaagcgcagcgctttggataaagaacttcacatcgatgatgtctctgtaaacgtcgaccgcgatctgcttcctgcggaggaaagtgaacaacgcggacgcgcagcgatcaataagctcaagggtctttaactaaaacgatttatagcgaa

SEQ ID NO: 372 - protein, 148 aa, Corynebacterium glutamicum
VKALEPAAGVDLDDKTIPHEIPHWIGRGEHLGAVHLTKGCYRGQETVARVDNLGRSPRVLVLLHLDGSAPLDPVTGAEIKAGARTVGRLGTVVHDADYGPIALGLVKRSALDKELHIDDVSVNVDRDLLPAEESEQRGRAAINKLKGL

SEQ ID NO: 373 - DNA, 837 bp, Corynebacterium glutamicum
  CDS (101)..(814): FRXA00767
tcaagcgccataacgcctgattatgcacggttaaggcgcatctcgctcactggtgctaaccacttgcgcttttggaaggaataacccttcctgtcagattgtgggtactatcgaagacgtggctaacgaacaaatcgaggtcgcgaacaacactgatcagattcctgcaggatacaagtcccctcttctttctagaagtggtgcggcagaagcgcagggcgctgctgctcaagcaggtactgaaggtgtcgcgtggcattacggttcccctctcgtcgagcaacgcatcttcgaaactggcacgggcttagttgaccgttctaatcgcaaggtgatcaaagtcgaagggcctgatgcccccacgttcctcaataatattttgtcccaaaaggttgattccgttgaaaacggctttactgccggtgccctggatttggatgcgcagggtcgtattcaacacacaatgcaggtaactgtcgtcgatggggttttctacctcgacacgtccgcggcggagtttgataccctcatcggtttcttgaccaagatgattttctggtcggaagtcaccgtccaggaagccgatctggcgatcatcactctgctcggccaggaaattgcccttccggacgcggtctttgcccgtagggtcgattggaatgggccatcgcgtatcgacgtcgccatccggcgtgaaaacctggaggagggcgtcgacaagctcttagaagctggcgcaaagctcaccggtctcatggcttacacggcccgagcgcgtgaaggcgttggagcccgctgcgggcgtggatttggatgataagaccattccccatgaaa

SEQ ID NO: 374 - protein, 238 aa, Corynebacterium glutamicum
VGTIEDVANEQIEVANNTDQIPAGYKSPLLSRSGAAEAQGAAAQAGTEGVAWHYGSPLVEQRIFETGTGLVDRSNRKVIKVEGPDAPTFLNNILSQKVDSVENGFTAGALDLDAQGRIQHTMQVTVVDGVFYLDTSAAEFDTLIGFLTKMIFWSEVTVQEADLAIITLLGQEIALPDAVFARRVDWNGPSRIDVAIRRENLEEGVDKLLEAGAKLTGLMAYTARAREGVGARCGRGFG

SEQ ID NO: 375 - DNA, 336 bp, Corynebacterium glutamicum
  CDS (101)..(313): RXN00769
ggctattgtgtctatcaggaatacagttaatacatcttgaaaagcccatgggccatccgaattcccaggatcggcccgctcactccaagggggtcaggcaatgggtcgcggtcgcgcgaaggcaaaacagaccaaagttgctcgccagttgaagtacagctctccagacatggatctcgattcgctgcagcgggagctggctaaccagtctcctaggcgttcctactccgatacccctgatgatgaggaccagtacgcagagtatgcggactgggatgaggacgacaccgacaatcgtgcctacggcacaaactgatttcgtgtgtccttaactct

SEQ ID NO: 376 - protein, 71 aa, Corynebacterium glutamicum
MGRGRAKAKQTKVARQLKYSSPDMDLDSLQRELANQSPRRSYSDTPDDEDQYAEYADWDEDDTDNRAYGTN

SEQ ID NO: 377 - DNA, 336 bp, Corynebacterium glutamicum; identical to SEQ ID NO: 375
  CDS (101)..(313): FRXA00769

SEQ ID NO: 378 - protein, 71 aa, Corynebacterium glutamicum; identical to SEQ ID NO: 376

SEQ ID NO: 379 - DNA, 942 bp, Corynebacterium glutamicum
  CDS (101)..(919): RXN00771
tacccctgttttggagaatgctccgagccaggggtacttttcttttcctcacacacagtagctgctgagaaaaatgaagaccttttgttaggttgggagtatgaccaacccatacgaggccttcataccgctcaagcatcgtacggggattgaacccgagcacaccttttgggaatgggaaaacaaaagggttcacattgcaaggagacgtcgagaagcgcccgtccgcgttatcgtggtgcatgggctaggcacccatagtggcgccctctggcccctcgtcgcggccattgagggcgcggacctcgccgcgatcgacctgcctaaaactccgctttacgacgattggctgcgccttttagaatctttcatctcgtccgaagacgacggtcggccactcatcctgatcggtgcaggcaccggaggcttgctttgcgcagaagctgcacaccgcacaggactggtcgcacacgtcattgccacctgcctgctcaacccctccgaccagccgacgcgccgggcactgttcaggttttcaccgctgactcggttgatccaaggccgcttgcgcaaccgcgaaattcccgtgaccagagtgttgaacttcagcaaaatcagccgcagcccagccctgagcaaattgtgcgcggccgatgaatttagcggagcatccaaaataacctggggtttcctcgcgtcatatgtgcaacacaaggccaaactgggtgcagttcccgtcactctgatgcaccctgaccacgaccttctgactcccgttgagctcagtctgcgtacgctttcgcgcctcaaagcgcccactgacgtggttatgctcaaggactgcgggcattttcccatcgaagaacccggcttcaccaccatgctcgaaaccgtcacatcagttatcgcgcggaatagttagcgggcgcatgtggttgggat

SEQ ID NO: 380 - protein, 273 aa, Corynebacterium glutamicum
MTNPYEAFIPLKHRTGIEPEHTFWEWENKRVHIARRRREAPVRVIVVHGLGTHSGALWPLVAAIEGADLAAIDLPKTPLYDDWLRLLESFISSEDDGRPLILIGAGTGGLLCAEAAHRTGLVAHVIATCLLNPSDQPTRRALFRFSPLTRLIQGRLRNREIPVTRVLNFSKISRSPALSKLCAADEFSGASKITWGFLASYVQHKAKLGAVPVTLMHPDHDLLTPVELSLRTLSRLKAPTDVVMLKDCGHFPIEEPGFTTMLETVTSVIARNS

SEQ ID NO: 381 - DNA, 801 bp, Corynebacterium glutamicum
  CDS (101)..(778): FRXA00771
tacccctgttttggagaatgctccgagccaggggtacttttcttttcctcacacacagtagctgctgagaaaaatgaagaccttttgttaggttgggagtatgaccaacccatacgaggccttcataccgctcaagcatcgtacggggattgaacccgagcacaccttttgggaatgggaaaacaaaagggttcacattgcaaggagacgtcgagaagcgcccgtccgcgttatcgtggtgcatgggctaggcacccatagtggcgccctctggcccctcgtcgcggccattgagggcgcggacctcgccgcgatcgacctgcctaaaactccgctttacgacgattggctgcgccttttagaatctttcatctcgtccgaagacgacggtcggccactcatcctgatcggtgcaggcaccggaggcttgctttgcgcagaagctgcacaccgcacaggactggtcgcacacgtcattgccacctgcctgctcaacccctccgaccagccgacgcgccgggcactgttcaggttttcaccgctgactcggttgatccaaggccgcttgcgcaaccgcgaaattcccgtgaccagagtgttgaacttcagcaaaatcagccgcagcccagccctgagcaaattgtgcgcggccgatgaatttaacggagcattcaaaataacctggggtttcctcgcgtcatatgtgcaacacaaggccaaactgggtgcagttcccctcactctgatgcaccctgaccacgacctttttgactcccgttgagctcaaatctgcgtacgctt

SEQ ID NO: 382 - protein, 226 aa, Corynebacterium glutamicum
MTNPYEAFIPLKHRTGIEPEHTFWEWENKRVHIARRRREAPVRVIVVHGLGTHSGALWPLVAAIEGADLAAIDLPKTPLYDDWLRLLESFISSEDDGRPLILIGAGTGGLLCAEAAHRTGLVAHVIATCLLNPSDQPTRRALFRFSPLTRLIQGRLRNREIPVTRVLNFSKISRSPALSKLCAADEFNGAFKITWGFLASYVQHKAKLGAVPLTLMHPDHDLFDSR

SEQ ID NO: 383 - DNA, 680 bp, Corynebacterium glutamicum
  CDS (1)..(657): RXN00785
atcatcgctactctcggtgtgaccttgctggttgaggcccgcggattattcttgacggttgcgtccattcccattctgtttggtattttcacaccactgacttcgtggtttgtgtcccaacaaggcgtggctgcgaatgtgtcccctggtgtttccgtcacggaaatcctcacggctgtttatcctttggcgcagttgttccccaccctgatcatggtcactttggtggcggcattgatcgctgtggtgcggattattctgctgcgcaggaaccaggaatctcgtcaggtttctggggaacttacccggcgcgcgcagcgtgaggctgaggaagctaatcagaatgctgctcgtcgtgctcgcgcacagagcacgagggtacaaagttctaaaacacgtaaccgtcgcgcgcaaccaaccggcgataccggttcacaagtcacggttgatgagttgatcaggcgtagccaggagcgccggcaaactgttgcgcagcgccaaactgagcgcggtgtgccgtttactccaactccgggtcctgtggtggcccccaagccgcgcccgagcgcccctgaggcgccggctcctacggatgtgggtgagcgtcgacaagcagcccctaaacgccgcacctcgctcgacgatgatctgtacagctaaaaaatccccgctcatgtggc

SEQ ID NO: 384 - protein, 219 aa, Corynebacterium glutamicum
IIATLGVTLLVEARGLFLTVASIPILFGIFTPLTSWFVSQQGVAANVSPGVSVTEILTAVYPLAQLFPTLIMVTLVAALIAVVRIILLRRNQESRQVSGELTRRAQREAEEANQNAARRARAQSTRVQSSKTRNRRAQPTGDTGSQVTVDELIRRSQERRQTVAQRQTERGVPFTPTPGPVVAPKPRPSAPEAPAPTDVGERRQAAPKRRTSLDDDLYS

SEQ ID NO: 385 - DNA, 621 bp, Corynebacterium glutamicum
  CDS (1)..(621): FRXA00785
atcatcgctactctcggtgtgaccttgctggttgaggcccgcggattattcttgacggttgcgtccattcccattctgtttggtattttcacaccactgacttcgtggtttgtgtcccaacaaggcgtggctgcgaatgtgtcccctggtgtttccgtcacggaaatcctcacggctgtttatcctttggcgcagttgttccccaccctgatcatggtcactttggtggcggcattgatcgctgtggtgcggattattctgctgcgcaggaaccaggaatctcgtcaggtttctggggaacttacccggcgcgcgcagcgtgaggctgaggaagctaatcagaatgctgctcgtcgtgctcgcgcacagagcacgagggtacaaagttctaaaacacgtaaccgtcgcgcgcaaccaaccggcgataccggttcacaagtcacggttgatgagttgatcaggcgtagccaggagcgccggcaaactgttgcgcagcgccaaactgagcgcggtgtgccgtttactccaactccgggtcctgtggtggcccccaagccgcgcccgagcgcccctgaggcgccggctcctacggatgtgggtgagcgtcgacaagcagcccct

SEQ ID NO: 386 - protein, 207 aa, Corynebacterium glutamicum
IIATLGVTLLVEARGLFLTVASIPILFGIFTPLTSWFVSQQGVAANVSPGVSVTEILTAVYPLAQLFPTLIMVTLVAALIAVVRIILLRRNQESRQVSGELTRRAQREAEEANQNAARRARAQSTRVQSSKTRNRRAQPTGDTGSQVTVDELIRRSQERRQTVAQRQTERGVPFTPTPGPVVAPKPRPSAPEAPAPTDVGERRQAAP

SEQ ID NO: 387 - DNA, 651 bp, Corynebacterium glutamicum
  CDS (101)..(628): RXN00795
tttggattctggacacccaaaagggggtttcgtaccaaactcgtgacatactaggcgggtggctgagaaacgaccgaaaatttttgatggcagtcgagacatgattatctcgttggtagtctccgcgatcatcatgttggtagcggtgggattcacgggaatgtgttctttcaatacaggatcccctgaaaatgggcaggtacctgaagttgatgcttccacttttatgtcaatggaagcgcgcgcaatgactgatcatgcaactaggttgccggaaactcctgaaggctggaccacaaattcagctcgacgcaccatggtggatgacaccccggcatctgtagttggatatgtcaccgcagatgagggctatattcagctcactcaaactggtgaaaccgttgaggatgctgtggctggttatgatactcgctggcgtgatctttctgagtcttatgatcttgatggccacgacgtgggaatttacacctcacaggaatctgatgtgcgtgatctgcgtgtgatggatctgggcgatgcccgcgtcatggtctcgggtgctgctaccgatgaagaattcaatgatctgcttcgcgcagttgcgaattcggagccactgcctaccaattaagaattggtcgaaccaccaaa

SEQ ID NO: 388 - protein, 176 aa, Corynebacterium glutamicum
MIISLVVSAIIMLVAVGFTGMCSFNTGSPENGQVPEVDASTFMSMEARAMTDHATRLPETPEGWTTNSARRTMVDDTPASVVGYVTADEGYIQLTQTGETVEDAVAGYDTRWRDLSESYDLDGHDVGIYTSQESDVRDLRVMDLGDARVMVSGAATDEEFNDLLRAVANSEPLPTN

SEQ ID NO: 389 - DNA, 651 bp, Corynebacterium glutamicum; identical to SEQ ID NO: 387
  CDS (101)..(628): FRXA00795

SEQ ID NO: 390 - protein, 176 aa, Corynebacterium glutamicum; identical to SEQ ID NO: 388

SEQ ID NO: 391 - DNA, 825 bp, Corynebacterium glutamicum
  CDS (101)..(802): RXN00831
agctccaagaaagtcagtgctgtgcatggctcggtgctgctcatgcttttcggtgtttacatgatgagcatgttcgcctgatttaggtagcctggtgggaatgagtgcacttgagacattgcaatggcaggactggtcaagcgtcttaattgtggtagctcacccagatgatccggagtatgggctttccgcggctgttaaagaatggacagacgccggggtggaggtgtcttacctgctgctcacccacggggaggcaggtatccaaggtttagaccctaaagaaaccgggtcattgcgcgcagcggaacagcgggctgcatgtgatgtggtaggagttagaaatctcaccattttgaatcacccagattccatgttggtgtacaatctggtactgcgcaaagatattgctcgggaaatccggatccgtaaaccaaatgctgtggtggtatccaattttgatgtagaggcctacggtggtttgaaccaggcggatcaccgcgtggcgggattagccgcaattgatgcgacccgcgatgccgctaatccgtgggcgcagccagagctgttgcaggaggatctgcagccgtggggagctgaagtcatcatcattgccggacacccagagcccacccacaccatggatctggctaaagattctgttgatgccggagttgcatcccttcaagctcacaaggaatacttggccgctcttccagatcccccgaagccggaggagttcattccggcgtttctcgaggtagagggcggttacgcagcggccttccgagttttcggacggtaagcagggcgatacgtgatagg

SEQ ID NO: 392 - protein, 234 aa, Corynebacterium glutamicum
MSALETLQWQDWSSVLIVVAHPDDPEYGLSAAVKEWTDAGVEVSYLLLTHGEAGIQGLDPKETGSLRAAEQRAACDVVGVRNLTILNHPDSMLVYNLVLRKDIAREIRIRKPNAVVVSNFDVEAYGGLNQADHRVAGLAAIDATRDAANPWAQPELLQEDLQPWGAEVIIIAGHPEPTHTMDLAKDSVDAGVASLQAHKEYLAALPDPPKPEEFIPAFLEVEGGYAAAFRVFGR

SEQ ID NO: 393 - DNA, 825 bp, Corynebacterium glutamicum; identical to SEQ ID NO: 391
  CDS (101)..(802): FRXA00831

SEQ ID NO: 394 - protein, 234 aa, Corynebacterium glutamicum; identical to SEQ ID NO: 392

SEQ ID NO: 395 - DNA, 1077 bp, Corynebacterium glutamicum
  CDS (101)..(1054): RXN00835
actgcaccagcgccaacgatcgcaattttcatacctgctatcttgcctgagcacagataagatttgtaagcactaccccttctctacaaaggagtcatcaatggccggtggattggcagcactattagacgatgtcgcagcaattactcgagcggctgcagccagcctcgatgatgtcacggcgatggctggaaaaaccagcgttaaagccgcaggcgtggttgtagatgacacggcagttaccccgcaatatgttcaaggtgtcaaacctgcacgcgaactgcccatgatttggcggatcgctaagggctctttggtaaacaagatcatcatcattttgcccatcgcgttgcttctttccgcgtttgctccgtgggctctcacaccaattttgatgctgggcggctcctacctgtgcttcgaaggtgcagaaaagatctggcactccctccacaggcgcatcaaaggtgaacagcacagcaccgaacccaagtcgcaggaaagcccaaagtcagaggatcagctggtcaaaagtgccatcacaactgacctcatcctttccgcagagatcatggttatttcactcaatcagattgcagatcaaactatctggatgcaggctgcggttcttttcgtcgtaggtattggcatcaccgcgctcgtgtacggcgtagtcggtgttcttgtgaaaatggatgacgtcggacttacactttcaaagcgtgactccgcaggtatccagaaatttggccgcggcttggtcaaagcgatgcccatcgttcttcaagttatttctgttgtcggcgtttttgccatgctgtgggttggtggccacatcatggtcgttggaactgaagagttaggatgggaacttccctaccaccttgttcacggactagagtcctgggctaacggtatcggaggcagtgctctgggatgggttggcaatactttcgggtcacttgtgttcggcctcatttggggcgcgattatcaccgttgtggtcagtgtgatcaagaagttcattccacagcgtgcgcaaaactcgtctcattagtggagagttgttcgctgtaa

SEQ ID NO: 396 - protein, 318 aa, Corynebacterium glutamicum
MAGGLAALLDDVAAITRAAAASLDDVTAMAGKTSVKAAGVVVDDTAVTPQYVQGVKPARELPMIWRIAKGSLVNKIIIILPIALLLSAFAPWALTPILMLGGSYLCFEGAEKIWHSLHRRIKGEQHSTEPKSQESPKSEDQLVKSAITTDLILSAEIMVISLNQIADQTIWMQAAVLFVVGIGITALVYGVVGVLVKMDDVGLTLSKRDSAGIQKFGRGLVKAMPIVLQVISVVGVFAMLWVGGHIMVVGTEELGWELPYHLVHGLESWANGIGGSALGWVGNTFGSLVFGLIWGAIITVVVSVIKKFIPQRAQNSSH

SEQ ID NO: 397 - DNA, 713 bp, Corynebacterium glutamicum
  CDS (1)..(690): FRXA00835
tttgctccgtgggctctcacaccaattttgatgctgggcggctcctacctgtgcttcgaaggtgcagaaaagatctggcactccctccacaggcgcatcaaaggtgaacagcacagcaccgaacccaagtcgcaggaaagcccaaagtcagaggatcagctggtcaaaagtgccatcacaactgacctcatcctttccgcagagatcatggttatttcactcaatcagattgcagatcaaactatctggatgcaggctgcggttcttttcgtcgtaggtattggcatcaccgcgctcgtgtacggcgtagtcggtgttcttgtgaaaatggatgacgtcggacttacactttcaaagcgtgactccgcaggtatccagaaatttggccgcggcttggtcaaagcgatgcccatcgttcttcaagttatttctgttgtcggcgtttttgccatgctgtgggttggtggccacatcatggtcgttggaactgaagagttaggatgggaacttccctaccaccttgttcacggactagagtcctgggctaacggtatcggaggcagtgctctgggatgggttggcaatactttcgggtcacttgtgttcggcctcatttggggcgcgattatcaccgttgtggtcagtgtgatcaagaagttcattccacagcgtgcgcaaaactcgtctcattagtggagagttgttcgctgtaa

SEQ ID NO: 398 - protein, 230 aa, Corynebacterium glutamicum
FAPWALTPILMLGGSYLCFEGAEKIWHSLHRRIKGEQHSTEPKSQESPKSEDQLVKSAITTDLILSAEIMVISLNQIADQTIWMQAAVLFVVGIGITALVYGVVGVLVKMDDVGLTLSKRDSAGIQKFGRGLVKAMPIVLQVISVVGVFAMLWVGGHIMVVGTEELGWELPYHLVHGLESWANGIGGSALGWVGNTFGSLVFGLIWGAIITVVVSVIKKFIPQRAQNSSH

SEQ ID NO: 399 - DNA, 1816 bp, Corynebacterium glutamicum
  CDS (101)..(1816): RXN00836
ggagagttgttcgctgtaatttcgctgtacagttaatatgactttttactgtctcaatcaattcacaagtttgcacgaaatttaaggaaaggagtgcccaatgtatacccattcaacaggcactcctcagcttgatttcgacggtgacatctatccccttcacctcttcttctctgcacagactgcccaacatttcgctctcgagcgcgtcaattggcatgtcttacgcgctattgtgaaacctgagcaaggcgaactcatcgtcgaagcgcttctcgcaccaatagaatccgcaacaaaaatcggtgtttgggttcaagatgaatttctcggggtgattgcagagtcccagttcctgttgaattctcaattgtctcgaatttttgcctctggccacctgatttccagccaactacttctcacaccgagtaaaggatctctcgcttcagttcttcttccaaacctaaaattcgggctcatcagcaatgatcctccacgagctgattcccacctcttaccgctaggcagaatgtggcgcgttgagcccaccgttcatgctctgtttgaggatttctcacttggctccacgattctttttgggctgaggcttgatttagaagccctaattgtctcctataacggaatagaatgtggcatcttaaactttgatgacgcctcagcactaagctctgctgtgaaattctcaaatgcaaatggtctcacccccacggtgctcggccacgtagtccgggagaacggtgaaacatccttcgagattgacgttctcccactggagttgtggtcgaagaagcagcatcgccttgaggttttaaaaatccctcggttgatacctaaagaggcagattcccaaaattatgtgaaggcgacagcgctcctttcagacgagattctgcgaccacaaacgctgtccaaaaaggcactgtctttgtcggacaccgcagttaagtacagccctcatgttgcttgtggcgtggggatgtttagtcttttcgccgttattccctttgacaagttgagtgatcatagtgcgatgctgctcgcagtcattagcttgatgctttttgtgctggcattagtaattcttttcaagagaattcagtcaactaatactcagcgttggaacttggcctcgtcagtcggattactcgcgacacttccgattatcatattcctggttgctgatacattgattcctcagggcagcctggaaaaccatgctcaacccgacgtacaggtaacaacgttagctaacaggcggccaagttcacctacctcactggactcactaggcgcactgaattcaccaagttcgccgaattccccgagctcatcaatgctgcaaaactctgaaatgttcgcctcaccaccgatcgcctctgggcagtcaccggtttcgacgttccgctcatggctagatcgatccattctgccactcacacgagaaaattccgcttcagaaagcgcagtgacagctcttggaccgtcgatagtgcagcctgcatctgaatcgattacaactccagctcaaacgtcgcaaagtcgccacgcaattgacgatggtgacgacagtaaaacctcaacgggaagaccagctcccactactaactcgccgatcattgctcttcccccaacgtggattatcgggccggaagatccagaatccaccgaccctacagcaccaaccgagcccaccgagccaagcgaacctgtcgcaaccgacgaaccctcagagacctctgaacaaacttcacctctcttagctcgcgacacccccgaactgaaccggaaacaactg

SEQ ID NO: 400 - protein, 572 aa, Corynebacterium glutamicum
MYTHSTGTPQLDFDGDIYPLHLFFSAQTAQHFALERVNWHVLRAIVKPEQGELIVEALLAPIESATKIGVWVQDEFLGVIAESQFLLNSQLSRIFASGHLISSQLLLTPSKGSLASVLLPNLKFGLISNDPPRADSHLLPLGRMWRVEPTVHALFEDFSLGSTILFGLRLDLEALIVSYNGIECGILNFDDASALSSAVKFSNANGLTPTVLGHVVRENGETSFEIDVLPLELWSKKQHRLEVLKIPRLIPKEADSQNYVKATALLSDEILRPQTLSKKALSLSDTAVKYSPHVACGVGMFSLFAVIPFDKLSDHSAMLLAVISLMLFVLALVILFKRIQSTNTQRWNLASSVGLLATLPIIIFLVADTLIPQGSLENHAQPDVQVTTLANRRPSSPTSLDSLGALNSPSSPNSPSSSMLQNSEMFASPPIASGQSPVSTFRSWLDRSILPLTRENSASESAVTALGPSIVQPASESITTPAQTSQSRHAIDDGDDSKTSTGRPAPTTNSPIIALPPTWIIGPEDPESTDPTAPTEPTEPSEPVATDEPSETSEQTSPLLARDTPELNRKQL

SEQ ID NO: 401 - DNA, 1771 bp, Corynebacterium glutamicum
  CDS (101)..(1771): FRXA00836
ggagagttgttcgctgtaatttcgctgtacagttaatatgactttttactgtctcaatcaattcacaagtttgcacgaaatttaaggaaaggagtgcccaatgtatacccattcaacaggcactcctcagcttgatttcgacggtgacatctatccccttcacctcttcttctctgcacagactgcccaacatttcgctctcgagcgcgtcaattggcatgtcttacgcgctattgtgaaacctgagcaaggcgaactcatcgtcgaagcgcttctcgcaccaatagaatccgcaacaaaaatcggtgtttgggttcaagatgaatttctcggggtgattgcagagtcccagttcctgttgaattctcaattgtctcgaatttttgcctctggccacctgatttccagccaactacttctcacaccgagtaaaggatctctcgcttcagttcttcttccaaacctaaaattcgggctcatcagcaatgatcctccacgagctgattcccacctcttaccgctaggcagaatgtggcgcgttgagcccaccgttcatgctctgtttgaggatttctcacttggctccacgattctttttgggctgaggcttgatttagaagccctaattgtctcctataacggaatagaatgtggcatcttaaactttgatgacgcctcagcactaagctctgctgtgaaattctcaaatgcaaatggtctcacccccacggtgctcggccacgtagtccgggagaacggtgaaacatccttcgagattgacgttctcccactggagttgtggtcgaagaagcagcatcgccttgaggttttaaaaatccctcggttgatacctaaagaggcagattcccaaaattatgtgaaggcgacagcgctcctttcagacgagattctgcgaccacaaacgctgtccaaaaaggcactgtctttgtcggacaccgcagttaagtacagccctcatgttgcttgtggcgtggggatgtttagtcttttcgccgttattccctttgacaagttgagtgatcatagtgcgatgctgctcgcagtcattagcttgatgctttttgtgctggcattagtaattcttttcaagagaattcagtcaactaatactcagcgttggaacttggcctcgtcagtcggattactcgcgacacttccgattatcatattcctggttgctgatacattgattcctcagggcagcctggaaaaccatgctcaacccgacgtacaggtaacaacgttagctaacaggcggccaagttcacctacctcactggactcactaggcgcactgaattcaccaagttcgccgaattccccgagctcatcaatgctgcaaaactctgaaatgttcgcctcaccaccgatcgcctctgggcagtcaccggtttcgacgttccgctcatggctagatcgatccattctgccactcacacgagaaaattccgcttcagaaagcgcagtgacagctcttggaccgtcgatagtgcagcctgcatctgaatcgattacaactccagctcaaacgtcgcaaagtcgccacgcaattgacgatggtgacgacagtaaaacctcaacgggaagaccagctcccactactaactcgccgatcattgctcttcccccaacgtggattatcgggccggaagatccagaatccaccgaccctacagcaccaaccgagcccaccgagccaagcgaacctgtcgcaaccgacgaaccctcagagacctctgaacaaacttca

SEQ ID NO: 402 - protein, 557 aa, Corynebacterium glutamicum
MYTHSTGTPQLDFDGDIYPLHLFFSAQTAQHFALERVNWHVLRAIVKPEQGELIVEALLAPIESATKIGVWVQDEFLGVIAESQFLLNSQLSRIFASGHLISSQLLLTPSKGSLASVLLPNLKFGLISNDPPRADSHLLPLGRMWRVEPTVHALFEDFSLGSTILFGLRLDLEALIVSYNGIECGILNFDDASALSSAVKFSNANGLTPTVLGHVVRENGETSFEIDVLPLELWSKKQHRLEVLKIPRLIPKEADSQNYVKATALLSDEILRPQTLSKKALSLSDTAVKYSPHVACGVGMFSLFAVIPFDKLSDHSAMLLAVISLMLFVLALVILFKRIQSTNTQRWNLASSVGLLATLPIIIFLVADTLIPQGSLENHAQPDVQVTTLANRRPSSPTSLDSLGALNSPSSPNSPSSSMLQNSEMFASPPIASGQSPVSTFRSWLDRSILPLTRENSASESAVTALGPSIVQPASESITTPAQTSQSRHAIDDGDDSKTSTGRPAPTTNSPIIALPPTWIIGPEDPESTDPTAPTEPTEPSEPVATDEPSETSEQTS

SEQ ID NO: 403 - DNA, 837 bp, Corynebacterium glutamicum
  CDS (101)..(814): RXN00840
gcgattaatgtgacaggaggaaaagaagttaactgaagttactaatgtgactaaagttgttccctccgcattgtctcgttgaaaggtaagtaaaactcaagtgacaaagacactcccccgactgcttacagtcgctgccgctctagccattgcactcccggcaaccccggtagcatcggctgtcacaccagttgaacaagctttcaacgcctcatcgaatctctccagcggtctccccgtagaccaatggggacgccccaacgagcagttccgccaacaaatcgaacaggcagtaaaccaaccgtgggtcccgcaggaaatcaagaacatcgtttctcaggccatgggttttatcaccggtgacggcagcgaaggtggggacattgaaatccccgacaacgcaccacgcatcgcgcagttcttctggcccacccgatcagaaaactgcatcaacggaaattctgcagccgtaggatctgccttcgcagttccaggaccagcagatctccccctccccggcgcaggtgtcggccaaacctccttcgtgttcaccgcactgggaactggccccctcgcagaacagcaaagcaccgcaatgactgttcaatgggcaaacttaagcaacttcacccatggcaccacgacgttgagcaacaccggaatcaaccccgatggcccctcaacgatttccggtgtggcagacacaggacgcggcatcatcgtcgcctccatgtcaggcggcctcaccacatccaccgaaaacggttcagcgaactgtaatttcatcccgactgccgtcgtattcgatgtgaggtaagaaaacaatgactgatcttc

SEQ ID NO: 404 - protein, 238 aa, Corynebacterium glutamicum
VTKTLPRLLTVAAALAIALPATPVASAVTPVEQAFNASSNLSSGLPVDQWGRPNEQFRQQIEQAVNQPWVPQEIKNIVSQAMGFITGDGSEGGDIEIPDNAPRIAQFFWPTRSENCINGNSAAVGSAFAVPGPADLPLPGAGVGQTSFVFTALGTGPLAEQQSTAMTVQWANLSNFTHGTTTLSNTGINPDGPSTISGVADTGRGIIVASMSGGLTTSTENGSANCNFIPTAVVFDVR

SEQ ID NO: 405 - DNA, 837 bp, Corynebacterium glutamicum; identical to SEQ ID NO: 403
  CDS (101)..(814): FRXA00840

SEQ ID NO: 406 - protein, 238 aa, Corynebacterium glutamicum; identical to SEQ ID NO: 404

SEQ ID NO: 407 - DNA, 660 bp, Corynebacterium glutamicum
  CDS (101)..(637): RXN00841
gcctccatgtcaggcggcctcaccacatccaccgaaaacggttcagcgaactgtaatttcatcccgactgccgtcgtattcgatgtgaggtaagaaaacaatgactgatcttcatcccgtaaagcaggaaattttcaacactgctgaatccataaacacagatcccaaggggtttctccgcgaggtagacaccttcaaagtaaccgacttcggcctgtacatggctcgtggtgcaaaccaccccaagttcggatacttggaaagctggctcctcccagaacttggattgcgtgccaacattttccacttccgcaaaggcgtggatgaacgtcaggattactacatcgatgtcgctgaaattcgcgtcgaagacaacatctggaccacccgcgacctctacgtggatctcatctctgtctgcggagaaccagtaacagtcatggacatcgacgaactagctgcagcaacctcagcagggcttatcactgcagatgacgctgagcgcgcaattgatgccaccttgaatgctgttgaaggaatcacccgccacggcgacgatcctatgcagtggctgcgctccaagggaatcgaactcacctgggctgacgccagccaggtagagctcgtccctgcagagtaactacttcctaaccgctgctt

SEQ ID NO: 408 - protein, 179 aa, Corynebacterium glutamicum
MTDLHPVKQEIFNTAESINTDPKGFLREVDTFKVTDFGLYMARGANHPKFGYLESWLLPELGLRANIFHFRKGVDERQDYYIDVAEIRVEDNIWTTRDLYVDLISVCGEPVTVMDIDELAAATSAGLITADDAERAIDATLNAVEGITRHGDDPMQWLRSKGIELTWADASQVELVPAE

SEQ ID NO: 409 - DNA, 660 bp, Corynebacterium glutamicum; identical to SEQ ID NO: 407
  CDS (101)..(637): FRXA00841

SEQ ID NO: 410 - protein, 179 aa, Corynebacterium glutamicum; identical to SEQ ID NO: 408

SEQ ID NO: 411 - DNA, 993 bp, Corynebacterium glutamicum
  CDS (101)..(970): RXN00846
ctgcgggagactcgggtagaagcgaaaaataacggtatcctcggggctgcggatggctggcctgggggaatttcaagtgctgcaagttggaggaaaaacgatgttgaagaatgatctgtctggtgctcgagttgtagctgtgcatgcgcaccctgacgatgaggcgattaccaccggtggtgtgcttgcggatcttgctgctcgtggcgccgatgtcacggtaattacctgcacgttgggcgagcagggtgaggttatcggtgagacattcgcgcagctagtcaacggtgatgcggatcagcttggcgggtttaggatccatgagctttacgcctcgctggagattctgggcgtgcgtggcattcatctgggtggcgctggctgctggagggattccggtatggttggtgatcctgcaaatgagcatccgcgtgcgtttattcactctggtgaccgtgcagtggagcaattgaaagaacttcttgcggaattgaagccacatcttttgatcacctatggccctgacggcggctatgggcaccccgatcacattcgtgcgcatgaaatcacccacgcagcagccggcgagcaacgcattctgtgggctgtgagcgaccgtgaggagctcgaggacggtctaaaggcaatcactgggcttcctgaaggttggggcaggggagagctctctgcggtcgattccgtggacctctctgttgagctgaacgatgaagtgtatgccaccaaggtggaatccatgcgcgcgcatgcgacacaattgtggatcgctgacggttccgtatctcgcaccaacccggttgccgcacacgcagtgacacagcaggacaatgtgaaggtgtgggcgctatctaatttgattgcacaacccatcatgcgccacgagcactaccaactcggcgccggaacaccactgcctgaaggtgcaactggagtgcttgacggactggagttctgacacggttatggcagaatcta

SEQ ID NO: 412 - protein, 290 aa, Corynebacterium glutamicum
MLKNDLSGARVVAVHAHPDDEAITTGGVLADLAARGADVTVITCTLGEQGEVIGETFAQLVNGDADQLGGFRIHELYASLEILGVRGIHLGGAGCWRDSGMVGDPANEHPRAFIHSGDRAVEQLKELLAELKPHLLITYGPDGGYGHPDHIRAHEITHAAAGEQRILWAVSDREELEDGLKAITGLPEGWGRGELSAVDSVDLSVELNDEVYATKVESMRAHATQLWIADGSVSRTNPVAAHAVTQQDNVKVWALSNLIAQPIMRHEHYQLGAGTPLPEGATGVLDGLEF

SEQ ID NO: 413 - DNA, 487 bp, Corynebacterium glutamicum
  CDS (101)..(487): FRXA00846
ctgcgggagactcgggtagaagcgaaaaataacggtatcctcggggctgcggatggctggcctgggggaatttcaagtgctgcaagttggaggaaaaacgatgttgaagaatgatctgtctggtgctcgagttgtagctgtgcatgcgcaccctgacgatgaggcgattaccaccggtggtgtgcttgcggatcttgctgctcgtggcgccgatgtcacggtaattacctgcacgttgggcgagcagggtgaggttatcggtgagacattcgcgcagctagtcaacggtgatgcggatcagcttggcgggtttaggatccatgagctttacgcctcgctggagattctgggcgtgcgtggcattcatctgggtggcgctggctgctggagggattccggtatggttggtgatcctgcaaatgagcatccgcgtgcgtttattcactctggtgaccgtgcagtggagcaattgaaagaacttcttgcg

SEQ ID NO: 414 - protein, 129 aa, Corynebacterium glutamicum
MLKNDLSGARVVAVHAHPDDEAITTGGVLADLAARGADVTVITCTLGEQGEVIGETFAQLVNGDADQLGGFRIHELYASLEILGVRGIHLGGAGCWRDSGMVGDPANEHPRAFIHSGDRAVEQLKELLA

SEQ ID NO: 415 - DNA, 951 bp, Corynebacterium glutamicum
  CDS (101)..(928): RXN00850
ggcagttgtgccggtatacgtggcgtcatggataatgatcgcataaatgaatacagcgaaattacctgtttcagatatttaggaaggctcacttttcaacatggctaatccattctccaaggcatggaagtacctcatggcgttgttcgactccaagattgaggagaacgcggatcctaaggtacagatccagcaagccatcgaagatgctcagcgccagcatcaggagctctcccagcaggcagcagctgttattggtaaccagcgtcagcttgaaatgcagctgaaccgccgtctggctgaaattgagaagctgcagggcaacacccgccaggctatccagctggctgacaaggctcgcgctgacggtgatgtcaagaaggctactgagtacgaaaacgccgctgaggctttcgctgcacagctggttactgctgagcagtccgttgaagataccaagcagctccacgaccaggctctgcagcaggctgatcaggctaagaaggctgtggagcgtaactccatggctttgcagcagaaggttgctgagcgcaccaagcttctgagccagctggagcaggcgaagatgcaggaaaaggtttccgagtccctgaagtccatggattctttgacctccggcagcactcctaacctggatcaagttcgtgagaagattgagcgtcgttacgctaacgcgcttggccaggctgagcttgcgtccaactctgttgagggccgcatggctgaggttgagcaggctggcgttcagatggctggacactcccgccttgagcagatccgcgctgagatggctggtggttccctgaccgctggtaacaagcaggagtccattgaggctcctgcagcgggcaacaacgtcactgatgacgcagttgcacagcgcatgcgtgagctgcgcggcgaggcttaaacctgccacagcagactaaa

SEQ ID NO: 416 - protein, 276 aa, Corynebacterium glutamicum
MANPFSKAWKYLMALFDSKIEENADPKVQIQQAIEDAQRQHQELSQQAAAVIGNQRQLEMQLNRRLAEIEKLQGNTRQAIQLADKARADGDVKKATEYENAAEAFAAQLVTAEQSVEDTKQLHDQALQQADQAKKAVERNSMALQQKVAERTKLLSQLEQAKMQEKVSESLKSMDSLTSGSTPNLDQVREKIERRYANALGQAELASNSVEGRMAEVEQAGVQMAGHSRLEQIRAEMAGGSLTAGNKQESIEAPAAGNNVTDDAVAQRMRELRGEA

SEQ ID NO: 417 - DNA, 336 bp, Corynebacterium glutamicum
  CDS (101)..(313): RXN00854
ttcatccgccctggaagacggtcatgacggggacccttcttagggtcgctgtcggagattggacacgtaacttctgtgcttgcgctgtattatcgtccccatgcgtttatcggagtttcggcaactcattgaagatgaattcggagaagccaaaggggagtggattgcacactcgcatgtgattggtgccctcggcgtcactgcagatgttgcagtagataccggggttgatctgcgcgatgtatgggaacaactgtgcattgatttcagtgttcccgaagagcgacgacttggtaaagatgaaccagggttctagcttgttcgagggggttcgca

SEQ ID NO: 418 - protein, 71 aa, Corynebacterium glutamicum
MRLSEFRQLIEDEFGEAKGEWIAHSHVIGALGVTADVAVDTGVDLRDVWEQLCIDFSVPEERRLGKDEPGF

SEQ ID NO: 419 - DNA, 336 bp, Corynebacterium glutamicum; identical to SEQ ID NO: 417
  CDS (101)..(313): FRXA00854

SEQ ID NO: 420 - protein, 71 aa, Corynebacterium glutamicum; identical to SEQ ID NO: 418

SEQ ID NO: 421 - DNA, 408 bp, Corynebacterium glutamicum
  CDS (101)..(385): RXN00855
taaaaacctctcgacggacgaagcgccacaaaagcaagagaagaatataagtgaaccaaattccgtttagtgtacgtctagacgcctaaacttacctgttatgacttattttgccgtgctttacacatacaacccagacagcgagaaagtcgctgaagttcgtaccgtccaccgcgagttcattgccaaccttcatgcggagggcaaaatcgttggctccggtcctttcgtggacggcgacggtggcgcgctgattgtcatcaagttggaagaaggctccaaccttgttgatgctgaaaccctgatgaacaatgatccattccacgtagaaaacgtgctggacaaccgcgtcatccgtagctggaaccctgtgaccaaagatttctaggcaactttttctttaacaat

SEQ ID NO: 422 - protein, 95 aa, Corynebacterium glutamicum
MTYFAVLYTYNPDSEKVAEVRTVHREFIANLHAEGKIVGSGPFVDGDGGALIVIKLEEGSNLVDAETLMNNDPFHVENVLDNRVIRSWNPVTKDF

SEQ ID NO: 423 - DNA, 408 bp, Corynebacterium glutamicum; identical to SEQ ID NO: 421
  CDS (101)..(385): FRXA00855

SEQ ID NO: 424 - protein, 95 aa, Corynebacterium glutamicum; identical to SEQ ID NO: 422

SEQ ID NO: 425 - DNA, 1044 bp, Corynebacterium glutamicum
  CDS (101)..(1021): RXN00869
gccaacaccgcgggtgcgcttgtggcgtcccgtcttgaatgctccaccgcaatgcctactaccgatgaggtggaagcctccctcaaccagaaagtctgatatgactcctccgattatctccccagagagctttgaagccctaaggcggatgcgtgcggctgaacccacgatggtggcggaacgtttcaagcagcgccgtaagcgtgaactgctcggtgaggacggcaagctgtttatcgtggctgccgaccacccagcgcgcggcgcacttgctgttggcgacaatgaaaccgccatggctaaccgctatgaactgctcgaacgcatggctatcgcactgtctcgcccgggtgtggatggtgtgctgggaactccagacatcattgatgatctggcggcgctcggactgctcgatgacaagatcgtggttggctccatgaaccgtggtggcctgcgtggcgcttcctttgaaatggatgatcgctacaccggctacaacgtgtcctccatggttgatcgtggcgtggatttcgcgaaaaccctagtgcgcatcaacttgagcgacgccggaaccgccccgaccttggaagccaccgcgcatgcagtcaatgaggctgcagcagcacagctgcccatcatgctcgagccgttcatgagtaactgggtaaacggcaaggtggtcaatgatctttccaccgatgcagttatccaatctgtcgccattgctgctggtctgggcaatgattcttcctatacctggatgaagcttccagtggtggaggagatggagcgcgtcatggaatccaccaccatgccaaccctgttgttgggcggcgaaggcggcaacgatccagatgccaccttcgcatcctgggagcatgcactcaccctgccgggtgtgcgtggcctgaccgtgggacgcactctgctgtatccgcaagacggcgatgtcgccgccgctgttgataccgcagcgcgacttgttcacacagatattcaacaattcacttcgcagagcatttaaggaatttacacacatgtctg

SEQ ID NO: 426 - protein, 307 aa, Corynebacterium glutamicum
MTPPIISPESFEALRRMRAAEPTMVAERFKQRRKRELLGEDGKLFIVAADHPARGALAVGDNETAMANRYELLERMAIALSRPGVDGVLGTPDIIDDLAALGLLDDKIVVGSMNRGGLRGASFEMDDRYTGYNVSSMVDRGVDFAKTLVRINLSDAGTAPTLEATAHAVNEAAAAQLPIMLEPFMSNWVNGKVVNDLSTDAVIQSVAIAAGLGNDSSYTWMKLPVVEEMERVMESTTMPTLLLGGEGGNDPDATFASWEHALTLPGVRGLTVGRTLLYPQDGDVAAAVDTAARLVHTDIQQFTSQSI

SEQ ID NO: 427 - DNA, 815 bp, Corynebacterium glutamicum
  CDS (1)..(792): FRXA00869
ctgtttatcgtggctgccgaccacccagcgcgcggcgcacttgctgttggcgacaatgaacccgccatggctaaccgctatgaactgctcgaacgcatggctatcgcactgtctcgcccgggtgtggatggtgtgctgggaactccagacatcattgatgatctggcggcgctcggactgctcgatgacaagatcgtggttggctccatgaaccgtggtggcctgcgtggcgcttcctttgaaatggatgatcgctacaccggctacaacgtgtcctccatggttgatcgtggcgtggatttcgcgaaaaccctagtgcgcatcaacttgagcgacgccggaaccgccccgaccttggaagccaccgcgcatgcagtcaatgaggctgcagcagcacagctgcccatcatgctcgagccgttcatgagtaactgggtaaacggcaaggtggtcaatgatctttccaccgatgcagttatccaatctgtcgccattgctgctggtctgggcaatgattcttcctatacctggatgaagcttccagtggtggaggagatggagcgcgtcatggaatccaccaccatgccaaccctgttgttgggcggcgaaggcggcaacgatccagatgccaccttcgcatcctgggagcatgcactcaccctgccgggtgtgcgtggcctgaccgtgggacgcactctgctgtatccgcaagacggcgatgtcgccgccgctgttgataccgcagcgcgacttgttcacacagatattcaacaattcacttcgcagagcatttaaggaatttacacacatgtctg

SEQ ID NO: 428 - protein, 264 aa, Corynebacterium glutamicum
LFIVAADHPARGALAVGDNEPAMANRYELLERMAIALSRPGVDGVLGTPDIIDDLAALGLLDDKIVVGSMNRGGLRGASFEMDDRYTGYNVSSMVDRGVDFAKTLVRINLSDAGTAPTLEATAHAVNEAAAAQLPIMLEPFMSNWVNGKVVNDLSTDAVIQSVAIAAGLGNDSSYTWMKLPVVEEMERVMESTTMPTLLLGGEGGNDPDATFASWEHALTLPGVRGLTVGRTLLYPQDGDVAAAVDTAARLVHTDIQQFTSQSI

SEQ ID NO: 429 - DNA, 753 bp, Corynebacterium glutamicum
  CDS (101)..(730): RXN00915
cttggctgcaggtccaccatcagcacaggtctttgacatgaacgtagctcgccgcgacgtttcttcaggaccttctctacctggtgagggtgagttctaaatgtccgccgcctattcgcaggacaccattttgacggtgtttctggggaggggtctgaccgctgaagggatccgacagaccctagaagacttcgcagaaaccggcctagtccgcaacctggtgtggattgatgccgatagtttccacgagtcttcatctgaagtcacccacttggcaaccaaccaagacggtcttccggagcttcagcgacgacctttcaatgagttggtgtcccggtcacgaaccaccaagcttcacatcggtgtcatcaacgtcattgatggcagcgaaggcatgcttcatgcagaagaactcaacccattggttgggatcatcgacagtgtctgttcacaccaccaaattcaccgatccaacgtgatgatcggtgcggtggctgccacacttgatgaggaacttccaattcttcgtggttatgtgaacctgatgctggcacctgaagatagccacagcccaggcaccgcaacagtgacctaccgtcatggtttcagcgatcaccgtttaccctgcactgcgtggctaatatcgccagcttgtacggactgtgggaaggcagcacatccacaccaatcgaacagctcgtacctgcgaaaggttccagctttcgtttggtgaggtctttttacaggcgaatt

SEQ ID NO: 430 - protein, 210 aa, Corynebacterium glutamicum
MSAAYSQDTILTVFLGRGLTAEGIRQTLEDFAETGLVRNLVWIDADSFHESSSEVTHLATNQDGLPELQRRPFNELVSRSRTTKLHIGVINVIDGSEGMLHAEELNPLVGIIDSVCSHHQIHRSNVMIGAVAATLDEELPILRGYVNLMLAPEDSHSPGTATVTYRHGFSDHRLPCTAWLISPACTDCGKAAHPHQSNSSYLRKVPAFVW

SEQ ID NO: 431 - DNA, 610 bp, Corynebacterium glutamicum
  CDS (101)..(610): FRXA00915
cttggctgcaggtccaccatcagcacaggtctttgacatgaacgtagctcgccgcgacgtttcttcaggaccttctctacctggtgagggtgagttctaaatgtccgccgcctattcgcaggacaccattttgacggtgtttctggggaggggtctgaccgctgaagggatccgacagaccctagaagacttcgcagaaaccggcctagtccgcaacctggtgtggattgatgccgatagtttccacgagtcttcatctgaagtcacccacttggcaaccaaccaagacggtcttccggagcttcagcgacgacctttcaatgagttggtgtcccggtcacgaaccaccaagcttcacatcggtgtcatcaacgtcattgatggcagcgaaggcatgcttcatgcagaagaactcaacccattggttgggatcatcgacagtgtctgttcacaccaccaaattcaccgatccaacgtgatgatcggtgcggtggctgccacacttgatgaggaacttccaattcttcgtggttatgtgaacctgatgctggcacctgaagatagccacagcccaggcaccgcaacagtgacctaccgtcatggtttcagc

SEQ ID NO: 432 - protein, 170 aa, Corynebacterium glutamicum
MSAAYSQDTILTVFLGRGLTAEGIRQTLEDFAETGLVRNLVWIDADSFHESSSEVTHLATNQDGLPELQRRPFNELVSRSRTTKLHIGVINVIDGSEGMLHAEELNPLVGIIDSVCSHHQIHRSNVMIGAVAATLDEELPILRGYVNLMLAPEDSHSPGTATVTYRHGFS

SEQ ID NO: 433 - DNA, 2802 bp, Corynebacterium glutamicum
  CDS (101)..(2779): RXN00917
tgccgtggaagaaagcgctctttactgcgacagccgtcctattggtgtttgctgttgtgtggtcggccttggatattgccctgtgggtaggaaagcagtcatggtgaacacgttgaactctaaaaccgtgaatgtaccccgttttgccagaggcgttgttgctgcagccacagcgctattttttggcgctttggtaagcctcgcgcctagtgcgttggcgcaggaaccacctgcagttgaggccggagcgtcaggttctttgagcaacctgggtgcctgcatcgctgataaaggcactcttgatgtcatcatcatgatcgatgagacagaatccttgatccatgaagctcgtgacggcgtggtcaacgccaatgaaccaggcgcggacgcacagcaccaccgtgttcctgcagcacagagctttgtggatgagcttctagccaagcaaagcgatggtgatctgaacacccgcatccgtgttgctggtttcggccagacgtacaaatctggtgccactgatccagacaattacggagcatggacgcaactagatgcctccaccgttggcggagtacaagatgaaatctcccgcttcgctgaccgcacccaggagcagtacaccaactacgcctccgcgattgagggcgcttaccaggacttcactaggtccggctctgaggacgcctgccgcatgctggtgaccttcaccgacggcgcactgaccgctcaagaaggcgccgatgttgcagaagcagcactgtgcgcgccgggtggcgtcaccgatcgactgcgcagtgctggcatcacccacatcggcatcggtttatcggcacctaccaacccatctgatttcagcctgctgcgcggaaccaccgcaggtggcggaacatgtggtgtcgaaccagctaacggtgcattcttcccagcagataacgtgggcggacttttcgcagcattccgtgaagcccttgcgattggtggtgaaacaattggtgaaacccgagctggtgatcctttcagcttcaccctggacaactcggtgaactctgtgcgtttcaccgcgatcgccaaggatgatctcggcccgaacgcccacttggtgctcaccgcacccaacggcgaaacggttgagctcaaagattctggaagcagcgtcgccaacagcactgacgtgagttgggaagccgaaagcagcccagtaaaaatggctgatggttccctcaacctgcagcaaggtggggattggaagggtgtctggcagattcagttccaaggaattgatcctgcagcggttgatggacgcgtattcaactcagtggagatccagcctgacctccagcttgtgttcagtggcggtgattcgacgtcaggtgcacttaaccttcgcgatgatcagcagctgaatatgcagctggtgggccgtgatggtcagccacgcatccttgaggggtccgcgctggtcgatcttggtttcacccgcgcagataccggcgagttcgcccctttggctcaaggaattgatatttctggcggcgaattaagcttcccgctggatacgatttcgcagctcccagccatcggcacggtggaagcgcgtaccacgatcaccaccgcaggcgtcgatgatctccccggcaccacgttgagcccaattctcaacaccacgcgcatcaccatcactcagcgcgatatgcctcagctgccagcgtcggttcgcttcacagcggatgaggacgttgttaccgtagacatccccatcaccggccccggcaaggtatggattgcaccgggaacccagctcagcggagtgcttccagacggcgtggacggcattgcagcatcaagtactttcgacagcccagataatgctttggtgctcggactggatgagcagggcacgattcctgttgaactaaccgtgagcgatcttcgtgacggactggtcaacggctcgattccactccagatctccaacgctgagggcgccaatgaaaccagcgtggatctgccgacagaaggcacgttgagcgttcccattaacgcctccactttcgcattggcattcattttggcccttgtgctttccctcctgattccgctgctcattttgtatattgtgcgtttcctctccgcaaaggttccgtcctctgcgatgagtggcgtgcgcattccagtggaattctccggtgaagctctgcgctatgcgggcagcactatgcctgatctcgcatcgcaaaccaccgccaccaagcaggtcgttgttcatggagacaccttcaatgtggaaggccacaaacttaaagtccagcgcttccagctgaacccgattgcgtctcctgcagtgatcgtgcagaccgacccgtcgatcagcttcgacggcaaacaaaagggcacacaagctaaactcccgctggcggtccaaggcagttggttcctcactgcaagcggcgctgacccttccaagatggaactcatcgccctgacaaacctgccgctcgagcagggccaaatcgaccgcatgatcgcaggtatcaccagcaaagcccctgatagggcacgcgaactacaaaaattgcttgacgacgccgcgacctcccagcccgcaaaggttccaccgcgcgccccagccgcgcagggccacgtcgaaaagcaagctcctagttttggcactggttccggtggtggtttcggctccagcaatggtggaggctttggctccggtagcggatccaacgacacaaatggtggatttggttccagcggcggcttcggcgcgcgataacctgtaacttgcgattaaaa

SEQ ID NO: 434 - protein, 893 aa, Corynebacterium glutamicum
MVNTLNSKTVNVPRFARGVVAAATALFFGALVSLAPSALAQEPPAVEAGASGSLSNLGACIADKGTLDVIIMIDETESLIHEARDGVVNANEPGADAQHHRVPAAQSFVDELLAKQSDGDLNTRIRVAGFGQTYKSGATDPDNYGAWTQLDASTVGGVQDEISRFADRTQEQYTNYASAIEGAYQDFTRSGSEDACRMLVTFTDGALTAQEGADVAEAALCAPGGVTDRLRSAGITHIGIGLSAPTNPSDFSLLRGTTAGGGTCGVEPANGAFFPADNVGGLFAAFREALAIGGETIGETRAGDPFSFTLDNSVNSVRFTAIAKDDLGPNAHLVLTAPNGETVELKDSGSSVANSTDVSWEAESSPVKMADGSLNLQQGGDWKGVWQIQFQGIDPAAVDGRVFNSVEIQPDLQLVFSGGDSTSGALNLRDDQQLNMQLVGRDGQPRILEGSALVDLGFTRADTGEFAPLAQGIDISGGELSFPLDTISQLPAIGTVEARTTITTAGVDDLPGTTLSPILNTTRITITQRDMPQLPASVRFTADEDVVTVDIPITGPGKVWIAPGTQLSGVLPDGVDGIAASSTFDSPDNALVLGLDEQGTIPVELTVSDLRDGLVNGSIPLQISNAEGANETSVDLPTEGTLSVPINASTFALAFILALVLSLLIPLLILYIVRFLSAKVPSSAMSGVRIPVEFSGEALRYAGSTMPDLASQTTATKQVVVHGDTFNVEGHKLKVQRFQLNPIASPAVIVQTDPSISFDGKQKGTQAKLPLAVQGSWFLTASGADPSKMELIALTNLPLEQGQIDRMIAGITSKAPDRARELQKLLDDAATSQPAKVPPRAPAAQGHVEKQAPSFGTGSGGGFGSSNGGGFGSGSGSNDTNGGFGSSGGFGAR

SEQ ID NO: 435 - DNA, 1406 bp, Corynebacterium glutamicum
  CDS (1)..(1383): FRXA00917
cagctgaatatgcagctggtgggccgtgatggtcagccacgcatccttgaggggtccgcgctggtcgatcttggtttcacccgcgcagataccggcgagttcgcccctttggctcaaggaattgatatttctggcggcgaattaagcttcccgctggatacgatttcgcagctcccagccatcggcacggtggaagcgcgtaccacgatcaccaccgcaggcgtcgatgatctccccggcaccacgttgagcccaattctcaacaccacgcgcatcaccatcactcagcgcgatatgcctcagctgccagcgtcggttcgcttcacagcggatgaggacgttgttaccgtagacatccccatcaccggccccggcaaggtatggattgcaccgggaacccagctcagcggagtgcttccagacggcgtggacggcattgcagcatcaagtactttcgacagcccagataatgctttggtgctcggactggatgagcagggcacgattcctgttgaactaaccgtgagcgatcttcgtgacggactggtcaacggctcgattccactccagatctccaacgctgagggcgccaatgaaaccagcgtggatctgccgacagaaggcacgttgagcgttcccattaacgcctccactttcgcattggcattcattttggcccttgtgctttccctcctgattccgctgctcattttgtatattgtgcgtttcctctccgcaaaggttccgtcctctgcgatgagtggcgtgcgcattccagtggaattctccggtgaagctctgcgctatgcgggcagcactatgcctgatctcgcatcgcaaaccaccgccaccaagcaggtcgttgttcatggagacaccttcaatgtggaaggccacaaacttaaagtccagcgcttccagctgaacccgattgcgtctcctgcagtgatcgtgcagaccgacccgtcgatcagcttcgacggcaaacaaaagggcacacaagctaaactcccgctggcggtccaaggcagttggttcctcactgcaagcggcgctgacccttccaagatggaactcatcgccctgacaaacctgccgctcgagcagggccaaatcgaccgcatgatcgcaggtatcaccagcaaagcccctgatagggcacgcgaactacaaaaattgcttgacgacgccgcgacctcccagcccgcaaaggttccaccgcgcgccccagccgcgcagggccacgtcgaaaagcaagctcctagttttggcactggttccggtggtggtttcggctccagcaatggtggaggctttggctccggtagcggatccaacgacacaaatggtggatttggttccagcggcggcttcggcgcgcgataacctgtaacttgcgattaaaa

SEQ ID NO: 436 - protein, 461 aa, Corynebacterium glutamicum
QLNMQLVGRDGQPRILEGSALVDLGFTRADTGEFAPLAQGIDISGGELSFPLDTISQLPAIGTVEARTTITTAGVDDLPGTTLSPILNTTRITITQRDMPQLPASVRFTADEDVVTVDIPITGPGKVWIAPGTQLSGVLPDGVDGIAASSTFDSPDNALVLGLDEQGTIPVELTVSDLRDGLVNGSIPLQISNAEGANETSVDLPTEGTLSVPINASTFALAFILALVLSLLIPLLILYIVRFLSAKVPSSAMSGVRIPVEFSGEALRYAGSTMPDLASQTTATKQVVVHGDTFNVEGHKLKVQRFQLNPIASPAVIVQTDPSISFDGKQKGTQAKLPLAVQGSWFLTASGADPSKMELIALTNLPLEQGQIDRMIAGITSKAPDRARELQKLLDDAATSQPAKVPPRAPAAQGHVEKQAPSFGTGSGGGFGSSNGGGFGSGSGSNDTNGGFGSSGGFGAR

SEQ ID NO: 437 - DNA, 536 bp, Corynebacterium glutamicum
  CDS (1)..(513): RXN00921
cctgcggcaatcctcttggaccatatcgttccgaacttcagcagagatcggtctttgccagacatcgaagactggacgagaagcgatgaagctcagcagatctttgcaggaatcattgcgggtgcgtctgttcaaactggtagaagccacttcatgtgggatcttttgcgggcgtattttggagtcgctttgatcggcgacgaagatacctacagggcttttactactctcacggtcgattctgttcttagtttcgtgcagttaactcttcaagagggcagaacggaagacattagacgattcgagaaatatggtgagcagattgcccgagaggatttgccgtcgattctcaccaatgctcgagcagtacagcaatatctcggctatatcgaccaagatatcatcaataagaaagtgtcccggtctagggatgttaaccagatttttactgagatggcgcgcgctatcatcagagcaattagccggaataatattggaaaggacatgcggtcatgaacgtgattcgactggattcc

SEQ ID NO: 438 - protein, 171 aa, Corynebacterium glutamicum
PAAILLDHIVPNFSRDRSLPDIEDWTRSDEAQQIFAGIIAGASVQTGRSHFMWDLLRAYFGVALIGDEDTYRAFTTLTVDSVLSFVQLTLQEGRTEDIRRFEKYGEQIAREDLPSILTNARAVQQYLGYIDQDIINKKVSRSRDVNQIFTEMARAIIRAISRNNIGKDMRS

SEQ ID NO: 439 - DNA, 2022 bp, Corynebacterium glutamicum
  CDS (101)..(1999): FRXA00921
tctgggaacgtggattggtggaagcaggtgagttgcccgtggccttgagatggactcatgtcacctacgcgtcctttagaggaactgcaggtaggggtgggtggaaggtggaacttggtctgctcaggccactaaagaagacctccaatttatcgcggaggttgcgcccactcatattgaaacggtgaccccttttgatgatttcatctcatcagaagatatcgatgcgttgccgaggaggtttgagtaccgtcctttggcaggccgatcgttgatcatgcagtctgttcctgcaggtaaagatgccactggacgtccagggaatgtgttcacccatgcagtatttgatggggatctagaaagcccactggagtctgtttatcccatttccctgtaccgttcacctgatttgctgaccccttttcgtgcagccgcggtcaacgctgccgagctccctttggatgcaggcgagccgagaattggccccatcactgatctgtccttgtcgtggatgatgatcgacagcatgtttggcgatcgcagacagcagttctaccagcttcaagatgctctccaagctggagataaagctactgttttggttctgaacagcactaacgaggcagcatattggcttcaagcgttgtcttctacattgactccgaatgaagcccggcgtctgttgcacttctcaacctttgagcgtgctgctaccttgccagctccagataaatcaatggaggctcgttctctgtttgtggtcccaggaattgatcgtgaattgttggcggagcattcagggattgtgattatcgatccggagattccacagagccaacctttcggcccgcagggatcctggtcccgaatgacagaagggctcttctccgacggttttgatgctgatgaacttgtcgcagggctgattcgtgccaacgagaacctggataatagccaaaaggaactcgctcaatttggagacggtttagcgcgatttatccggaatggccgtttttccggcacgcacccgcttcgcgtacttgctgatcagcatatgtttggaaaggtgccagacaagccagcacctaaggtggagcctgtcgctccggcaccaaaccccaatgcaatttgggcgcgtgcatctgaggtagttcacaatcctcggagagcatcagaatcacaagattggccaagtctgaggcgattgccggatagtcggcgcaggatcatcaatatgtcagagcaggcgatcaacagcattgagaagcttcatgattcgccggcacaggatcttgttgcctatttggatttccttttgaaaactgagcttgcgacaagcattaatgcttcggatcccttttttcggagtagtttttcagactttccagcgatggacaactggcgacacattaagttcaccgaggatgcgcaccctcgcttgagggaactactcgtggacgcagaacgcgatgctaggaacagagcacctgcggcaatcgtcttggaccatatcgttccgaacttcagcagagatcggtctttgccagacatcgaagactggacgagaagcgatgaagctcagcagatctttgcaggaatcattgcgggtgcgtctgttcaaactggtagaagccacttcatgtgggatcttttgcgggcgtattttggagtcgctttgatcggcgacgaagatacctacagggcttttactactctcacggtcgattctgttcttagtttcgtgcagttaactcttcaagagggcagaacggaagacattagacgattcgagaaatatggtgagcagattgcccgagaggatttgccgtcgattctcaccaatgctcgagcagtacagcaatatctcggctatatcgaccaagatatcatcaataagaaagtgtcccggtctagggatgttaaccagatttttactgagatggcgcgcgctatcatcagagcaattagccggaataatattggaaaggacatgcggtcatgaacgtgattcgactggattcc

SEQ ID NO: 440 - protein, 633 aa, Corynebacterium glutamicum
VEGGTWSAQATKEDLQFIAEVAPTHIETVTPFDDFISSEDIDALPRRFEYRPLAGRSLIMQSVPAGKDATGRPGNVFTHAVFDGDLESPLESVYPISLYRSPDLLTPFRAAAVNAAELPLDAGEPRIGPITDLSLSWMMIDSMFGDRRQQFYQLQDALQAGDKATVLVLNSTNEAAYWLQALSSTLTPNEARRLLHFSTFERAATLPAPDKSMEARSLFVVPGIDRELLAEHSGIVIIDPEIPQSQPFGPQGSWSRMTEGLFSDGFDADELVAGLIRANENLDNSQKELAQFGDGLARFIRNGRFSGTHPLRVLADQHMFGKVPDKPAPKVEPVAPAPNPNAIWARASEVVHNPRRASESQDWPSLRRLPDSRRRIINMSEQAINSIEKLHDSPAQDLVAYLDFLLKTELATSINASDPFFRSSFSDFPAMDNWRHIKFTEDAHPRLRELLVDAERDARNRAPAAIVLDHIVPNFSRDRSLPDIEDWTRSDEAQQIFAGIIAGASVQTGRSHFMWDLLRAYFGVALIGDEDTYRAFTTLTVDSVLSFVQLTLQEGRTEDIRRFEKYGEQIAREDLPSILTNARAVQQYLGYIDQDIINKKVSRSRDVNQIFTEMARAIIRAISRNNIGKDMRS

SEQ ID NO: 441 - DNA, 1035 bp, Corynebacterium glutamicum
  CDS (101)..(1012): RXN00943
taggtacgatcggacgaggagaaaaaatctgaaaacaatccagtggcccacctcggcttataaaactggacaacagtattttgattggagcatcaccataatgatccgcaaacttgctcgaccaatgcttgcatcggtctacgtcgcagatggcgcagaaacagtattgaacaccagcgcacacgtcgaaggcactcaggtagttctggatcgtatccgttatgtgctgccccgtaagtacgcaaagcgcatttccagagatccagaattggtcacccgcgtcattggcggcaccaaagtcggtgcgggttctttgctagctattggtcgtgcaccacgcacctctgcagctaccctcgcaatcctgactatccctaacatcctggctcgcaatgcgttctgggaaacccaggatgcggatgaaaagcgtaaccgccgcaacggtttcctcaccaacattgccctgcttggtggcctgtttatcacttctgttgatactgagggcaagcctggcgtgaagtggcgtgcaaccaatgctacaaagcgtggcaagaagcagctgcagcaggcacttccaaccaaatctgagactgaaaagttcggtgagaaggcctctgattggttcaacgatacttctgacaaggtcaccgagtacgcgtacaccgctcaggattttgtcggtgagaacaaggatgactggatcaagtccgcaaccgagactgctcacaaggtcgctgatactgtgagcgattacgctcacaaggctacctcttaccttgaggagaacagcggtgactggcttgaggctgcgcaggctaacgccaagactgctcgtaagtctgcagtgaaggctgccggcaaggctcaggaaaaggctaactttgctcttcaggtcgcagaggaaacctctggtcgcgccaacaagaaggcaactaagagctacgacaagcttcagaagcaggctgataaggccatcgatcgtgcacagaagaagctgaagggcatcgaactttaagtaacttcttcctgattgag

SEQ ID NO: 442 - protein, 304 aa, Corynebacterium glutamicum
MIRKLARPMLASVYVADGAETVLNTSAHVEGTQVVLDRIRYVLPRKYAKRISRDPELVTRVIGGTKVGAGSLLAIGRAPRTSAATLAILTIPNILARNAFWETQDADEKRNRRNGFLTNIALLGGLFITSVDTEGKPGVKWRATNATKRGKKQLQQALPTKSETEKFGEKASDWFNDTSDKVTEYAYTAQDFVGENKDDWIKSATETAHKVADTVSDYAHKATSYLEENSGDWLEAAQANAKTARKSAVKAAGKAQEKANFALQVAEETSGRANKKATKSYDKLQKQADKAIDRAQKKLKGIEL

SEQ ID NO: 443 - DNA, 530 bp, Corynebacterium glutamicum
  CDS (1)..(507): FRXA00943
aagcctggcgtgaagtggcgtgcaaccaatgctacaaagcgtggcaagaagcagctgcagcaggcactttcaaccaaatctgagactgaaaagttcggtgagaaggcctctgattggttcaacgatacttctgacaaggtcaccgagtacgcgtacaccgctcaggattttgtcggtgagaacaaggatgactggatcaagtccgcaaccgagactgctcacaaggtcgctgatactgtgagcgattacgctcacaaggctacctcttaccttgaggagaacagcggtgactggcttgaggctgcgcaggctaacgccaagactgctcgtaagtctgcagtgaaggctgccggcaaggctcacgaaaaggctaactttgctcttcaggtcgcagaggaaacctctggtcgcgccaacaagaaggcaactaagagctacgacaagcttcagaagcaggctgataaggccatcgatcgtgcacagaagaagctgaagggcatcgaactttaagtaacttcttcctgattgag

SEQ ID NO: 444 - protein, 169 aa, Corynebacterium glutamicum
KPGVKWRATNATKRGKKQLQQALSTKSETEKFGEKASDWFNDTSDKVTEYAYTAQDFVGENKDDWIKSATETAHKVADTVSDYAHKATSYLEENSGDWLEAAQANAKTARKSAVKAAGKAHEKANFALQVAEETSGRANKKATKSYDKLQKQADKAIDRAQKKLKGIEL

SEQ ID NO: 445 - DNA, 316 bp, Corynebacterium glutamicum
  CDS (101)..(316): FRXA02423
taggtacgatcggacgaggagaaaaaatctgaaaacaatccagtggcccacctcggcttataaaactggacaacagtattttgattggagcatcaccataatgatccgcaaacttgctcgaccaatgcttgcatcggtctacgtcgcagatggcgcagaaacagtattgaacaccagcgcacacgtcgaaggcactcaggtagttctggatcgtatccgttatgtgctgccccgtaagtacgcaaagcgcatttccagagatccagaattggtcacccgcgtcattggcggcaccaaagtctgtgcgggttcttgt

SEQ ID NO: 446 - protein, 72 aa, Corynebacterium glutamicum
MIRKLARPMLASVYVADGAETVLNTSAHVEGTQVVLDRIRYVLPRKYAKRISRDPELVTRVIGGTKVCAGSC

SEQ ID NO: 447 - DNA, 1095 bp, Corynebacterium glutamicum
  CDS (101)..(1072): RXN00945
tcacagtaccacccacaagccacaaggagggtatggaggtgggcgtctaaagccaaatttttcccggtgtttgaggcgattgcaccgtacactaatgtgcatgcttgaacgcctcaaacgcctagatccgctcattgtcctcattgtgctggctgtcattgtggcgatcatcattccagttcgcggggttgctgcggattggtttgatgtcgccgtcaagattgccattgcgctgctgttttttctttatggtgcccgcctatccacccaagaggcgctgaatggtctgaagcactggaggcttcacctgactattttggcgatcactttcggaatattcccacttatcggcattgggctcgagccgatgactgcatttgtgtcggaagatatttatcggggaattttgttcctcacgctcgttccgtccaccgtgcagtcatcggtggcgtttacctcgatcgctaaaggcaacgtagctggtgcgattgtgtcggcatcgctctccaaccttgcgggtgttttcctcactccgctgctggtcatgctcatcatgtctgcgggcgggggagttcacgtggattcccaggtcttcctcgacattgcgattcagcttctgctgccgttcatcctcggccaggtatgtaggcgttgggtgaagaattttgcggccaacaaagcaacaaaaatcgtggaccgcggctcgatcgcgatggtcgtgtactccgcgttttctgccggcatggtggctggcatttggtccactgtgagcgttctagagattatctacctcattgttttcgctattctgctggtgatggccatgctgtggttcacgctgttcatggctacacgccttggatttaaccgggcagattccatcgctattcagttctgcggaaccaagaaatccctggccacaggcctcccaatggcggcagtcatcttcggtggcgccaatatcggcctgctcatcttgccgttgatgatcttccaccaagtccagctgatgatttgtgcatggcttgcagctcgttatggtcgtgatgcgcaggaacagaaagccaacgcctaaaagtcctcagtagctagcca

SEQ ID NO: 448 - protein, 324 aa, Corynebacterium glutamicum
MLERLKRLDPLIVLIVLAVIVAIIIPVRGVAADWFDVAVKIAIALLFFLYGARLSTQEALNGLKHWRLHLTILAITFGIFPLIGIGLEPMTAFVSEDIYRGILFLTLVPSTVQSSVAFTSIAKGNVAGAIVSASLSNLAGVFLTPLLVMLIMSAGGGVHVDSQVFLDIAIQLLLPFILGQVCRRWVKNFAANKATKIVDRGSIAMVVYSAFSAGMVAGIWSTVSVLEIIYLIVFAILLVMAMLWFTLFMATRLGFNRADSIAIQFCGTKKSLATGLPMAAVIFGGANIGLLILPLMIFHQVQLMICAWLAARYGRDAQEQKANA

SEQ ID NO: 449 - DNA, 897 bp, Corynebacterium glutamicum
  CDS (101)..(874): RXN00946
gggccggtgtgaataaaacaccttccccaaatagacagcatggtctagattagcttgaaacgaaagcgtacattcgcagcaactaacggaaagcacactcatgactcacactctgcaggcaactaatccccttgatcaaaccgcttggcacgcttggcatttctcccgaaacaaagaggccatcagccgcaccggcgccaccagcctgagtgccacagagtggattagcgccaccacactcaaggacgcgcacacttttccttcacttcccgggcgatggtataaacgaggcggcggggtagtgggagcacatttaccaccagctttcgcaacaactggaacggtgcaactgcgccccggtgagctcttgatagcggaagatttcaccctcaccgtcattgaacggcttggacagtttgcacttcaggtttttgatgcacgcaatccgaagcgttttgaattccactccatcgcagctttcccaccgtccgaggaatggcggattgaggctcgcttcttcccggaacctgacactgttaacaccgctgcagctgatggagttatcgttgccacgcctactgcgggttgggtgcactttttgaagggccgtctggattaccgtcttcgtgtaaccgttcagaaaaataatctacgggcactatttagcgacaattcctcgacgttgggcgtttatcagcatcgttttgtcgacatcccacgccctgatgccgagggaaacaccatcattgatttcaaccgcgcttatcttcccccaaaggcattgaaccgaaagttcctgtgcccatcgcccagcctgaacaaccacctcaatctcaccgtggaggcaggggagaagtgggtggttgctggaggataatacttgctaaccgtcctaaa

SEQ ID NO: 450 - protein, 258 aa, Corynebacterium glutamicum
MTHTLQATNPLDQTAWHAWHFSRNKEAISRTGATSLSATEWISATTLKDAHTFPSLPGRWYKRGGGVVGAHLPPAFATTGTVQLRPGELLIAEDFTLTVIERLGQFALQVFDARNPKRFEFHSIAAFPPSEEWRIEARFFPEPDTVNTAAADGVIVATPTAGWVHFLKGRLDYRLRVTVQKNNLRALFSDNSSTLGVYQHRFVDIPRPDAEGNTIIDFNRAYLPPKALNRKFLCPSPSLNNHLNLTVEAGEKWVVAGG

SEQ ID NO: 451 - DNA, 897 bp, Corynebacterium glutamicum; identical to SEQ ID NO: 449
  CDS (101)..(874): FRXA00946

SEQ ID NO: 452 - protein, 258 aa, Corynebacterium glutamicum; identical to SEQ ID NO: 450

SEQ ID NO: 453 - DNA, 789 bp, Corynebacterium glutamicum
  CDS (14)..(766): RXN00953
cttgcattccccaatggcgccaccaacggtaggcaactacatcatgcagtccttcactcaaggtctgcagttcggcgttgcagttgccgtgattctctttggtgtccgcaccattcttggtgaactggtccccgcattccaaggtattgctgcgaaggttgttcccggagctatccccgcattggatgcaccgatcgtgttcccctacgcgcagaacgccgttctcattggtttcttgtcttccttcgtcggtggcttggttggcctgactgttcttgcatcgtggctgaacccagcttttggtgtcgcgttgattctgcctggtttggtcccccacttcttcactggtggcgcggcgggcgtttacggtaatgccacgggtggtcgtcgaggagcagtatttggcgcctttgccaacggtcttctgattaccttcctccctgctttcctgcttggtgtgcttggttccttcgggtcagagaacaccactttcggtgatgcggactttggttggttcggaatcgttgttggttctgcagccaaggtggaaggtgctggcgggctcatcttgttgctcatcatcgcagcggttcttctgggtggcgcgatggtcttccagaagcgcgtcgtgaatgggcactgggatccagctcccaaccgtgagcgcgtggagaaggcggaagctgatgccactccaacggctggggctcggacctaccctaagattgctcctccggcgggcgctcctaccccaccggctcgaagctaagatctccaaaaccctgagat

SEQ ID NO: 454 - protein, 251 aa, Corynebacterium glutamicum
MAPPTVGNYIMQSFTQGLQFGVAVAVILFGVRTILGELVPAFQGIAAKVVPGAIPALDAPIVFPYAQNAVLIGFLSSFVGGLVGLTVLASWLNPAFGVALILPGLVPHFFTGGAAGVYGNATGGRRGAVFGAFANGLLITFLPAFLLGVLGSFGSENTTFGDADFGWFGIVVGSAAKVEGAGGLILLLIIAAVLLGGAMVFQKRVVNGHWDPAPNRERVEKAEADATPTAGARTYPKIAPPAGAPTPPARS

SEQ ID NO: 455 - DNA, 579 bp, Corynebacterium glutamicum
  CDS (101)..(556): RXN00959
tttggaggcggagcatcataccttttaatgtcaggatcgtgcagtgaagaattcaggatgaattactcgctggaatattggtggggatagagttgttgttatgacggtgatcggaattattcttggcagcctttttggcgttcttgcagtccttctcatcgtggttggtgctttggggtgggcggctaagctccctggcaacccggttgtgggcattcgtgtccctgaggtgcgtaaatcccaagaattgtgggatatggcgcaccgtgtcgctggcccgttgtgggtgctgtcgggagtttcctttgttattgcatcgctagttgcgtttgttgcttctggttggatgtggcttgttgtggcgttgggtgttgaggctgccatcgcgttcattggtatgggtgcgggtatggctgcacatactgttgcgatggttgacgcgaagcgcattcgcgaaaccccgcaggcgcctgtttccgctgaaattgaagaggccggtggtgtgactattacctctgccgattatcaacaagactccgctgaatgcccccaagattgacttggatgcagtgcgtagag

SEQ ID NO: 456 - protein, 152 aa, Corynebacterium glutamicum
MTVIGIILGSLFGVLAVLLIVVGALGWAAKLPGNPVVGIRVPEVRKSQELWDMAHRVAGPLWVLSGVSFVIASLVAFVASGWMWLVVALGVEAAIAFIGMGAGMAAHTVAMVDAKRIRETPQAPVSAEIEEAGGVTITSADYQQDSAECPQD

SEQ ID NO: 457 - DNA, 427 bp, Corynebacterium glutamicum
  CDS (101)..(427): FRXA00959
tttggaggcggagcatcataccttttaatgtcaggatcgtgcagtgaagaattcaggatgaattactcgctggaatattggtggggatagagttgttgttatgacggtgatcggaattattcttggcagcctttttggcgttcttgcagtccttctcatcgtggttggtgctttggggtgggcggctaagctccctggcaacccggttgtgggcattcgtgtccctgaggtgcgtaaatcccaagaattgtgggatatggcgcaccgtgtcgctggcccgttgtgggtgctgtcgggagtttcctttgttattgcatcgctagttgcgtttgttgcttctggttggatgtggcttgttgtggcgttgggtgttgaggctgccatcgcgttcattggtatgggtgcgggtatggctgcgcatactggt

SEQ ID NO: 458 - protein, 109 aa, Corynebacterium glutamicum
MTVIGIILGSLFGVLAVLLIVVGALGWAAKLPGNPVVGIRVPEVRKSQELWDMAHRVAGPLWVLSGVSFVIASLVAFVASGWMWLVVALGVEAAIAFIGMGAGMAAHTG

SEQ ID NO: 459 - DNA, 960 bp, Corynebacterium glutamicum
  CDS (101)..(937): RXN00963
ctggctctgacggcgtcgacttgttctgcttctctgatacaccaattttcgaggcccttaacctcgcacgtacttttactccggaaggaatctagaacttatgcgtcttgcaacaatccgcaccaacggcaccaccattgctgctcgtgttgaatctgaaaacaccgctaccaccatcgagggctttgccaacgtcggtgaattactccaggaatccaactggcgcgagctggcagaaaacgctgctggtgaggctgtgacctttgaaaacaaggagctagatgcagtagttccagcacctaagaagattgtgtgcgtcggccttaactacgccaaccacattaaagaaatgggccgcgacctccctgataccccaaccctttttgttaagttccctgacgcgctcatcggacctttcgatgatgttgtcgttccagagtgggctaacaaggctctcgactgggaaggcgagatggcagttatcattggcaagcgcgcacgccgtgtcaagcaggccgatgctgctgagtacatcgctggctacgcagtgatgaacgattacaccacccgcgatttccagtacgcagcacctgcaaagactccacagtggcaccagggcaagtctttggaaaagtccgctggcttcgggccttggatgactaccccagattcttttgagttcggcggcgagctggcaacctacctcgagggcgagaaggtacagtccacccctaccaatgacctggtctttagcccagaaaagctcatcgaatacatcacccacatctacccattggatgctggcgacgtcattgtcaccggtaccccaggcggcgttggccacgcacgtaacccacagcgctacatcggtgacggcgaaaccgtaaaggttgagattgcgggcctcggcttcattgaaaacaagacggtgtttgaataaatgacaactttccacgatct

SEQ ID NO: 460 - protein, 279 aa, Corynebacterium glutamicum
MRLATIRTNGTTIAARVESENTATTIEGFANVGELLQESNWRELAENAAGEAVTFENKELDAVVPAPKKIVCVGLNYANHIKEMGRDLPDTPTLFVKFPDALIGPFDDVVVPEWANKALDWEGEMAVIIGKRARRVKQADAAEYIAGYAVMNDYTTRDFQYAAPAKTPQWHQGKSLEKSAGFGPWMTTPDSFEFGGELATYLEGEKVQSTPTNDLVFSPEKLIEYITHIYPLDAGDVIVTGTPGGVGHARNPQRYIGDGETVKVEIAGLGFIENKTVFE

SEQ ID NO: 461 - DNA, 538 bp, Corynebacterium glutamicum
  CDS (101)..(538): FRXA00963
ctggctctgacggcgtcgacttgttctgcttctctgatacaccaattttcgaggcccttaacctcgcacgtacttttactccggaaggaatctagaacttatgcgtcttgcaacaatccgcaccaacggcaccaccattgctgctcgtgttgaatctgaaaacaccgctaccaccatcgagggctttgccaacgtcggtgaattactccaggaatccaactggcgcgagctggcagaaaacgctgctggtgaggctgtgacctttgaaaacaaggagctagatgcagtagttccagcacctaagaagattgtgtgcgtcggccttaactacgccaaccacattaaagaaatgggccgcgacctccctgataccccaaccctttttgttaagttccctgacgcgctcatcggacctttcgatgatgttgtcgttccagagtgggctaacaaggctctcgactgggaaggcgagatggcagttatcattggcaagcgcgcacgccgtgtcaagcaggccgatgctgctgagtacatcgct

SEQ ID NO: 462 - protein, 146 aa, Corynebacterium glutamicum
MRLATIRTNGTTIAARVESENTATTIEGFANVGELLQESNWRELAENAAGEAVTFENKELDAVVPAPKKIVCVGLNYANHIKEMGRDLPDTPTLFVKFPDALIGPFDDVVVPEWANKALDWEGEMAVIIGKRARRVKQADAAEYIA

SEQ ID NO: 463 - DNA, 341 bp, Corynebacterium glutamicum
  CDS (1)..(318): RXN00971
aaagcactttccatcggaacccagtgggcacaagtcatgggcattaaccacgccgaagccgaagaactcgacgaagccctctccccgctcattaaccgcctccgcgaaatgggctttgaccccaccgaaaccgaagaagcaaactccctcgctctacacagctgcccatttgtggtcaacgacaaacgcccatcagccttcgtctgcgccatccacgccggattcatccaagaaagcctcggtgaaaacaaccgcatccagctggaactcaaaccactcaacgcgccgggcacctgtaaggttcacgtgttcagcgaataattgctgcactaataaggccc

SEQ ID NO: 464 - protein, 106 aa, Corynebacterium glutamicum
KALSIGTQWAQVMGINHAEAEELDEALSPLINRLREMGFDPTETEEANSLALHSCPFVVNDKRPSAFVCAIHAGFIQESLGENNRIQLELKPLNAPGTCKVHVFSE

SEQ ID NO: 465 - DNA, 296 bp, Corynebacterium glutamicum
  CDS (1)..(273): FRXA00971
aaccacgccgaagccgaagaactcgacgaagccctctccccgctcattaaccgcctccgcgaaatgggctttgaccccaccgaaaccgaagaagcaaactccctcgctctacacagctgcccatttgtggtcaacgacaaacgcccatcagccttcgtctgcgccatccacgccggattcatccaagaaagcctcggtgaaaacaaccgcatccagctggaactcaaaccactcaacgcgccgggcacctgtaaggttcacgtgttcagcgaataattgctgcactaataaggccc

SEQ ID NO: 466 - protein, 91 aa, Corynebacterium glutamicum
NHAEAEELDEALSPLINRLREMGFDPTETEEANSLALHSCPFVVNDKRPSAFVCAIHAGFIQESLGENNRIQLELKPLNAPGTCKVHVFSE

SEQ ID NO: 467 - DNA, 1503 bp, Corynebacterium glutamicum
  CDS (101)..(1480): RXN00991
acttcaaggaaagacggtcccaagagctaaaactcccccacggcacgcgaagctgaacaggctttcaccgcttctaagggcaacagcttaaaccacgctaatggacatactcataagcatcctctcactgctaggcttcgtgcttcttaccgcgagcaccggactattcgtggccattgagttcgcactcaccggcttagaaaaatccactgtagaaacacatgtgaagcaaaaaggcgacagcagcgcccgcgcagtgcagagggatcatcaaaatctgtcgttcgtgctctctggtgcccagctgggcatcacgatcacgacacttgccacaggcttcctcgcagagccggttttggccaaattcttcaccccagcacttgagctggtgggattaaatgaatcagcaagctccgcagtagccctcatcatcgcactgttggtggcaactaccctctccatggtttttggtgagttggttcccaaaaactgggcgatcaccaacccgttgggcgtggcacgttttgttgtccaccctgtcaattggttcaacatggttctcaagccgtttattaacggcatgaacaagtctgcaaactttattgtccgcaaacttggtattgaaccagccgaagagcttgcctctgcccgttcctcccaagagctcaccgccttggtacgcagctccgcggaaagcggcggactggatcaaaacaccgcagcggtgatcaaccgatccctgcagttcggtgacgccaccgctgatgaattcatgacacctcgctccaccattgaatcattgcgtgccacagacaccgtcaatgatttgatcgagcttgccctggaaacgggtcactcccgcttcccagtcaccgaaggcgacttggatgaaaccatcggcatggtccacatcaaggacgcattctctgtagtgcaggcagaacgcgccaccaccatggtgcgcgatctagcccgcaaaattcctgtggtaccagccagccttgacggcgactctgtcctcaacgctgtccgctccgccggctcccaagttattttggttgccgatgaatacggcggaaccgcaggcatggtcaccatcgaagacgtcgtggaggaaatcctcggcgaaatccacgatgagcacgacgactccgacgccgaacgcgatttccaacaattcggcgccagctgggaagtctccggcctggtccgcatcgatgaactcgaaaaacgcgtcgggtacgtctcccctgacggcccctacgaaaccctcggcggcttgatcatgtacacagtcggcgccattcctcgcgtcggcgatgtcgccctactcccactgaccgataccccaaccatggatgaattcgaatccggcttctccggacgctggatcgcacgagtaacggtcatggaagatcgacgcatcgacaaagccgttctcacccccatcacccatgaagaagcaaaggagtacgaaaagtgagtatttgggcaactgtcctt

SEQ ID NO: 468 - protein, 460 aa, Corynebacterium glutamicum
MDILISILSLLGFVLLTASTGLFVAIEFALTGLEKSTVETHVKQKGDSSARAVQRDHQNLSFVLSGAQLGITITTLATGFLAEPVLAKFFTPALELVGLNESASSAVALIIALLVATTLSMVFGELVPKNWAITNPLGVARFVVHPVNWFNMVLKPFINGMNKSANFIVRKLGIEPAEELASARSSQELTALVRSSAESGGLDQNTAAVINRSLQFGDATADEFMTPRSTIESLRATDTVNDLIELALETGHSRFPVTEGDLDETIGMVHIKDAFSVVQAERATTMVRDLARKIPVVPASLDGDSVLNAVRSAGSQVILVADEYGGTAGMVTIEDVVEEILGEIHDEHDDSDAERDFQQFGASWEVSGLVRIDELEKRVGYVSPDGPYETLGGLIMYTVGAIPRVGDVALLPLTDTPTMDEFESGFSGRWIARVTVMEDRRIDKAVLTPITHEEAKEYEK

SEQ ID NO: 469 - DNA, 1185 bp, Corynebacterium glutamicum
  CDS (101)..(1162): RXN01004
ccggacgctggatcgcacgagtaacggtcatggaagatcgacgcatcgacaaagccgttctcacccccatcacccatgaagaagcaaaggagtacgaaaagtgagtatttgggcaactgtccttctaattatcgtccttctttccgccaacgccttcttcgtggccgcggagttcgcactgatttcctcgcgccgggaccgcctggattccctggtatcccagggtaaaaagggagctgaaaaggttctctacgcaaccgagcacctctccatcatgttggcgggcgctcagttcggtattacggtctgttctctgattctgggtaaagtcgcagaacctgcgatcgcccacttcattgaggtgcctttcacctcctggggtgttccaaatgatttgatccacccaatttccttcgtcatcgcactggcgatcatcacctggttgcacattctctttggtgaaatggtgccaaagaacatcgctattgctggccctgaaaccttaggcatgtggcttgctccagtgctcattgcgtttgtgaagattacccgcccgttgatcgagttcatgaactggatcgcccgtctgacccttcgcgcctttggtgtggagcaaaaaaacgagctggattccaccgtggacccagagcagctggcatcaatgatttccgagtcccgttccgaaggcctccttgatgctgaagagcacgcccgcctgtccaaggcgctgcgctctgagcagcgttccatcaaggaactggtgattaaggatgaggacgtgcgcacgctggcgttcggtaaatctggcccgaccttgcaccagttggaggaagcagtccgcgagaccggtttctcccgcttccctgtcaccggccgcgatggatcctacttgggttatatccacatcaaggatattttgcctcgtctggctgatcctgagatggatccctccgagaccattccgcgttctgcactgcgccctttgagcaatgtggatgccgacggcctcatggatgacgtcttggattttatgcactaccgctccgcgcacatggctcaggttcgcctcaaaggtgagcttctcggcgtgattacgctggaggatctcatcgaagaatacgtgggcaccgtcaacgattggactcacgaaagctccgacgactagaaatagtaactgtgttggac

SEQ ID NO: 470 - protein, 354 aa, Corynebacterium glutamicum
VSIWATVLLIIVLLSANAFFVAAEFALISSRRDRLDSLVSQGKKGAEKVLYATEHLSIMLAGAQFGITVCSLILGKVAEPAIAHFIEVPFTSWGVPNDLIHPISFVIALAIITWLHILFGEMVPKNIAIAGPETLGMWLAPVLIAFVKITRPLIEFMNWIARLTLRAFGVEQKNELDSTVDPEQLASMISESRSEGLLDAEEHARLSKALRSEQRSIKELVIKDEDVRTLAFGKSGPTLHQLEEAVRETGFSRFPVTGRDGSYLGYIHIKDILPRLADPEMDPSETIPRSALRPLSNVDADGLMDDVLDFMHYRSAHMAQVRLKGELLGVITLEDLIEEYVGTVNDWTHESSDD

SEQ ID NO: 471 - DNA, 771 bp, Corynebacterium glutamicum
  CDS (101)..(748): RXN01016
tgcccgtcgaggtgaacgcccaagaatagttctctttcgtcgacttctcacgttgataccgctcggcatcatccaccaaattctccagccgggtgaagcattgttgccgtatgcaatagtcggcctggtcattttgctgccatcctcctggttgcctcgttgggctgtcgcagtccttggcgaagtgtcgcttgtgccagcggtggttttcggtggcgggttcctgcttatcccctcaatgttcctgatcggttcagcgctcgttaggtatggagtagtcgatcgggcagagaacgcaccgcgggctatgggagtctttttcgccgtaagcgcagcaatcgctatacctacgctgatcatccaggcacgtgacatcacttcttcaggcttctcgatcgtttccacagtggcgggactcgcgcttggcggcgtctacatttctttagtgttgctggccttgcatacaccgattcgcggtgcactcgctgcagttttcgcacctttagggcgtatggcgctaaccaactacattggtgcaacgatcctcatgctcattggcgggctaatcgtggatcttccacacagcacatcatggacagctacggtgctcctagctgcgggtattctcattattcaagagctactttctgctttatggttgcgccactacacacaggggccacttgggtatctatggcgttgggtgacttggggaagccgttcccccttccttacccgttccgcatcatgacaggtacggaagtgtcctac

SEQ ID NO: 472 - protein, 216 aa, Corynebacterium glutamicum
LLPYAIVGLVILLPSSWLPRWAVAVLGEVSLVPAVVFGGGFLLIPSMFLIGSALVRYGVVDRAENAPRAMGVFFAVSAAIAIPTLIIQARDITSSGFSIVSTVAGLALGGVYISLVLLALHTPIRGALAAVFAPLGRMALTNYIGATILMLIGGLIVDLPHSTSWTATVLLAAGILIIQELLSALWLRHYTQGPLGYLWRWVTWGSRSPFLTRSAS

SEQ ID NO: 473 - DNA, 771 bp, Corynebacterium glutamicum; identical to SEQ ID NO: 471
  CDS (101)..(748): FRXA01016

SEQ ID NO: 474 - protein, 216 aa, Corynebacterium glutamicum; identical to SEQ ID NO: 472

SEQ ID NO: 475 - DNA, 1101 bp, Corynebacterium glutamicum
  CDS (101)..(1078): RXN01023
aagcgaatccgggaatgaaagtgagtgcgccaaagtcaactccttggttcaagtgtcagtatttttctagtctatcgccccacaggtaggctcaggacacatgagtgccgtgaacagtgctggtcgcccagccaacgggggaattaacaaaacccccatgattattgccctagtgttatctattgtgttggttttggcggtgctgttcggcgcccgagtcctccttggccccgccggccagcaacagatagccatgagtgggcttcccgccccagacgcagaatctgctgagtgcgccgcattactcgaggatctccccggcgaggccttcgggcacacccgtgcagaaatcatggatcctgttccaccgggcgctgccgcctggtccacctcagacctcgagcgtgtgacgctgcgttgtggcgtcgatatgccattccagtacaccgcgctcgccaacaccgtcgacgtcgacggcaccacctggctacctgtctccgacatgacccccggctcctccctggagacctggtactccgtcaaccgcttccccgtcgtcgccatcaccgccgatgacatcagcaccgacagcgccgacaaccccgtcgcccccttcagcagcgccgtcgacaagctagaaaagcgcgacggccagcccttcgacgccccacttaccggcttgagctcagccggcaccacatgcacttcgcttttcgacgccctcccccgccaactcgaagtcggcggcgacgacggcacaacgtacgaacgcatcgaggaggaccgcatgcaggccgccggatactccgacgacgcagtcgcgtgggacacgccgggattagaacccattgtgatccgttgcggcgtggagccttctgagaactacgcagccggtgccatgttgcagcagatcgatgacatcccgtggttcgaggacaccattttggcctccggtaccacctcgtctacctggtatgcccttggacgcgagatcgacatcgccgtgtctctgcctcaggctgcttcctcttccctgattactatctccggtttcattgaagacacggttcctgcggaataagacataaaaaatcgccccac

SEQ ID NO: 476 - protein, 326 aa, Corynebacterium glutamicum
MSAVNSAGRPANGGINKTPMIIALVLSIVLVLAVLFGARVLLGPAGQQQIAMSGLPAPDAESAECAALLEDLPGEAFGHTRAEIMDPVPPGAAAWSTSDLERVTLRCGVDMPFQYTALANTVDVDGTTWLPVSDMTPGSSLETWYSVNRFPVVAITADDISTDSADNPVAPFSSAVDKLEKRDGQPFDAPLTGLSSAGTTCTSLFDALPRQLEVGGDDGTTYERIEEDRMQAAGYSDDAVAWDTPGLEPIVIRCGVEPSENYAAGAMLQQIDDIPWFEDTILASGTTSSTWYALGREIDIAVSLPQAASSSLITISGFIEDTVPAE

SEQ ID NO: 477 - DNA, 974 bp, Corynebacterium glutamicum
  CDS (1)..(951): FRXA01023
ccagccaacgggggaattaacaaaacccccatgattattgccctagtgttatctattgtgttggttttggcggtgctgttcggcgcccgagtcctccttggccccgccggccagcaacagatagccatgagtgggcttcccgccccagacgcagaatctgctgagtgcgccgcattactcgaggatctccccggcgaggccttcgggcacacccgtgcagaaatcatggatcctgttccaccgggcgctgccgcctggtccacctcagacctcgagcgtgtgacgctgcgttgtggcgtcgatatgccattccagtacaccgcgctcgccaacaccgtcgacgtcgacggcaccacctggctacctgtctccgacatgacccccggctcctccctggagacctggtactccgtcaaccgcttccccgtcgtcgccatcaccgccgatgacatcagcaccgacagcgccgacaaccccgtcgaccccttcagcagcgccgtcgacaagctagaaaagcgcgacggccagcccttcgacgccccacttaccggcttgagctcagccggcaccacatgcacttcgcttttcgacgccctcccccgccaactcgaagtcggcggcgacgacggcacaacgtacgaacgcatcgaggaggaccgcatgcaggccgccggatactccgacgacgcagtcgcgtgggacacgccgggattagaacccattgtgatccgttgcggcgtggagccttctgagaactacgcagccggtgccatgttgcagcagatcgatgacatcccgtggttcgaggacaccattttggcctccggtaccacctcgtctacctggtatgcccttggacgcgagatcgacatcgccgtgtctctgcctcaggctgcttcctcttccctgattactatctccggtttcattgaagacacggttcctgcggaataagacataaaaaatcgccccac

SEQ ID NO: 478 - protein, 317 aa, Corynebacterium glutamicum
PANGGINKTPMIIALVLSIVLVLAVLFGARVLLGPAGQQQIAMSGLPAPDAESAECAALLEDLPGEAFGHTRAEIMDPVPPGAAAWSTSDLERVTLRCGVDMPFQYTALANTVDVDGTTWLPVSDMTPGSSLETWYSVNRFPVVAITADDISTDSADNPVDPFSSAVDKLEKRDGQPFDAPLTGLSSAGTTCTSLFDALPRQLEVGGDDGTTYERIEEDRMQAAGYSDDAVAWDTPGLEPIVIRCGVEPSENYAAGAMLQQIDDIPWFEDTILASGTTSSTWYALGREIDIAVSLPQAASSSLITISGFIEDTVPAE

SEQ ID NO: 479 - DNA, 2172 bp, Corynebacterium glutamicum
  CDS (101)..(2149): RXN01028
cgcaagcagctgcactatattcaggcattttaccgtgcctgggacccatcaacgccgcttcaatgacgctgacccagcggtgacccatccgcatctcacagtgatctacccaccgctcacccctgcatccgaagagaaattcaacaagatcacctcagtcgctgctgtgagcaagcgcccaaccaccctgccgtatttccgtgcagatggttcacctactcgtggctttgctaacttctccacaggaggtattcacggtgcggaatacaacgaagatcgttttgaccatgatcaagatctacacacagtggcaacccgtgaattcttcgccattcttgatgcgacattagcggctctctacgcagcccaccaagccgaacctgaatcggcggactaccagattgcacaagacgcactcgcctgggcaaagaatgtacttagcgatcaaaaactcatcgctaagtcgcctcagttatacaaccccgaaaccggggtcacctatgagtgggagtttgtcgctcaagcagcatggtggattcgcaacaaaccggttgaggttattttaccaacaggtgaatcaatgaccgtaaaacacaaatctgtattggcatctgcgtcctacccactccgagacaacgtggcgtactggcgtagcgaacccaaaacaccacagctgtttcccgtagcaaaatctggtggttcctcgcttgagaagaagtacaactacacctctgtgggtactgctattcacgaggactttagcagttactatccgctcttgctcaccaatatggctgcatttaccaatgctgacttaggtattgatgagaaaaccgggcgccctcgtgaccgctaccgtgaaatctacgaacaaaaagagatctatggcgcacagcgcaaagacccctccattgatgaagaaacaaagcaacgtctagggattttgcgcgaaggtaccaagttgattcttaactcggccaccggtgctgctgatgctggtcacgacaccccgatcctcatgaacaatcgcgttattgccatgaggattattgggcagctattttcttggagaattgggcaagctcaatcactggctggtgcaacgattatttccactaacactgatggcctgtattccgtactcgatatggggactaaccagcgcgttcttgatgaacacgctacagccatcggtgtgcaaattgagcctgaagaactggatattgtctccaaggattccaactcacgtgccgaatttctcggcaatggctacatcaatgcggccggtgacttggcgtgttgggatggacccaactctcggaactcactagatcacccggcctttgttgaccatgtgctggtgaagtatttccagctcgtcgtcaacaacactgtgccagagattccagaaacacctgagcttgagggtgtaccgctggctcttgatcaacccatgaaccgccacgaagtctcgaagattgtcgccactatgcacaaggaattcgagccgaaaaagctgctgtcgttttaccaaaacattttggcctcttcacgcggttctaataccttcctattctctgtcccctatatccctgcaacagaaggagaagaaacccaccctgcaacagataccagcactattgcgacaccaaccttgagctttgatgcttatggtaataaggccgaggtcatgccgactcaatccactgtggataagcgcgtgccctctttgctgcagtattacacgcgtacattccatgtgcgacaagatacgcagcaggctgtctttgatgttattggcgccaaccccgtgctcatcgccgcagcaaaagctgcatccatatcaccggcttctgctgattcacgtagaaagaagggcctggcctccaccaacgctgacccagtagccaagcatgtactagaaattgcaggagctgatgtggaatcgctgcgccatgaaaaggatctcaaggtcaccaagcacactggccaagacccagcactgcctgtcgtggtctttaaccaaaccatttggcataaccccaacgacgatgtgattaatgcattactgggcgctattgaccaggatgcctacattgacatggcgatctcgtcctacaacaagtcctggcacaacattatcccggcttaactaccgctgggtagacccct

SEQ ID NO: 480 - protein, 683 aa, Corynebacterium glutamicum
VIYPPLTPASEEKFNKITSVAAVSKRPTTLPYFRADGSPTRGFANFSTGGIHGAEYNEDRFDHDQDLHTVATREFFAILDATLAALYAAHQAEPESADYQIAQDALAWAKNVLSDQKLIAKSPQLYNPETGVTYEWEFVAQAAWWIRNKPVEVILPTGESMTVKHKSVLASASYPLRDNVAYWRSEPKTPQLFPVAKSGGSSLEKKYNYTSVGTAIHEDFSSYYPLLLTNMAAFTNADLGIDEKTGRPRDRYREIYEQKEIYGAQRKDPSIDEETKQRLGILREGTKLILNSATGAADAGHDTPILMNNRVIAMRIIGQLFSWRIGQAQSLAGATIISTNTDGLYSVLDMGTNQRVLDEHATAIGVQIEPEELDIVSKDSNSRAEFLGNGYINAAGDLACWDGPNSRNSLDHPAFVDHVLVKYFQLVVNNTVPEIPETPELEGVPLALDQPMNRHEVSKIVATMHKEFEPKKLLSFYQNILASSRGSNTFLFSVPYIPATEGEETHPATDTSTIATPTLSFDAYGNKAEVMPTQSTVDKRVPSLLQYYTRTFHVRQDTQQAVFDVIGANPVLIAAAKAASISPASADSRRKKGLASTNADPVAKHVLEIAGADVESLRHEKDLKVTKHTGQDPALPVVVFNQTIWHNPNDDVINALLGAIDQDAYIDMAISSYNKSWHNIIPA

SEQ ID NO: 481 - DNA, 647 bp, Corynebacterium glutamicum
  CDS (1)..(624): FRXA01028
ttttaccaaaacattttggcctcttcacgcggttctaataccttcctattctctgtcccctatatccctgcaacagaaggagaagaaacccaccctgcaacagataccagcactattgcgacaccaaccttgagctttgatgcttatggtaataaggccgaggtcatgccgactcaatccactgtggataagcgcgtgccctctttgctgcagtattacacgcgtacattccatgtgcgacaagatacgcagcaggctgtctttgatgttattggcgccaaccccgtgctcatcgccgcagcaaaagctgcatccatatcaccggcttctgctgattcacgtagaaagaagggcctggcctccaccaacgctgacccagtagccaagcatgtactagaaattgcaggagctgatgtggaatcgctgcgccatgaaaaggatctcaaggtcaccaagcacactggccaagacccagcactgcctgtcgtggtctttaaccaaaccatttggcataaccccaacgacgatgtgattaatgcattactgggcgctattgaccaggatgcctacattgacatggcgatctcgtcctacaacaagtcctggcacaacattatcccggcttaactaccgctgggtagacccct

SEQ ID NO: 482 - protein, 208 aa, Corynebacterium glutamicum
FYQNILASSRGSNTFLFSVPYIPATEGEETHPATDTSTIATPTLSFDAYGNKAEVMPTQSTVDKRVPSLLQYYTRTFHVRQDTQQAVFDVIGANPVLIAAAKAASISPASADSRRKKGLASTNADPVAKHVLEIAGADVESLRHEKDLKVTKHTGQDPALPVVVFNQTIWHNPNDDVINALLGAIDQDAYIDMAISSYNKSWHNIIPA

SEQ ID NO: 483 - DNA, 1230 bp, Corynebacterium glutamicum
  CDS (1)..(1230): FRXA01812
agcttcaatgacgttgacccagcggtgacccatccgcatctcacagtgatctacccaccgctcacccctgcatccgaagagaaattcaacaagatcacctcagtcgctgctgtgagcaagcgcccaaccaccctgccgtatttccgtgcagatggttcacctactcgtggctttgctaacttctccacaggaggtattcacggtgcggaatacaacgaagatcgttttgaccatgatcaagatctacacacagtggcaacccgtgaattcttcgccattcttgatgcgacattagcggctctctacgcagcccaccaagccgaacctgaatcggcggactaccagattgcacaagacgcactcgcctgggcaaagaatgtacttagcgatcaaaaactcatcgctaagtcgcctcagttatacaaccccgaaaccggggtcacctatgagtgggagtttgtcgctcaagcagcatggtggattcgcaacaaaccggttgaggttattttaccaacaggtgaatcaatgaccgtaaaacacaaatctgtattggcatctgcgtcctacccactccgagacaacgtggcgtactggcgtagcgaacccaaaacaccacagctgtttcccgtagcaaaatctggtggttcctcgcttgagaagaagtacaactacacctctgtgggtactgctattcacgaggactttagcagttactatccgctcttgctcaccaatatggctgcatttaccaatgctgacttaggtattgatgagaaaaccgggcgccctcgtgaccgctaccgtgaaatctacgaacaaaaagagatctatggcgcacagcgcaaagacccctccattgatgaagaaacaaagcaacgtctagggattttgcgcgaaggtaccaagttgattcttaactcggccaccggtgctgctgatgctggtcacgacaccccgatcctcatgaacaatcgcgttattgccatgaggattattgggcagctattttcttggagaattgggcaagctcaatcactggctggtgcaacgattatttccactaacactgatggcctgtattccgtactcgatatggggactaaccagcgcgttcttgatgaacacgctacagccatcggtgtgcaaattgagcctgaagaactggatattgtctccaaggattccaactcacgtgccgaatttctcggcaatggctacatcaatgcggcc

SEQ ID NO: 484 - protein, 410 aa, Corynebacterium glutamicum
SFNDVDPAVTHPHLTVIYPPLTPASEEKFNKITSVAAVSKRPTTLPYFRADGSPTRGFANFSTGGIHGAEYNEDRFDHDQDLHTVATREFFAILDATLAALYAAHQAEPESADYQIAQDALAWAKNVLSDQKLIAKSPQLYNPETGVTYEWEFVAQAAWWIRNKPVEVILPTGESMTVKHKSVLASASYPLRDNVAYWRSEPKTPQLFPVAKSGGSSLEKKYNYTSVGTAIHEDFSSYYPLLLTNMAAFTNADLGIDEKTGRPRDRYREIYEQKEIYGAQRKDPSIDEETKQRLGILREGTKLILNSATGAADAGHDTPILMNNRVIAMRIIGQLFSWRIGQAQSLAGATIISTNTDGLYSVLDMGTNQRVLDEHATAIGVQIEPEELDIVSKDSNSRAEFLGNGYINAA

SEQ ID NO: 485 - DNA, 837 bp, Corynebacterium glutamicum
  CDS (101)..(814): RXN01069
tcctaagctctcttgagtacctgagaccttctcagcaaaacacaaagtgccttcacccaacctggggtggaggcactttctcattgctaaggtgtgcatcgtgaacgatttaccgaacctaccaaagctgcccttcaactggacatgggtgctggcaactgttgccacgacagtggtgttggcgggtattggtttgtatgtgtattacccgtcgttgccagatcctatgccggtgcattggaatggatccggggaggcggataattggacgcctaaatcggtgggttcgtttctttcactgattttgatagggccaggcattattttgctgaccctgtcgggtatgcaggcgttgctgaccatgcagtctggagtgatcacgcaacgcggtggggcgaaatcggcgaatgaagcgcaccggcagtgggaaacctacaaggcaacaagcatgcacatgggttggtacatgtttgtgctcaacgctttgattttggtgatgatcctcaatgagttccgcccaaaccctctgcctggtggatttatcatcgggcttattggaattattgctgccacgattgtcctgttggttctgattggaaaaacaaccacgagtttggcaaagaaataccccatgcctgaccaagatggaaagacgtgggggattttctacaacgatccggacgataatcggatcttagtggacaccgggatggggatgaattacacgtttaacattgcccatacgtggggcaagatcttcgcggttttgatcttcgcggtgccagtactcatcgttttattaaccgttctcctttaacctcgatccaccgatgtgcc

SEQ ID NO: 486 - protein, 238 aa, Corynebacterium glutamicum
VNDLPNLPKLPFNWTWVLATVATTVVLAGIGLYVYYPSLPDPMPVHWNGSGEADNWTPKSVGSFLSLILIGPGIILLTLSGMQALLTMQSGVITQRGGAKSANEAHRQWETYKATSMHMGWYMFVLNALILVMILNEFRPNPLPGGFIIGLIGIIAATIVLLVLIGKTTTSLAKKYPMPDQDGKTWGIFYNDPDDNRILVDTGMGMNYTFNIAHTWGKIFAVLIFAVPVLIVLLTVLL

SEQ ID NO: 487 - DNA, 703 bp, Corynebacterium glutamicum
  CDS (101)..(703): FRXA01069
tcctaagctctcttgagtacctgagaccttctcagcaaaacacaaagtgccttcacccaacctggggtggaggcactttctcattgctaaggtgtgcatcgtgaacgatttaccgaacctaccaaagctgcccttcaactggacatgggtgctggcaactgttgccacgacagtggtgttggcgggtattggtttgtatgtgtattacccgtcgttgccagatcctatgccggtgcattggaatggatccggggaggcggataattggacgcctaaatcggtgggttcgtttctttcactgattttgatagggccaggcattattttgctgaccctgtcgggtatgcaggcgttgctgaccatgcagtctggagtgatcacgcaacgcggtggggcgaaatcggcgaatgaagcgcaccggcagtgggaaacctacaaggcaacaagcatgcacatgggttggtacatgtttgtgctcaacgctttgattttggtgatgatcctcaatgagttccgcccaaaccctctgcctggtggatttatcatcgggcttattggaattattgctgccacgattgtcctgttggttctgattggaaaaacaaccacgagtttggcaaagaaataccccatgcctgaccaagatggaaagacgtgggggattttctacaacgatccggacgataatcggatcttagtggac

SEQ ID NO: 488 - protein, 201 aa, Corynebacterium glutamicum
VNDLPNLPKLPFNWTWVLATVATTVVLAGIGLYVYYPSLPDPMPVHWNGSGEADNWTPKSVGSFLSLILIGPGIILLTLSGMQALLTMQSGVITQRGGAKSANEAHRQWETYKATSMHMGWYMFVLNALILVMILNEFRPNPLPGGFIIGLIGIIAATIVLLVLIGKTTTSLAKKYPMPDQDGKTWGIFYNDPDDNRILVD

SEQ ID NO: 489 - DNA, 2187 bp, Corynebacterium glutamicum
  CDS (101)..(2164): RXN01071
cacctgaattggctgagggagaggcaccgactggcaccgaagaggtgcttgcctcgaaggcgggcgctgaggcgaatggcctggagtaggggaccagatcttggtcgtggactccagtggccgctacaacgtcaccatcacaggcctgaccaccactgagacggattcggccaccgcgctgaacctgcagatgtcggaagctggctacctggagcgttacaccgacggggctaccgtccccagcgtcatgctgtcggctgcagatggcaccacgcctcaagagcttgtcgacgccctcgctgccgaacttggatcgaactttgatgtagaaaccggcgaagcgctagtcgagcaggctacaggaatgatcacgcaggccttgagcttcgtgcagtacttcctcgttgccttcggtctcattgcactgctggttggtaccttcatcatcgcgaataccttctccatgattgtggctcagcgcatgcgtgagttcgctctcctgcgagccctgggtgcggcgccaggacagatcactcgctctgtggtgctggaagcaaccatcgttggcctcttcggctctgctcttggtgtgctgggtggtatgggcctcgtagcgatcatttcagctgtcctcaataacctgggcatgccgatgggatccagcgttggcttgactccttctgcagtggttaccgcgctcgtattgggcaccgttgtcaccattgtgagcgcgtgggctccggctcgtcgtgcaggtgaggttaagcctgttgaagcgatgcgcaacatggaaaccaccactatgcgttccatgatggggcgcacgatcaccggtggcatcgttctagcactcggcatcatctttgcgattgccggtgcgatgatgactgattcttccaccgctactcgttccatcctggtgggcattggtgcactgtttgtcatcgtgggtacgttcctcttctcaccagcgctctccatgcctgtggtgggtggcctgggcaaggttatcggtgcaccgtttggcagcgttggaagccttgctgcgaccaactccaagcgaaaccctcgccgtaccgcaactacagcgttcgcactgacgttgggcattgccttagtgactgcaattggcatgctttctgcaaccatgaaggacgcagtctccgacatgatggcggagcagtacaccgcagattacatcctgcagggaccaaccaacggttccatcaccatgccgaaggaatctgtcaatgatgttcgcgatgctgagggcgttgccgatgtcgtgctcgtttccatgaactctgcctcggtgaacggtcaggcttcatacagccagctgggccagtctgtaacctttgtcgctgacggcgacctgagcaaggtcatcagcacagaaagcattgatggctccctcgacttgagcaacccaggtgttgtgactaaccagacgtttgctgatgaaaacggctgggcagtaggcgatactctgcagcttgaatcaatggggcagaccatcggcgatatcgagttgatcggtaccttcaccggaaacgacgccatcggaaatatgatcatctccgaaagttccttggctgatacaccagcggcagacactgctgttcctcagatgatgctggtggtaggcgaagaaggctttgataaggaacaactgcgcaccaacttggaagacgcagtcgctgattacattgtcatctctgtgaaatcagcaaccgagttcgctggtgaaacggttgcgatgatcgacaccatgatgaacattctgtacgcgctgcttgctctgtctgtcattgttgccatcatcggcatcatcaacaccctggcactgaatgtgatcgagcgtcgccaggagatcggtatgctccgcgcagttggcgtgaagcgcggacaggtccgcaccatgatcaccttagaatctgttcagatcgccatctacggtgctgtgattggtatcgcgattggtcttggtctgggctgggcctttgtgacagtgatgtcaggcgaaggactagacgctgcggttagtatcccgtggggtcaggtcggactgatgcttgttggttccgctgtagtcggtgttatcgccgcgctgtggccggcagtcaaggcatctaggacaccacctttggatgcgattaccgactagttttagcggcagttgaatca

SEQ ID NO: 490 - protein, 688 aa, Corynebacterium glutamicum
LVVDSSGRYNVTITGLTTTETDSATALNLQMSEAGYLERYTDGATVPSVMLSAADGTTPQELVDALAAELGSNFDVETGEALVEQATGMITQALSFVQYFLVAFGLIALLVGTFIIANTFSMIVAQRMREFALLRALGAAPGQITRSVVLEATIVGLFGSALGVLGGMGLVAIISAVLNNLGMPMGSSVGLTPSAVVTALVLGTVVTIVSAWAPARRAGEVKPVEAMRNMETTTMRSMMGRTITGGIVLALGIIFAIAGAMMTDSSTATRSILVGIGALFVIVGTFLFSPALSMPVVGGLGKVIGAPFGSVGSLAATNSKRNPRRTATTAFALTLGIALVTAIGMLSATMKDAVSDMMAEQYTADYILQGPTNGSITMPKESVNDVRDAEGVADVVLVSMNSASVNGQASYSQLGQSVTFVADGDLSKVISTESIDGSLDLSNPGVVTNQTFADENGWAVGDTLQLESMGQTIGDIELIGTFTGNDAIGNMIISESSLADTPAADTAVPQMMLVVGEEGFDKEQLRTNLEDAVADYIVISVKSATEFAGETVAMIDTMMNILYALLALSVIVAIIGIINTLALNVIERRQEIGMLRAVGVKRGQVRTMITLESVQIAIYGAVIGIAIGLGLGWAFVTVMSGEGLDAAVSIPWGQVGLMLVGSAVVGVIAALWPAVKASRTPPLDAITD

SEQ ID NO: 491 - DNA, 1726 bp, Corynebacterium glutamicum
  CDS (101)..(1726): FRXA02898
cacctgaattggctgagggagaggcaccgactggcaccgaagaggtgcttgcctcgaaggcgggcgctgaggcgaatggcctggagtaggggaccagatcttggtcgtggactccagtggccgctacaacgtcaccatcacaggcctgaccaccactgagacggattcggccaccgcgctgaacctgcagatgtcggaagctggctacctggagcgttacaccgacggggctaccgtccccagcgtcatgctgtcggctgcagatggcaccacgcctcaagagcttgtcgacgccctcgctgccgaacttggatcgaactttgatgtagaaaccggcgaagcgctagtcgagcaggctacaggaatgatcacgcaggccttgagcttcgtgcagtacttcctcgttgccttcggtctcattgcactgctggttggtaccttcatcatcgcgaataccttctccatgattgtggctcagcgcatgcgtgagttcgctctcctgcgagccctgggtgcggcgccaggacagatcactcgctctgtggtgctggaagcaaccatcgttggcctcttcggctctgctcttggtgtgctgggtggtatgggcctcgtagcgatcatttcagctgtcctcaataacctgggcatgccgatgggatccagcgttggcttgactccttctgcagtggttaccgcgctcgtattgggcaccgttgtcaccattgtgagcgcgtgggctccggctcgtcgtgcaggtgaggttaagcctgttgaagcgatgcgcaacatggaaaccaccactatgcgttccatgatggggcgcacgatcaccggtggcatcgttctagcactcggcatcatctttgcgattgccggtgcgatgatgactgattcttccaccgctactcgttccatcctggtgggcattggtgcactgtttgtcatcgtgggtacgttcctcttctcaccagcgctctccatgcctgtggtgggtggcctgggcaaggttatcggtgcaccgtttggcagcgttggaagccttgctgcgaccaactccaagcgaaaccctcgccgtaccgcaactacagcgttcgcactgacgttgggcattgccttagtgactgcaattggcatgctttctgcaaccatgaaggacgcagtctccgacatgatggcggagcagtacaccgcagattacatcctgcagggaccaaccaacggttccatcaccatgccgaaggaatctgtcaatgatgttcgcgatgctgagggcgttgccgatgtcgtgctcgtttccatgaactctgcctcggtgaacggtcaggcttcatacagccagctgggccagtctgtaacctttgtcgctgacggcgacctgagcaaggtcatcagcacagaaagcattgatggctccctcgacttgagcaacccaggtgttgtgactaaccagacgtttgctgatgaaaacggctgggcagtaggcgatactctgcagcttgaatcaatggggcagaccatcggcgatatcgagttgatcggtaccttcaccggaaacgacgccatcggaaatatgatcatctccgaaagttccttggctgatacaccagcggcagacactgctgttcctcagatgatgctggtggtaggcgaagaaggctttgataaggaacaactgcgcaccaacttggaagacgcagtcgctgattacattgtcatctctgtgaaa

SEQ ID NO: 492 - protein, 542 aa, Corynebacterium glutamicum
LVVDSSGRYNVTITGLTTTETDSATALNLQMSEAGYLERYTDGATVPSVMLSAADGTTPQELVDALAAELGSNFDVETGEALVEQATGMITQALSFVQYFLVAFGLIALLVGTFIIANTFSMIVAQRMREFALLRALGAAPGQITRSVVLEATIVGLFGSALGVLGGMGLVAIISAVLNNLGMPMGSSVGLTPSAVVTALVLGTVVTIVSAWAPARRAGEVKPVEAMRNMETTTMRSMMGRTITGGIVLALGIIFAIAGAMMTDSSTATRSILVGIGALFVIVGTFLFSPALSMPVVGGLGKVIGAPFGSVGSLAATNSKRNPRRTATTAFALTLGIALVTAIGMLSATMKDAVSDMMAEQYTADYILQGPTNGSITMPKESVNDVRDAEGVADVVLVSMNSASVNGQASYSQLGQSVTFVADGDLSKVISTESIDGSLDLSNPGVVTNQTFADENGWAVGDTLQLESMGQTIGDIELIGTFTGNDAIGNMIISESSLADTPAADTAVPQMMLVVGEEGFDKEQLRTNLEDAVADYIVISVK

SEQ ID NO: 493 - DNA, 410 bp, Corynebacterium glutamicum
  CDS (1)..(387): FRXA01071
aacattctgtacgcgctgcttgctctgtctgtcattgttgccatcatcggcatcatcaacaccctggcactgaatgtgatcgagcgtcgccaggagatcggtatgctccgcgcagttggcgtgaagcgcggacaggtccgcaccatgatcaccttagaatctgttcagatcgccatctacggtgctgtgattggtatcgcgattggtcttggtctgggctgggcctttgtgacagtgatgtcaggcgaaggactagacgctgcggttagtatcccgtggggtcaggtcggactgatgcttgttggttccgctgtagtcggtgttatcgccgcgctgtggccggcagtcaaggcatctaggacaccacctttggatgcgattaccgactagttttagcggcagttgaatca

SEQ ID NO: 494 - protein, 129 aa, Corynebacterium glutamicum
NILYALLALSVIVAIIGIINTLALNVIERRQEIGMLRAVGVKRGQVRTMITLESVQIAIYGAVIGIAIGLGLGWAFVTVMSGEGLDAAVSIPWGQVGLMLVGSAVVGVIAALWPAVKASRTPPLDAITD

SEQ ID NO: 495 - DNA, 534 bp, Corynebacterium glutamicum
  CDS (101)..(511): RXN01075
gcggtgcgtgttcattagcaggtcaagcgcgtaattgagggctagactggttagtaccggatattctttttttctttagtttgtgggagtggagataactatggacaatccagtcaacatcctcaatgagcaggaagctttggagcgcctgcagtcggtgtctcttggtcgcgtggtggttcgtcgcagcgatgagatggacattttcccggtgaacttcattgtggataagggcgcaatttacattcgtacagctgagggcaacaagttgttcagcatgaatctcaaccacgatgtgctctttgaagccgatgaggtcaaggacggaaaggcctggtccgtggtggttcgtgcgaccgcagagattgtgcgcaagctggatgagatcgctactgccgacactttggagttgaagccttggattccaaccctgaagtccaactttgcccgtattgttccgaatgaaatcactgggcgggagttcaccctcggcgaggagcctgagcgctactagctttgccacatttcactaaa

SEQ ID NO: 496 - protein, 137 aa, Corynebacterium glutamicum
MDNPVNILNEQEALERLQSVSLGRVVVRRSDEMDIFPVNFIVDKGAIYIRTAEGNKLFSMNLNHDVLFEADEVKDGKAWSVVVRATAEIVRKLDEIATADTLELKPWIPTLKSNFARIVPNEITGREFTLGEEPERY

SEQ ID NO: 497 - DNA, 534 bp, Corynebacterium glutamicum; identical to SEQ ID NO: 495
  CDS (101)..(511): FRXA01075

SEQ ID NO: 498 - protein, 137 aa, Corynebacterium glutamicum; identical to SEQ ID NO: 496

SEQ ID NO: 499 - DNA, 1137 bp, Corynebacterium glutamicum
  CDS (101)..(1114): RXN01128
attcgagtacaaataaatttgagaacaaaaagatggggggaaatatgttaaagtgcgttatattgctttagcgaaagtaacttccatgcatcaacgttcgatgagcttcactttcattcgtacttttttcgtactttttggcatcacgttgttagtgtcatgcgttccagagcctcctgactcctacactaaagaatccactgtgctgcggtatcaggtctctgatttcaatctaaacttcgtggaattagcagttgcgcttgggtatttgaacaacattgagctccaagtagtcggatctgtacaaggcggcgttgagtccattgaatcgctcaaaaaggatgacattgacttcgcggcagtccccttcattggccttgttgcaggagagatagccaccggtgcgcccatcaaagcagtggccgcaagttacggaatttcccacgattcttcttctgcacttctagtccttaaagacagtgagatacacgaagtgcacgatctcattggcaaaacagttggcataaacaccctcggtgctctgggatctgcgatggttgagcgtcatctattcgacgccggtctcaccgaacctgagatcgtgagcgtcactcaacgtgcattacccggtgagtacttagaacaacgcctctaccaggggcaagttgatgcaatttgggtcaccgatagcgctaaacaccaagcgcttgaaactggagattttcggatcttggcagaggattcagaccttgtgcaggaactcaacactggctgcatggtggtgtcgcaaaaactcatcgacgagcaccccgcagtggttggagaattagtggatggagtagctcaggcaatcgagtttgaacgatcccactcccctgaagaagtgcgcgaagtttatttcaactacctcgaagcccatggtcagagtgatagaatatccagctttagatattgggagcattcgggcatcgcaacccgaggtggagtgctcagtgatagggagttcagcatgtggtcccactggattgaccgccaatacgacgtccccgatatcaatccagcaagtatttacaccaaccaattcaacccataccgaaaagtaaacccctcgccataaaaggcaagggggtcggcgtt

SEQ ID NO: 500 - protein, 338 aa, Corynebacterium glutamicum
MSFTFIRTFFVLFGITLLVSCVPEPPDSYTKESTVLRYQVSDFNLNFVELAVALGYLNNIELQVVGSVQGGVESIESLKKDDIDFAAVPFIGLVAGEIATGAPIKAVAASYGISHDSSSALLVLKDSEIHEVHDLIGKTVGINTLGALGSAMVERHLFDAGLTEPEIVSVTQRALPGEYLEQRLYQGQVDAIWVTDSAKHQALETGDFRILAEDSDLVQELNTGCMVVSQKLIDEHPAVVGELVDGVAQAIEFERSHSPEEVREVYFNYLEAHGQSDRISSFRYWEHSGIATRGGVLSDREFSMWSHWIDRQYDVPDINPASIYTNQFNPYRKVNPSP

SEQ ID NO: 501 - DNA, 1137 bp, Corynebacterium glutamicum; identical to SEQ ID NO: 499
  CDS (101)..(1114): FRXA01128

SEQ ID NO: 502 - protein, 338 aa, Corynebacterium glutamicum; identical to SEQ ID NO: 500

SEQ ID NO: 503 - DNA, 871 bp, Corynebacterium glutamicum
  CDS (101)..(871): RXN01134
gatatcttgaacttgacgctggctgaatacattcctgctgccgatgaaatgatcaagggcttcgacgaggcggctgaattcctgcgtcagcgatgcatttttgagtctcgaccaggttccatacaccgcgcagattgttccactggccgtgatcctcaccctgcttgatgcagaagaaatggccaccgcacgttcatgggatcgtttgaatcagtggttctggagcggtgtcttgggtgagctttatggctcgcctgctgtgatcgcacgttccggtcgcgataccgatcaagttgctgcgtggattcgtgaaggtgccggcgaaactgcggttgtgccaaagactattcgcgataccgttttccacgaatcacgtcttctcagtgcaacccaagacaccggagtgtggaagggtatcttcgcactgctcatgggcaggggagcacgcgactggcgcaccggacagcagtttgatcgctggacttttgatgagctgggttgcaatttccaccagattttccccaccaaatggtgcaaggaacgcggcatcgatcctgtccttacggaatcagtactgaaccgcaccccgatgggtcgccgtaccgaagtagtcatcggcgatacccctccatcccgctacctgtctcgtgttcaatccaagtcgctcatgggtgatgaggaattcgatcagatgctggatacccacctgctcagcgcggaagacctgcacagttccaacaccacgcacttctttgcttctcgacgcaccaacttcatcgacatggtcgaggatgccatcggtaaagcggtgatcagggacgtcaacgagtcagatctcaccggtggacacgatggtccctcggtacacggg

SEQ ID NO: 504 - protein, 257 aa, Corynebacterium glutamicum
LSLDQVPYTAQIVPLAVILTLLDAEEMATARSWDRLNQWFWSGVLGELYGSPAVIARSGRDTDQVAAWIREGAGETAVVPKTIRDTVFHESRLLSATQDTGVWKGIFALLMGRGARDWRTGQQFDRWTFDELGCNFHQIFPTKWCKERGIDPVLTESVLNRTPMGRRTEVVIGDTPPSRYLSRVQSKSLMGDEEFDQMLDTHLLSAEDLHSSNTTHFFASRRTNFIDMVEDAIGKAVIRDVNESDLTGGHDGPSVHG

SEQ ID NO: 505 - DNA, 459 bp, Corynebacterium glutamicum
  CDS (1)..(459): FRXA01134
agtgcaacccaagacaccggagtgtggaagggtatcttcgcactgctcatgggcaggggagcacgcgactggcgcaccggacagcagtttgatcgctggacttttgatgagctgggttgcaatttccaccagattttccccaccaaatggtgcaaggaacgcggcatcgatcctgtccttacggaatcagtactgaaccgcaccccgatgggtcgccgtaccgaagtagtcatcggcgatacccctccatcccgctacctgtctcgtgttcaatccaagtcgctcatgggtgatgaggaattcgatcagatgctggatacccacctgctcagcgcggaagacctgcacagttccaacaccacgcacttctttgcttctcgacgcaccaacttcatcgacatggtcgaggatgccatcggtaaagcggtgatcagggacgtcaacgagtcagatctcacc

SEQ ID NO: 506 - protein, 153 aa, Corynebacterium glutamicum
SATQDTGVWKGIFALLMGRGARDWRTGQQFDRWTFDELGCNFHQIFPTKWCKERGIDPVLTESVLNRTPMGRRTEVVIGDTPPSRYLSRVQSKSLMGDEEFDQMLDTHLLSAEDLHSSNTTHFFASRRTNFIDMVEDAIGKAVIRDVNESDLT

SEQ ID NO: 507 - DNA, 1056 bp, Corynebacterium glutamicum
  CDS (101)..(1033): RXN01140
tatccaacttcccgattttcaacgggattacgcttgggatgttgatcgcatccgaagccttataaccactgttcttcgtggttttccagtaggtgtgctgatggcactagacacccgcggcgaggaaatgcgtttccggccacgcgcgctgtccggcgccccagatacgggcaaggatccaggtcttttgcttctcgacggacaacagcgcctcaccaccctttatcattgcttcagtggcgatggctatgtaaatacggtggacttccgatcaaagaaagtgacccggaagttttatattgatgttgctaaggctgttgaatctccggtcatgtccgatgaggctattttttcagtcgacgaaaccggcaaaatcatctcccacttcggtccagtgatcgacggcggcatcaccgatttagaaacagcacttgctcatggttgccttccagtttctgtgctgctggatgataacggcactgatttcctctttgacctcgccgatatggcaggagaaggcgctcgcgaacacgcgaagcgcttccaatcacaaatcgttaagaccttagttagttacgacatcccaatgatccgactggatcgtgaaaccgccaagggtggaattggttccatctttgctcaggccaatagctctggcttgcagatggatgtctttgatttgctcaccgcggtgttcgcagccgatgaatcggtggagaccgaattctcactgcgtgatgactgggtgcgggttgaacgaaaccttcgccaacactccgcacttgatggcatcggcagcacggagttcctcaccgcagtagccctgttggtcagtgcccgcaagggacatgcgtctggttaccgtgaagatatcttgaacttgacgctggctgaatacattcctgctgccgatgaaatgatcaagggcttcgacgaggcggctgaattcctgcgtcagcgatgcatttttgagtctcgaccaggttccatacaccgcgcagattgttccactggccgtgatcctcaccctgcttgatgcagaagaaatggccaccg

SEQ ID NO: 508 - protein, 311 aa, Corynebacterium glutamicum
MALDTRGEEMRFRPRALSGAPDTGKDPGLLLLDGQQRLTTLYHCFSGDGYVNTVDFRSKKVTRKFYIDVAKAVESPVMSDEAIFSVDETGKIISHFGPVIDGGITDLETALAHGCLPVSVLLDDNGTDFLFDLADMAGEGAREHAKRFQSQIVKTLVSYDIPMIRLDRETAKGGIGSIFAQANSSGLQMDVFDLLTAVFAADESVETEFSLRDDWVRVERNLRQHSALDGIGSTEFLTAVALLVSARKGHASGYREDILNLTLAEYIPAADEMIKGFDEAAEFLRQRCIFESRPGSIHRADCSTGRDPHPA

SEQ ID NO: 509 - DNA, 886 bp, Corynebacterium glutamicum
  CDS (101)..(886): FRXA01140
tatccaacttcccgattttcaacgggattacgcttgggatgttgatcgcatccgaagccttataaccactgttcttcgtggttttccagtaggtgtgctgatggcactagacacccgcggcgaggaaatgcgtttccggccacgcgcgctgtccggcgccccagatacgggcaaggatccaggtcttttgcttctcgacggacaacagcgcctcaccaccctttatcattgcttcagtggcgatggctatgtaaatacggtggacttccgatcaaagaaagtgacccggaagttttatattgatgttgctaaggctgttgaatctccggtcatgtccgatgaggctattttttcagtcgacgaaaccggcaaaatcatctcccacttcggtccagtgatcgacggcggcatcaccgatttagaaacagcacttgctcatggttgccttccagtttctgtgctgctggatgataacggcactgatttcctctttgacctcgccgatatggcaggagaaggcgctcgcgaacacgcgaagcgcttccaatcacaaatcgttaagaccttagttagttacgacatcccaatgatccgactggatcgtgaaaccgccaagggtggaattggttccatctttgctcaggccaatagctctggcttgcagatggatgtctttgatttgctcaccgcggtgttcgcagccgatgaatcggtggagaccgaattctcactgcgtgatgactgggtgcgggttgaacgaaaccttcgccaacactccgcacttgatggcatcggcagcacggagttcctcaccgcagtagccctgttggtcagtgcccgcaagggacatgcgtctggttaccgtgaagatatcttgaacttgacg

SEQ ID NO: 510 - protein, 262 aa, Corynebacterium glutamicum
MALDTRGEEMRFRPRALSGAPDTGKDPGLLLLDGQQRLTTLYHCFSGDGYVNTVDFRSKKVTRKFYIDVAKAVESPVMSDEAIFSVDETGKIISHFGPVIDGGITDLETALAHGCLPVSVLLDDNGTDFLFDLADMAGEGAREHAKRFQSQIVKTLVSYDIPMIRLDRETAKGGIGSIFAQANSSGLQMDVFDLLTAVFAADESVETEFSLRDDWVRVERNLRQHSALDGIGSTEFLTAVALLVSARKGHASGYREDILNLT

SEQ ID NO: 511 - DNA, 723 bp, Corynebacterium glutamicum
  CDS (101)..(700): RXN01148
atagaacaagggtagccaaattcttggaaacagcgcgggcccccgaatccacaatgcgaatccacaatgtcacctgaagccgttaaagtaggtgatcattatgaccagcccagttgaaaacgttaagaaaaagccacgcccattggcgctgtcaccgtcgcgcgccggggattaccagcagtgtcccctgttgtatcgcttccgcgcgattgatcgcctgccagagcctaagaccgtcgcccaggtcaaaggcacgttggtgcacgctgtgttggaatatatgcacaagttgccgcgtgaagaacgcgaatatccagccatggtgaagcaactcaagcccacctgggcgcagatgtgtgaagaagacgcagagctcaaagagcttgttccagaagatgagctttatgatttcctcgtggattcccgcaccctgctgcgtggctactttgaaatggaaaatcctcaaggtttcgacgccaccgaatgcgaaatgtacgtggacactgtgctgcccaacggcgttcctgttcgtggttttatcgaccgtgtggataccgccccaccggccaagtccgagttatcgactacaagactggcaagaaaccaaagccgcagtggagccagcaagcgcagttccagatgctgttctatgcactggtctactggcgcatgttcaatgaaatcccagctcagcttcgtttaatgtacctcaaagtcaacgat

SEQ ID NO: 512 - protein, 200 aa, Corynebacterium glutamicum
MTSPVENVKKKPRPLALSPSRAGDYQQCPLLYRFRAIDRLPEPKTVAQVKGTLVHAVLEYMHKLPREEREYPAMVKQLKPTWAQMCEEDAELKELVPEDELYDFLVDSRTLLRGYFEMENPQGFDATECEMYVDTVLPNGVPVRGFIDRVDTAPPAKSELSTTRLARNQSRSGASKRSSRCCSMHWSTGACSMKSQLSFV

SEQ ID NO: 513 - DNA, 723 bp, Corynebacterium glutamicum; identical to SEQ ID NO: 511
  CDS (101)..(700): FRXA01148

SEQ ID NO: 514 - protein, 200 aa, Corynebacterium glutamicum; identical to SEQ ID NO: 512

SEQ ID NO: 515 - DNA, 543 bp, Corynebacterium glutamicum
  CDS (1)..(543): RXN01153
ccgtttttaagcccgatcgttacttccacgcacgcggtggtggcgtattccaccgcgcgtggatttggtgagcaccgggtgcgttgggactatgcgcaagagtccccactgcgcgatactcgtggctttgatctgcgccgataccaccaggcccctgtggtggatccgcacgccattggtgtggccaacgtgtttgtgcccaatggtgccaggttttatgtcgatcacgcgcacccggaatactcctccccagaggtcaccaatgcgtgggatgccatggtttacgacgccgctggtgaccacatccttatgcaggccgtctctgatgttgcgagtttcaccagccagaataggtctgtgttggacggccatgatccgtgtccagctttgaaaatctacaaaaacaatgtcgacggtaagggtgctagctacgggttccacgagaattacctctactcacgtgagacggattttgatgtgctggctcaggcattgatcccattttttgtgtgccggcaggtcatcatcggtgccggacgtgtg

SEQ ID NO: 516 - protein, 181 aa, Corynebacterium glutamicum
PFLSPIVTSTHAVVAYSTARGFGEHRVRWDYAQESPLRDTRGFDLRRYHQAPVVDPHAIGVANVFVPNGARFYVDHAHPEYSSPEVTNAWDAMVYDAAGDHILMQAVSDVASFTSQNRSVLDGHDPCPALKIYKNNVDGKGASYGFHENYLYSRETDFDVLAQALIPFFVCRQVIIGAGRV

SEQ ID NO: 517 - DNA, 543 bp, Corynebacterium glutamicum; identical to SEQ ID NO: 515
  CDS (1)..(543): FRXA01153

SEQ ID NO: 518 - protein, 181 aa, Corynebacterium glutamicum; identical to SEQ ID NO: 516

SEQ ID NO: 519 - DNA, 677 bp, Corynebacterium glutamicum
  CDS (39)..(677): RXN01154
ccggggaattccaggtcagtcagcgagcctgactaccattgagcaagaaaatttcactggaaaccacactcaaccgcggcattatcaacacccgcgatgaaccacacaccgacgctgatcactggggtcgcctgcacgtgatcatcggcgatgccaacatgtcgcagactgcgaatttcctcaaattcggcatgacctccctagtgctggatgccattgaggctggggtggatttctctgaactcaagctgaagaacgcagtgagtgaagtagcaaaggtctcccatgatctttcccttacccaccagctgcgattggcggatggttcagagctcaccgctattgatattctgcgccgctatttggacaaggtgcagccgtttgcagaaaccccagtggaacagcgtgtcactgcgctgtggggtgaagtgctggggctcctggagaatgatctgctctccaccagccatctccttgattggactgcaaaacttgccctgatcaagtcttttgaggcgcgtgggctgtccattaacgatcccaagatgtacctcattgacctgcagtacagcgatattgatccacagaagagtctgtatcacgcactggtatccaaggggcggatgaaaacactgtgcagtgcgcaggacattgcagatgcagcggccacttcaccg

SEQ ID NO: 520 - protein, 213 aa, Corynebacterium glutamicum
LSKKISLETTLNRGIINTRDEPHTDADHWGRLHVIIGDANMSQTANFLKFGMTSLVLDAIEAGVDFSELKLKNAVSEVAKVSHDLSLTHQLRLADGSELTAIDILRRYLDKVQPFAETPVEQRVTALWGEVLGLLENDLLSTSHLLDWTAKLALIKSFEARGLSINDPKMYLIDLQYSDIDPQKSLYHALVSKGRMKTLCSAQDIADAAATSP

SEQ ID NO: 521 - DNA, 603 bp, Corynebacterium glutamicum
  CDS (1)..(603): FRXA01154
gagggcattatcaacacccgcgatgaaccacacaccgacgctgatcactggggtcgcctgcacgtgatcatcggcgatgccaacatgtcgcagactgcgaatttcctcaaattcggcatgacctccctagtgctggatgccattgaggctggggtggatttctctgaactcaagctgaagaacgcagtgagtgaagtagcaaaggtctcccatgatctttcccttacccaccagctgcgattggcggatggttcagagctcaccgctattgatattctgcgccgctatttggacaaggtgcagccgtttgcagaaaccccagtggaacagcgtgtcactgcgctgtggggtgaagtgctggggctcctggagaatgatctgctctccaccagccatctccttgattggactgcaaaacttgccctgatcaagtcttttgaggcgcgtgggctgtccattaacgatcccaagatgtacctcattgacctgcagtacagcgatattgatccacagaagagtctgtatcacgcactggtatccaaggggcggatgaaaacactgtgcagtgcgcaggacattgcagatgcagcggccacttcaccg

SEQ ID NO: 522 - protein, 201 aa, Corynebacterium glutamicum
EGIINTRDEPHTDADHWGRLHVIIGDANMSQTANFLKFGMTSLVLDAIEAGVDFSELKLKNAVSEVAKVSHDLSLTHQLRLADGSELTAIDILRRYLDKVQPFAETPVEQRVTALWGEVLGLLENDLLSTSHLLDWTAKLALIKSFEARGLSINDPKMYLIDLQYSDIDPQKSLYHALVSKGRMKTLCSAQDIADAAATSP

SEQ ID NO: 523 - DNA, 1570 bp, Corynebacterium glutamicum
  CDS (101)..(1570): RXN01155
acagcttgctggatgaaatcgacggactgttggaaaacaacgccgaggaattcgttcgttcctatgtacaaaagggtggcgaatagtcactgtgagtaccgtggaatccgcattgacccgcaggatcatgggcattgaaacggagtatggcctcacctttgttgatggtgattccaaaaagcttcgcccagatgagatagctcgaaggatgtttcgtcccatcgtggagaaatattccagctctaatatcttcatacccaatggttcccggttgtatcttgatgtgggttcccacccggagtacgccaccgccgagtgtgataatttgacccagctgatcaattttgaaaaagctggcgatgttattgcagatcgcatggctgtagatgccgaagagtcgctggcgaaagaagacattgctgggcaggtgtacctgtttaaaaacaatgtcgattccgtgggcaattcttatggctgccacgaaaactaccttgtgggtcgctccatgccgttgaaggcgttgggtaaaaggctgatgccgtttctgattacccgccagctcatctgcggcgccggcaggatccatcaccccaatcctttggataaaggcgaatccttccccttgggctactgcatatcccagcgctctgaccacgtgtgggagggcgtatcaagtgccaccactagatcacgccccattatcaacacccgtgatgagccacatgcggattcccattcttaccgcaggctgcacgtgattgtgggtgatgccaacatggcagagcccagcatcgcgttgaaggtcggctccacgttgctggttctggaaatgattgaggcagatttcggtttgcccagcttagagcttgccaatgatattgcctcaattagggaaatctcccgcgatgcaacaggatccacactgttgtccctgaaagatggcaccaccatgactgccttgcagatccagcaggtggtctttgagcatgcctcgaagtggttggagcagcgccccgaaccagaattttctggcacctccaacacagagatggcccgcgtgctggatctgtggggtcgcatgttgaaagcgattgagtccggtgatttcagcgaagtggatacagaaattgactgggtgatcaaaaagaagctcattgatcgtttcattcagcgcggcaaccttgggttggatgatccaaaacttgcccaagtggacttgacttatcacgatattaggccaggtagaggcctatttagcgtgctgcaaagccgcggcatgatcaaacggtggactactgatgaggcgattttagctgcggtggataccgctcctgatacaacacgtgctcatttgcgcgggcgaatccttaaagcggcggatactctgggagtacctgtgactgtcgattggatgcgtcacaaggtcaaccgaccggagccacaatcggtggaattgggggatcctttttcccttttaaatcctcaacaaccagcccaagaaactgctttgagcattcttctcctaggcggaacctcttacattgccggtgagattgccacgttgacgttt

SEQ ID NO: 524 - protein, 490 aa, Corynebacterium glutamicum
VESALTRRIMGIETEYGLTFVDGDSKKLRPDEIARRMFRPIVEKYSSSNIFIPNGSRLYLDVGSHPEYATAECDNLTQLINFEKAGDVIADRMAVDAEESLAKEDIAGQVYLFKNNVDSVGNSYGCHENYLVGRSMPLKALGKRLMPFLITRQLICGAGRIHHPNPLDKGESFPLGYCISQRSDHVWEGVSSATTRSRPIINTRDEPHADSHSYRRLHVIVGDANMAEPSIALKVGSTLLVLEMIEADFGLPSLELANDIASIREISRDATGSTLLSLKDGTTMTALQIQQVVFEHASKWLEQRPEPEFSGTSNTEMARVLDLWGRMLKAIESGDFSEVDTEIDWVIKKKLIDRFIQRGNLGLDDPKLAQVDLTYHDIRPGRGLFSVLQSRGMIKRWTTDEAILAAVDTAPDTTRAHLRGRILKAADTLGVPVTVDWMRHKVNRPEPQSVELGDPFSLLNPQQPAQETALSILLLGGTSYIAGEIATLTF

SEQ ID NO: 525 - DNA, 1465 bp, Corynebacterium glutamicum
  CDS (101)..(1465): FRXA01155
acagcttgctggatgaaatcgacggactgttggaaaacaacgccgaggaattcgttcgttcctatgtacaaaagggtggcgaatagtcactgtgagtaccgtggaatccgcattgacccgcaggatcatgggcattgaaacggagtatggcctcacctttgttgatggtgattccaaaaagcttcgcccagatgagatagctcgaaggatgtttcgtcccatcgtggagaaatattccagctctaatatcttcatacccaatggttcccggttgtatcttgatgtgggttcccacccggagtacgccaccgccgagtgtgataatttgacccagctgatcaattttgaaaaagctggcgatgttattgcagatcgcatggctgtagatgccgaagagtcgctggcgaaagaagacattgctgggcaggtgtacctgtttaaaaacaatgtcgattccgtgggcaattcttatggctgccacgaaaactaccttgtgggtcgctccatgccgttgaaggcgttgggtaaaaggctgatgccgtttctgattacccgccagctcatctgcggcgccggcaggatccatcaccccaatcctttggataaaggcgaatccttccccttgggctactgcatatcccagcgctctgaccacgtgtgggagggcgtatcaagtgccaccactagatcacgccccattatcaacacccgtgatgagccacatgcggattcccattcttaccgcaggctgcacgtgattgtgggtgatgccaacatggcagagcccagcatcgcgttgaaggtcggctccacgttgctggttctggaaatgattgaggcagatttcggtttgcccagcttagagcttgccaatgatattgcctcaattagggaaatctcccgcgatgcaacaggatccacactgttgtccctgaaagatggcaccaccatgactgccttgcagatccagcaggtggtctttgagcatgcctcgaagtggttggagcagcgccccgaaccagaattttctggcacctccaacacagagatggcccgcgtgctggatctgtggggtcgcatgttgaaagcgattgagtccggtgatttcagcgaagtggatacagaaattgactgggtgatcaaaaagaagctcattgatcgtttcattcagcgcggcaaccttgggttggatgatccaaaacttgcccaagtggacttgacttatcacgatattaggccaggtagaggcctatttagcgtgctgcaaagccgcggcatgatcaaacggtggactactgatgaggcgattttagctgcggtggataccgctcctgatacaacacgtgctcatttgcgcgggcgaatccttaaagcggcggatactctgggagtacctgtgactgtcgattggatgcgtcacaaggtcaaccgaccggagccacaatcggtggaattgggggatcct

SEQ ID NO: 526 - protein, 455 aa, Corynebacterium glutamicum
VESALTRRIMGIETEYGLTFVDGDSKKLRPDEIARRMFRPIVEKYSSSNIFIPNGSRLYLDVGSHPEYATAECDNLTQLINFEKAGDVIADRMAVDAEESLAKEDIAGQVYLFKNNVDSVGNSYGCHENYLVGRSMPLKALGKRLMPFLITRQLICGAGRIHHPNPLDKGESFPLGYCISQRSDHVWEGVSSATTRSRPIINTRDEPHADSHSYRRLHVIVGDANMAEPSIALKVGSTLLVLEMIEADFGLPSLELANDIASIREISRDATGSTLLSLKDGTTMTALQIQQVVFEHASKWLEQRPEPEFSGTSNTEMARVLDLWGRMLKAIESGDFSEVDTEIDWVIKKKLIDRFIQRGNLGLDDPKLAQVDLTYHDIRPGRGLFSVLQSRGMIKRWTTDEAILAAVDTAPDTTRAHLRGRILKAADTLGVPVTVDWMRHKVNRPEPQSVELGDP

SEQ ID NO: 527 - DNA, 519 bp, Corynebacterium glutamicum
  CDS (101)..(496): RXN01167
gtgtcgttttatttgcacactagcaggtaaactgtgtgagacgaattcttttgcggcaacttggaggccgcattctagtaggcaaaggactgatacctagatggcagatcgcgttcttcgtggcagccgcatgggcgccgtgagctatgagacggatagggaccacgatctggctcctcgccagctcgtgaagtacaagaccgcagacggggaaatctatgaggttcccttcgctgatgatgcggaaatccccgaggagtggatgtgcaagaacggtaagctaggcatcctcatggaaggtgagggagtcgagtccaagccggtcaagcctccacgtactcactgggatatgttgcgtgagcgtcgctcaattgaagagctggatgtgctgctggaagagcgcatcgaggcacttcgtaagcgtcgtcgcaatgcagcgaaactgctgaaggctcagcaagaggctgaagaagcagaaaaggcagctgaagaggtttaatcttcctgcctaagttagaa

SEQ ID NO: 528 - protein, 132 aa, Corynebacterium glutamicum
MADRVLRGSRMGAVSYETDRDHDLAPRQLVKYKTADGEIYEVPFADDAEIPEEWMCKNGKLGILMEGEGVESKPVKPPRTHWDMLRERRSIEELDVLLEERIEALRKRRRNAAKLLKAQQEAEEAEKAAEEV

SEQ ID NO: 529 - DNA, 344 bp, Corynebacterium glutamicum
  CDS (1)..(321): FRXA01167
cctcgccagctcgtgaagtacaagaccgcagacggggaaatctatgaggttcccttcgctgatgatgcggaaatccccgaggagtggatgtgcaagaacggtaagctaggcatcctcatggaaggtgagggagtcgagtccaagccggtcaagcctccacgtactcactgggatatgttgcgtgagcgtcgctcaattgaagagctggatgtgctgctggaagagcgcatcgaggcacttcgtaagcgtcgtcgcaatgcagcgaaactgctgaaggctcagcaagaggctgaagaagcagaaaaggcagctgaagaggtttaatcttcctgcctaagttagaa

SEQ ID NO: 530 - protein, 107 aa, Corynebacterium glutamicum
PRQLVKYKTADGEIYEVPFADDAEIPEEWMCKNGKLGILMEGEGVESKPVKPPRTHWDMLRERRSIEELDVLLEERIEALRKRRRNAAKLLKAQQEAEEAEKAAEEV

SEQ ID NO: 531 - DNA, 1119 bp, Corynebacterium glutamicum
  CDS (101)..(1096): RXN01169
tcttgatcggaatcggcgcaaacatcgtctacgaacacctcagcgcgtaaccctcggcgcattatcctcagacagcttttagcgcaaacaaggagcatcattgaaacgggtcgttgaagcgtgggatagatttcaaatcccactgtatatcacggctcttatcgccggagcactggtgggtttgcagtggccaggctctacagggggtttcgaaagcgccattaacccagcgttaatggcgctgctttatgccacttttctcggtattccgatcactcggattggtgcagcgctgaaagatctgagatttctcatagtgctcatgtccgtcaattttgttgcagtgcctctggtggcttttgcgttgagcagattcattgcgggtgatgaggcgcttctaatcggatttttactggtgattctcgcgccgtgcattgattacgtcattgtctttgctggtttggccagggccgcccaagacaagctccttgccgccacgccaatattaatgcttgtccaaatcctgctgatccccgtcttcctggctgtttttgtgggttcagatgcccttggctcaatctctttcggcccatttgtagaagcatttttcctcctgattctcattccacttgttgctgctgcgggaactcagcaagtggcaagaaagtggcaggtaggacgtacaattatggctgctgcagaagcaatcatggtgcctttaatgatgctgacgttgttcgctgtcatcgcatcgcaagtggaagctgtgagtggtcaattcaccgatatcgccacagtagtgccactatatgtcgcctttttgatggtgatgattccaattggtggcgggatatccaaactcggtggcttaggtttcaaagagcaacgagccatcgtttttagcggagcaacccgtaactctttggtcgttttacctttagcgttagcacttcccgcaggcctggaaatagcggccgtcgtagttgtcactcaaaccctcgtggaactgattggcatggttgtctacgtgcgcatcatccctttaattttccatgaaaagcagacatacaggaaactttcaggcataggggagtcatgaaacagaacggcaagctaagg

SEQ ID NO: 532 - protein, 332 aa, Corynebacterium glutamicum
LKRVVEAWDRFQIPLYITALIAGALVGLQWPGSTGGFESAINPALMALLYATFLGIPITRIGAALKDLRFLIVLMSVNFVAVPLVAFALSRFIAGDEALLIGFLLVILAPCIDYVIVFAGLARAAQDKLLAATPILMLVQILLIPVFLAVFVGSDALGSISFGPFVEAFFLLILIPLVAAAGTQQVARKWQVGRTIMAAAEAIMVPLMMLTLFAVIASQVEAVSGQFTDIATVVPLYVAFLMVMIPIGGGISKLGGLGFKEQRAIVFSGATRNSLVVLPLALALPAGLEIAAVVVVTQTLVELIGMVVYVRIIPLIFHEKQTYRKLSGIGES

SEQ ID NO: 533 - DNA, 590 bp, Corynebacterium glutamicum
  CDS (1)..(567): FRXA01169
atccccgtcttcctggctgtttttgtgggttcagatgcccttggctcaatctctttcggcccatttgtagaagcatttttcctcctgattctcattccacttgttgctgctgcgggaactcagcaagtggcaagaaagtggcaggtaggacgtacaattatggctgctgcagaagcaatcatggtgcctttaatgatgctgacgttgttcgctgtcatcgcatcgcaagtggaagctgtgagtggtcaattcaccgatatcgccacagtagtgccactatatgtcgcctttttgatggtgatgattccaattggtggcgggatatccaaactcggtggcttaggtttcaaagagcaacgagccatcgtttttagcggagcaacccgtaactctttggtcgttttacctttagcgttagcacttcccgcaggcctggaaatagcggccgtcgtagttgtcactcaaaccctcgtggaactgattggcatggttgtctacgtgcgcatcatccctttaattttccatgaaaagcagacatacaggaaactttcaggcataggggagtcatgaaacagaacggcaagctaagg

SEQ ID NO: 534 - protein, 189 aa, Corynebacterium glutamicum
IPVFLAVFVGSDALGSISFGPFVEAFFLLILIPLVAAAGTQQVARKWQVGRTIMAAAEAIMVPLMMLTLFAVIASQVEAVSGQFTDIATVVPLYVAFLMVMIPIGGGISKLGGLGFKEQRAIVFSGATRNSLVVLPLALALPAGLEIAAVVVVTQTLVELIGMVVYVRIIPLIFHEKQTYRKLSGIGES

SEQ ID NO: 535 - DNA, 738 bp, Corynebacterium glutamicum
  CDS (101)..(715): RXN01173
agatctgtttctatgtattaaagatcacaccgagtggtggaatttcctcaagtgatttacccacaatggactttgttgatacccaattcgagaaaggccaatgcacgtgagcactcttccaaacaagaaactgcgtactcgcattttcgcaggcaccgctgccgtcgcactgtcacttggtgttgcgtcttgctcaaacgcagaagatgctgtggatagcgcaacagatgctgccaactctgcaacctccgccgcgggatctgcaattaacgatgccaccggcacttccagcgcatccaccacagagccttccggaacctctggatccgactccgggtctgactctgctggaggagacaccactgaagtagaaagcgccgatgggtccaccatcagcatcccaactgccgtcgtcaccgctgcaaatgctgcaggattcagtaccccggaatccgtggaagaaggcccgaatggtgagtcattggtgacgttccctgaaggctacattgttaactctgcagaaggtggtgcacaagcactggtcggcatgatcggtgaaacctggatcggcgaaggcggactatccgcggcagtgggtctcccaactgggcctgaagaagcaacaacaaatggttggactcaacagttcacatctggagtaattagctggcttgatgatggatcaggacagttcgcagcttctgttgaacctgcttaagggaatctcacctggcctcc

SEQ ID NO: 536 - protein, 205 aa, Corynebacterium glutamicum
MHVSTLPNKKLRTRIFAGTAAVALSLGVASCSNAEDAVDSATDAANSATSAAGSAINDATGTSSASTTEPSGTSGSDSGSDSAGGDTTEVESADGSTISIPTAVVTAANAAGFSTPESVEEGPNGESLVTFPEGYIVNSAEGGAQALVGMIGETWIGEGGLSAAVGLPTGPEEATTNGWTQQFTSGVISWLDDGSGQFAASVEPA

SEQ ID NO: 537 - DNA, 738 bp, Corynebacterium glutamicum; identical to SEQ ID NO: 535
  CDS (101)..(715): FRXA01173

SEQ ID NO: 538 - protein, 205 aa, Corynebacterium glutamicum; identical to SEQ ID NO: 536

SEQ ID NO: 539 - DNA, 873 bp, Corynebacterium glutamicum
  CDS (101)..(850): RXN01174
atatcgcaaccgctgttaatgaagaggaagaggctcgcgatatcgcgaagctgtgccaggagatggtggaattagctcggaatattgagaagttgaggtaatgagcaacatgcagggaaacgattccaagaaatctagcggcgcgagtcgtgcggagagcccactgatcaagttccggacattgattatcgtcatctttgtcatcttgatcgttggtttggcatctattgcagtgggacctgtcgtgtaccagctcatcatgggacctggtgtgaaaaccgaaggaatccaggctgatggcgcagcacctgcgtccaccgacatgaacggcacctgggatgttgccccagggagtattccaaacaccacctcagctggattcaccttcgctgagatcctgccaggcgaagaaaagatcacctccggctcaaccactggtgtcactggcgaagtggtcatcgaggataactccctgatctctggtctgattaccgtcaacatgactcacatcaccaccgatcaggaaaagcgcgacatcaacgtgcgcactaagctcttccacaccgatcagtacccagaagcaacctttgaggttaccgattccgttgatctttctgcgctcccagacaccggatccattgctcaggttgtcatcccaggcgagttgaccatccacggtgaaaccaaggctgtggagcctacctttgatgtacttcgtactggtgaccaagttatcgtggcttccgatatcgaaatcaaccgcctcgacttcggtgtagaaaccccagagttcatcgccgcaaagatcaatgagaccggcgagatcaacgtccgaatcgtattggagaaataaaccatgatggcatcacggat

SEQ ID NO: 540 - protein, 250 aa, Corynebacterium glutamicum
MSNMQGNDSKKSSGASRAESPLIKFRTLIIVIFVILIVGLASIAVGPVVYQLIMGPGVKTEGIQADGAAPASTDMNGTWDVAPGSIPNTTSAGFTFAEILPGEEKITSGSTTGVTGEVVIEDNSLISGLITVNMTHITTDQEKRDINVRTKLFHTDQYPEATFEVTDSVDLSALPDTGSIAQVVIPGELTIHGETKAVEPTFDVLRTGDQVIVASDIEINRLDFGVETPEFIAAKINETGEINVRIVLEK

SEQ ID NO: 541 - DNA, 873 bp, Corynebacterium glutamicum; identical to SEQ ID NO: 539
  CDS (101)..(850): FRXA01174

SEQ ID NO: 542 - protein, 250 aa, Corynebacterium glutamicum; identical to SEQ ID NO: 540

SEQ ID NO: 543 - DNA, 1401 bp, Corynebacterium glutamicum
  CDS (101)..(1378): RXN01229
  VARIANT 119: Xaa = Tyr or Ser
  VARIANT 120: Xaa = Asn, Thr, His, or Pro
  VARIANT 121, 266: Xaa = Glu or Val
  VARIANT 122, 303: Xaa = Asn or Thr
  VARIANT 123, 301: Xaa = Glu, Asp, Gln, or Pro
  VARIANT 124, 265: Xaa = Glu, Ala, Lys, or Asn
  VARIANT 125: Xaa = Glu, Ala, His, Pro, or Gln
  VARIANT 126, 239, 283: Xaa = Ala
  VARIANT 127, 251: Xaa = Glu, Ala, Asp, Lys, Thr, or Asn
  VARIANT 128: Xaa = Ile or Thr
  VARIANT 129: Xaa = Gly or Glu
  VARIANT 130: Xaa = Lys, Ile, or Asn
  VARIANT 132: Xaa = Lys, Gln, Asn, or His
  VARIANT 175: Xaa = Leu or Ser
  VARIANT 178, 230, 295: Xaa = Ile or Leu
  VARIANT 180, 211: Xaa = Pro
  VARIANT 181, 223, 244: Xaa = Ala or Ser
  VARIANT 187: Xaa = Val
  VARIANT 188, 198, 219, 302, 306: Xaa = Gly or Val
  VARIANT 193: Xaa = Val or Leu
  VARIANT 204, 282: Xaa = Ala or Thr
  VARIANT 205: Xaa = Gln or Pro
  VARIANT 206, 220,: Xaa = Val or Ile
  VARIANT 207: Xaa = Ser or Pro
  VARIANT 210, 298: Xaa = Phe or Ser
  VARIANT 214, 238, 243, 252, 257, 269: Xaa = Gly or Ala
  VARIANT 216, 217, 225, 249, 258, 319: Xaa = Gly or Arg
  VARIANT 218, 236: Xaa = Leu or Phe
  VARIANT 221, 286: Xaa = Gly
  VARIANT 226, 299: Xaa = Leu or Pro
  VARIANT 234: Xaa = Lys or Thr
  VARIANT 235: Xaa = Gln or Leu
  VARIANT 237, 291: Xaa = Gly, Val, Trp, Leu, Cys, or Phe
  VARIANT 240, 256: Xaa = Val or Ala
  VARIANT 241, 254: Xaa = Val, Leu, or Phe
  VARIANT 242: Xaa = Gly, Cys, or STOP codon
  VARIANT 245: Xaa = Gly, Ala, Trp, Ser, or STOP codon
  VARIANT 247: Xaa = Lys or Gln
  VARIANT 248: Xaa = Arg or Lys
  VARIANT 250: Xaa = Gly, Glu, Arg, Lys, Asp, Asn,; or Ser
  VARIANT 253: Xaa = Gly, Val, Cys, or Phe
  VARIANT 259: Xaa = Cys, Phe, Arg, or Leu
  VARIANT 260, 310: Xaa = Cys or Phe
  VARIANT 261, 262: Xaa = Arg
  VARIANT 263, 296: Xaa = Arg or Leu
  VARIANT 264, 289: Xaa = Glu, Val, Asp, Gln, Leu,; or His
  VARIANT 267: Xaa = Val, Met,or Ile
  VARIANT 268: Xaa = Gly, Val, Ser, or Ile
  VARIANT 270: Xaa = Asp or Ala
  VARIANT 271: Xaa = Asp, Val, His, or Leu
  VARIANT 272: Xaa = Leu
  VARIANT 273, 307: Xaa = Val, Ala, Leu, or Pro
  VARIANT 274: Xaa = Asp, Ala, or Glu
  VARIANT 275: Xaa = Thr or His
  VARIANT 276: Xaa = Gln, His, or Pro
  VARIANT 277, 278, 285: Xaa = Gly, Pro, Arg, or Ala
  VARIANT 279, 284: Xaa = Ala or Pro
  VARIANT 280: Xaa = Gly, Trp, or STOP codon
  VARIANT 281: Xaa = Arg, Trp, Thr, Ser, or Cys
  VARIANT 287: Xaa = Gly, Ala, Trp, Cys, or Ser
  VARIANT 288, 300, 317: Xaa = Arg or Pro
  VARIANT 290: Xaa = Met, Ile, or Leu
  VARIANT 292: Xaa = Trp, Ser, Cys, Arg, or Pro
  VARIANT 293: Xaa = Gly, Val, Arg, or Leu
  VARIANT 294: Xaa = Arg, Ser, Thr, Cys, or STOP codon
  VARIANT 297: Xaa = Val or Phe
  VARIANT 304: Xaa = Lys, Asn, Thr, Gln, His, or Pro
  VARIANT 305: Xaa = Met, Ile, Thr, Leu, or Pro
  VARIANT 308: Xaa = Arg, Met, Ile, Trp, Leu,; or STOP codon
  VARIANT 309: Xaa = Gly, Glu, Asp, Cys, Tyr,; or STOP codon
  VARIANT 311: Xaa = Phe
  VARIANT 312: Xaa = Trp, Leu, Arg, or STOP codon
  VARIANT 313: Xaa = Gly, Glu, Arg, or Lys
  VARIANT 314: Xaa = Gly, Glu, Cys, Tyr,; or STOP codon
  VARIANT 315: Xaa = Gly, Glu, Asp, Arg, Gln, or His
  VARIANT 316: Xaa = Tyr, Leu, Phe, Gln, His, Leu,; or STOP codon
  VARIANT 318: Xaa = Gly, Val, Arg, Ser, or Ile
tagccccgaaagacggcgagggttggctctgcttcgttgtgggaaaactaggcccttaataagctgtgcttatagggtctcctgcaccgataaaggactgatgatcatctccactaacaccgctcaccccctgcacgaaccgcacgtacccagccaccacaatcgtatgaatactctgcgtgccggtgtgctgggtgctaatgacggtatcgtctccattgctgcgctactgctcggtgtgatcgccaccggcgccagtgacaccgtcgtgttcggcgctggtttggcctcaacgatcgcgggggcggtatctatggctctcggtgagtacgtctctgtctcctcacagcgtgataccgaacgggtgctcatcgcaaaagaagcgaaggagctggccgaagacccgacggccgagcacgtcgagctgtcggagatcctacactcctacggcatctmcmmtgwgamtsmrrassmsgcsrmmaycgrgawmgggmasggcgacgccttgggcgcccaccttcagctcgagctcggtattgataatgagcaactgaccagccccttggccgccgccttctcctcggccgtggctttcctgctcggagcactgctgccgatggtgtyggtattcmtygccccykcaggctgggacgccggcgtkgkcttcgtagtcacgstgctggtcctggcggkkaccgggttcatctcarcccmgrtcycgggtacctycccmatgcgcgsgtgcsggsgcttkgkgrtcggkggtkccctcsgscyggccctgaccmtaccgtcttggaawcwattskksgssgcmgywktmkgwgsykcsksrrramararrrggrrkrmkgskkktktkgtggykgsksgkykttktcgwcgmcksswsramgwrrtsrkcgscgmcswcctysywgmmsaycmkssgsskscwkgrwssrcygcyscmssmggskskcsmswkwtrkksyssskswswmtwckyktttyycyycsgsmrgkwamcmmmmykgkksywwkrrrwtktttyykrrrarrmsrmywmcsrrkwrggccaccactgtcaggcgagattctgcttgctggcctcggcggtgagataggcatgggggaaccgaggatcccagtgactactggtgacctggaaacccgcggtctccagtgcctgggcaagctcgggcagtggccaccggtaggcggtggccacgggatgatacatcggttccagagaaggcccggagaaaaaggacatcagcaggccaccaccatcctccaccgccatccgcagtgcgaccagggcgtcgggcagctcgcccgggcccatgtggatcagggagtaccaggccaacaggcctgcccagcgcttcggcgagtctgagaggtcggtaatagtgccgt

SEQ ID NO: 544 - protein, 426 aa, Corynebacterium glutamicum
  VARIANT 119: Xaa = Tyr or Ser
  VARIANT 120: Xaa = Asn, Thr, His, or Pro
  VARIANT 121, 266: Xaa = Glu or Val
  VARIANT 122, 303: Xaa = Asn or Thr
  VARIANT 123, 301: Xaa = Glu, Asp, Gln, or Pro
  VARIANT 124, 265: Xaa = Glu, Ala, Lys, or Asn
  VARIANT 125: Xaa = Glu, Ala, His, Pro, or Gln
  VARIANT 126, 239, 283: Xaa = Ala
  VARIANT 127, 251: Xaa = Glu, Ala, Asp, Lys, Thr, or Asn
  VARIANT 128: Xaa = Ile or Thr
  VARIANT 129: Xaa = Gly or Glu
  VARIANT 130: Xaa = Lys, Ile, or Asn
  VARIANT 132: Xaa = Lys, Gln, Asn, or His
  VARIANT 175: Xaa = Leu or Ser
  VARIANT 178, 230, 295: Xaa = Ile or Leu
  VARIANT 180, 211: Xaa = Pro
  VARIANT 181, 223, 244: Xaa = Ala or Ser
  VARIANT 187: Xaa = Val
  VARIANT 188, 198, 219, 302, 306: Xaa = Gly or Val
  VARIANT 193: Xaa = Val or Leu
  VARIANT 204, 282: Xaa = Ala or Thr
  VARIANT 205: Xaa = Gln or Pro
  VARIANT 206, 220,: Xaa = Val or Ile
  VARIANT 207: Xaa = Ser or Pro
  VARIANT 210, 298: Xaa = Phe or Ser
  VARIANT 214, 238, 243, 252, 257, 269: Xaa = Gly or Ala
  VARIANT 216, 217, 225, 249, 258, 319: Xaa = Gly or Arg
  VARIANT 218, 236: Xaa = Leu or Phe
  VARIANT 221, 286: Xaa = Gly
  VARIANT 226, 299: Xaa = Leu or Pro
  VARIANT 234: Xaa = Lys or Thr
  VARIANT 235: Xaa = Gln or Leu
  VARIANT 237, 291: Xaa = Gly, Val, Trp, Leu, Cys, or Phe
  VARIANT 240, 256: Xaa = Val or Ala
  VARIANT 241, 254: Xaa = Val, Leu, or Phe
  VARIANT 242: Xaa = Gly, Cys, or STOP codon
  VARIANT 245: Xaa = Gly, Ala, Trp, Ser, or STOP codon
  VARIANT 247: Xaa = Lys or Gln
  VARIANT 248: Xaa = Arg or Lys
  VARIANT 250: Xaa = Gly, Glu, Arg, Lys, Asp, Asn,; or Ser
  VARIANT 253: Xaa = Gly, Val, Cys, or Phe
  VARIANT 259: Xaa = Cys, Phe, Arg, or Leu
  VARIANT 260, 310: Xaa = Cys or Phe
  VARIANT 261, 262: Xaa = Arg
  VARIANT 263, 296: Xaa = Arg or Leu
  VARIANT 264, 289: Xaa = Glu, Val, Asp, Gln, Leu,; or His
  VARIANT 267: Xaa = Val, Met,or Ile
  VARIANT 268: Xaa = Gly, Val, Ser, or Ile
  VARIANT 270: Xaa = Asp or Ala
  VARIANT 271: Xaa = Asp, Val, His, or Leu
  VARIANT 272: Xaa = Leu
  VARIANT 273, 307: Xaa = Val, Ala, Leu, or Pro
  VARIANT 274: Xaa = Asp, Ala, or Glu
  VARIANT 275: Xaa = Thr or His
  VARIANT 276: Xaa = Gln, His, or Pro
  VARIANT 277, 278, 285: Xaa = Gly, Pro, Arg, or Ala
  VARIANT 279, 284: Xaa = Ala or Pro
  VARIANT 280: Xaa = Gly, Trp, or STOP codon
  VARIANT 281: Xaa = Arg, Trp, Thr, Ser, or Cys
  VARIANT 287: Xaa = Gly, Ala, Trp, Cys, or Ser
  VARIANT 288, 300, 317: Xaa = Arg or Pro
  VARIANT 290: Xaa = Met, Ile, or Leu
  VARIANT 292: Xaa = Trp, Ser, Cys, Arg, or Pro
  VARIANT 293: Xaa = Gly, Val, Arg, or Leu
  VARIANT 294: Xaa = Arg, Ser, Thr, Cys, or STOP codon
  VARIANT 297: Xaa = Val or Phe
  VARIANT 304: Xaa = Lys, Asn, Thr, Gln, His, or Pro
  VARIANT 305: Xaa = Met, Ile, Thr, Leu, or Pro
  VARIANT 308: Xaa = Arg, Met, Ile, Trp, Leu,; or STOP codon
  VARIANT 309: Xaa = Gly, Glu, Asp, Cys, Tyr,; or STOP codon
  VARIANT 311: Xaa = Phe
  VARIANT 312: Xaa = Trp, Leu, Arg, or STOP codon
  VARIANT 313: Xaa = Gly, Glu, Arg, or Lys
  VARIANT 314: Xaa = Gly, Glu, Cys, Tyr,; or STOP codon
  VARIANT 315: Xaa = Gly, Glu, Asp, Arg, Gln, or His
  VARIANT 316: Xaa = Tyr, Leu, Phe, Gln, His, Leu,; or STOP codon
  VARIANT 318: Xaa = Gly, Val, Arg, Ser, or Ile
MIISTNTAHPLHEPHVPSHHNRMNTLRAGVLGANDGIVSIAALLLGVIATGASDTVVFGAGLASTIAGAVSMALGEYVSVSSQRDTERVLIAKEAKELAEDPTAEHVELSEILHSYGIXXXXXXXXXXXXGXGDALGAHLQLELGIDNEQLTSPLAAAFSSAVAFLLGALLPMVXVFXAXXGWDAGXXFVVTXLVLAXTGFISXXXXGTXXMRXCXXXXXXGXLXXALTXPSWXXXXXXXXXXXXXXXXXXXXXVXXXXXXXXXXXXXXXXXXXXXXXXXXXXXXXXXXXXXXXXXXXXXXXXXXXXXXXXXXXXXXXXPPLSGEILLAGLGGEIGMGEPRIPVTTGDLETRGLQCLGKLGQWPPVGGGHGMIHRFQRRPGEKGHQQATTILHRHPQCDQGVGQLARAHVDQGVPGQQACPALRRV

SEQ ID NO: 545 - DNA, 793 bp, Corynebacterium glutamicum
  CDS (101)..(793): FRXA01229
tagccccgaaagacggcgagggttggctctgcttcgttgtgggaaaactaggcccttaataagctgtgcttatagggtctcctgcaccgataaaggactgatgatcatctccactaacaccgctcaccccctgcacgaaccgcacgtacccagccaccacaatcgtatgaatactctgcgtgccggtgtgctgggtgctaatgacggtatcgtctccattgctgcgctactgctcggtgtgatcgccaccggcgccagtgacaccgtcgtgttcggcgctggtttggcctcaacgatcgcgggggcggtatctatggctctcggtgagtacgtctctgtctcctcacagcgtgataccgaacgggtgctcatcgcaaaagaagcgaaggagctggccgaagacccgacggccgagcacgtcgagctgtcggagatcctacactcctacggcatctcccctgagactgcgaaccaggcggccaccgagatcgggcagggcgacgccttgggcgcccaccttcagctcgagctcggtattgataatgagcaactgaccagccccttggccgccgccttctcctcggccgtggctttcctgctcggagcactgctgccgatggtgtcggtattcatcgcccctgcaggctgggacgccggcgtggtcttcgtagtcacgctgctggtcctggcggtgaccgggttcatctcagcccagatctcgggtacctccccaatgcgcgcgtgcgggcgcttggtgatcggtggtgccctcggcctggccctaacctacggt

SEQ ID NO: 546 - protein, 231 aa, Corynebacterium glutamicum
MIISTNTAHPLHEPHVPSHHNRMNTLRAGVLGANDGIVSIAALLLGVIATGASDTVVFGAGLASTIAGAVSMALGEYVSVSSQRDTERVLIAKEAKELAEDPTAEHVELSEILHSYGISPETANQAATEIGQGDALGAHLQLELGIDNEQLTSPLAAAFSSAVAFLLGALLPMVSVFIAPAGWDAGVVFVVTLLVLAVTGFISAQISGTSPMRACGRLVIGGALGLALTYG

SEQ ID NO: 547 - DNA, 630 bp, Corynebacterium glutamicum
  CDS (101)..(607): RXN01246
gggaaggaggagaaggctgctgtgagctctgcagcccccgtccgctgactttcaatgcttcatggactccccgatacacaacctccgaaagggaacccccatgaagcgcactatcaccatcgccgctctcgccttgacctccaccctggttttgtccgcctgcgcagataacactgagggagaaaacaccgacaccacgaccatcgccactacgtccgcccccgacaccaccgaaacgaccggggccaccacggatcctgagacagagacgggggcggccggagaggtctccgccgagcacaatgatgcggacatcatgttcgcgcagatgatgatcccgcatcaccaacaggccgtggagatgagtgaaatcctcctggccaaggacgatatcccggccgaggtcatcgagttcacccagggtgttatcgatgcccagggcccggagatcgaccggatgaataccatgctcgagacctgggaagaagatccggtcaccggtgatatgggtgagatggaccatggcgggatgagtggaatgatgagcgaggaggacatgacagccctcgaggacgcccagggcacccgaggctgcccggctctaccttgagcagatgaccgcccaccatg

SEQ ID NO: 548 - protein, 169 aa, Corynebacterium glutamicum
MKRTITIAALALTSTLVLSACADNTEGENTDTTTIATTSAPDTTETTGATTDPETETGAAGEVSAEHNDADIMFAQMMIPHHQQAVEMSEILLAKDDIPAEVIEFTQGVIDAQGPEIDRMNTMLETWEEDPVTGDMGEMDHGGMSGMMSEEDMTALEDAQGTRGCPALP

SEQ ID NO: 549 - DNA, 739 bp, Corynebacterium glutamicum
  CDS (101)..(739): FRXA01246
gggaaggaggagaaggctgctgtgagctctgcagcccccgtccgctgactttcaatgcttcatggactccccgatacacaacctccgaaagggaacccccatgaagcgcactatcaccatcgccgctctcgccttgacctccaccctggttttgtccgcctgcgcagataacactgagggagaaaacaccgacaccacgaccatcgccactacgtccgcccccgacaccaccgaaacgaccggggccaccacggatcctgagacagagacgggggcggccggagaggtctccgccgagcacaatgatgcggacatcatgttcgcgcagatgatgatcccgcatcaccaacaggccgtggagatgagtgaaatcctcctggccaaggacgatatcccggccgaggtcatcgagttcacccagggtgttatcgatgcccagggcccggagatcgaccggatgaataccatgctcgagacctgggaagaagatccggtcaccggtgatatgggtgagatggaccatggcgggatgagtggaatgatgagcgaggaggacatgacagccctcgaggacgcccagggcaccgaggctgcccggctctaccttgagcagatgaccgcccaccatgagggcgcggtcgatatggcccgcgatgaggtcactgatggccagaacccgcaggccatcgctctggctgagcaggtcattgaagatcaggaggccgagatcgccgagatt

SEQ ID NO: 550 - protein, 213 aa, Corynebacterium glutamicum
MKRTITIAALALTSTLVLSACADNTEGENTDTTTIATTSAPDTTETTGATTDPETETGAAGEVSAEHNDADIMFAQMMIPHHQQAVEMSEILLAKDDIPAEVIEFTQGVIDAQGPEIDRMNTMLETWEEDPVTGDMGEMDHGGMSGMMSEEDMTALEDAQGTEAARLYLEQMTAHHEGAVDMARDEVTDGQNPQAIALAEQVIEDQEAEIAEI

SEQ ID NO: 551 - DNA, 471 bp, Corynebacterium glutamicum
  CDS (1)..(471): RXN01249
tctcagattgtggcggtgtcttctcacggtcttaccacgatccaggagattgacgtgaaacgagcagcgatcgcagccgccgcccttaccctcgccctcacggggtgttcggccgccgacccggaacccaccgccgacgggacggtgtcccaggatacattcctgactacccatggcctggccgccatggacgcggtggagatcattgatcacctcgaccggcagaaggtcactgagcgtcccacggatctgatcgcctcagtgcgtgccgatgaactgctgctctcgagcgatgaccaggaagtcgtggtcgatcttcccgacaatcagacgtatgtctcgatcgcaccctacctcaactccacccacgactgcttctaccacagcctcacgacctgcctgggggatctcgacaatgaggatatccatgtcatgatcaccgatgaagcgaccggcgaggtcctgttcgat

SEQ ID NO: 552 - protein, 157 aa, Corynebacterium glutamicum
SQIVAVSSHGLTTIQEIDVKRAAIAAAALTLALTGCSAADPEPTADGTVSQDTFLTTHGLAAMDAVEIIDHLDRQKVTERPTDLIASVRADELLLSSDDQEVVVDLPDNQTYVSIAPYLNSTHDCFYHSLTTCLGDLDNEDIHVMITDEATGEVLFD

SEQ ID NO: 553 - DNA, 400 bp, Corynebacterium glutamicum
  CDS (101)..(400): FRXA01249
gaattgacgtggaaccgagcagcgatcgcagcccgccgcccttaccctcgccctcacggggtgttcggccgccgacccggaacccaccgccgacgggacggtgtcccaggatacattcctgactacccatggcctggccgccatggacgcggtggagatcattgatcacctcgaccggcagaaggtcactgagcgtcccacggatctgatcgcctcagtgcgtgccgatgaactgctgctctcgagcgatgaccaggaagtcgtggtcgatcttcccgacaatcagacgtatgtctcgatcgcaccctacctcaactccacccacgactgcttctaccacagcctcacgacctgcctgggggatctcgacaatgaggatatccatgtcatgatcaccgat

SEQ ID NO: 554 - protein, 100 aa, Corynebacterium glutamicum
VSQDTFLTTHGLAAMDAVEIIDHLDRQKVTERPTDLIASVRADELLLSSDDQEVVVDLPDNQTYVSIAPYLNSTHDCFYHSLTTCLGDLDNEDIHVMITD

SEQ ID NO: 555 - DNA, 432 bp, Corynebacterium glutamicum
  CDS (101)..(409): RXN01251
tgtaagccgagagcgaacctgccaaaagtaaggggcgggttcgcggtgacgtcggtaggatcgagcgaagaaaccaacaaacttcttaggagccattctcatgacccagccagatatgtcccagatcctcgcccaagctcagcagatgcaggctcaactacaggccgctcagcaggaaatcctggcaaccaccgttgtcggaaatgcaggaaacgggctggttaccgtcactatggccggcaacggcgaggtctccgcagtgaccgttgacccaaaggtcgttgaccctgaagatgtcgaaaccctacaggaccttctgctcggtgcattcaaggatgcccataacaaggtcgcaaacgttgctgaagagaagatgggcccactatcccagggcatgggtggcctcttctaattagttgctaaacgcagggc

SEQ ID NO: 556 - protein, 103 aa, Corynebacterium glutamicum
MTQPDMSQILAQAQQMQAQLQAAQQEILATTVVGNAGNGLVTVTMAGNGEVSAVTVDPKVVDPEDVETLQDLLLGAFKDAHNKVANVAEEKMGPLSQGMGGLF

SEQ ID NO: 557 - DNA, 432 bp, Corynebacterium glutamicum
  CDS (101)..(409): FRXA01251
tgtaagccgagagcgaacctgccaaaagtaaggggcgggttcgcggtgacgtcggtaggatcgagcgaagaaaccaacaaacttcttaggagccattctcatgacccagccagatatgtcccagatcctcgcccaagctcagcagatgcaggctcaactacaggccgctcagcaggaaatcctggcaaccaccgttgtcggaaatgcaggaaacgggctggttaccgtcactatggccggcaacggcgaggtcttcgcagtgaccgttgacccaaaggtcgttgaccctgaagatgtcgaaaccctacaggaccttctgctcggtgcattcaaggatgcccataacaaggtcgcaaacgttgctgaagagaagatgggcccactatcccagggcatgggtggcctcttctaattagttgctaaacgcagggc

SEQ ID NO: 558 - protein, 103 aa, Corynebacterium glutamicum
MTQPDMSQILAQAQQMQAQLQAAQQEILATTVVGNAGNGLVTVTMAGNGEVFAVTVDPKVVDPEDVETLQDLLLGAFKDAHNKVANVAEEKMGPLSQGMGGLF

SEQ ID NO: 559 - DNA, 1035 bp, Corynebacterium glutamicum
  CDS (101)..(1012): RXN01263
agtggcctttggagttattttgatgacggtatcggcgactgctgggatcctcctctttttatctccaaatagaagccaagctgcgccaccccaatttagtttgaccccgtatgatccaaccgctgtaaataaggagtcggaaaaagaagcagcaaagaatctgtttggcgctgaggcgttgacagtggatccggatgccggtgaggttgttgatcgagtagataatttttatccgacgactgctaaggcaaaacgagattacccaagtaactatgcagcgggttgtcaccaagaagtcaatgagactagtcctgagtcatgtgtttatggtgataaaaattctgatttttctgtagcacttgtcggtgactcccacgctggtcattggcttcctgccttggaaccaattgctgaagcacaggggtggagattggaagtttatacaaagtcacagtgtccactcataagcactgcgatcaaacttggtgaaactttttatgcagaatgctatgagtggaatgaaaaattacttgctaagctaactggaccttctgcaccaaatcatgtgattgtaagtagccaacgttacgcttctgcaaatccgttaatcgatagtgtcgcgacgggaaccgtttccgaaggatatgaaatggcatggaattcattaaaagatgcaggtgtttctatttctgtacttcttgatactcctcggccgcaaattgatatcccagaatgtgtagcatcaaaccgcgataatctctcagaatgttcagttcaccggagcgttgcgcttgggactgaagctcatcctcagcaaaaaactgcagctcaaaatatagacgtgcctgtattggatttgagtaattggatttgtccggaagaatattgctccgctgttatcggaaatgttttggtatacagggattcacatcatttgaccgctacgtatgctcgtagtctctctagcgcattatggaatgagttggttgcctcaaatggtgagccttttaagtaagaggtagttgttcaagtagc

SEQ ID NO: 560 - protein, 304 aa, Corynebacterium glutamicum
LTPYDPTAVNKESEKEAAKNLFGAEALTVDPDAGEVVDRVDNFYPTTAKAKRDYPSNYAAGCHQEVNETSPESCVYGDKNSDFSVALVGDSHAGHWLPALEPIAEAQGWRLEVYTKSQCPLISTAIKLGETFYAECYEWNEKLLAKLTGPSAPNHVIVSSQRYASANPLIDSVATGTVSEGYEMAWNSLKDAGVSISVLLDTPRPQIDIPECVASNRDNLSECSVHRSVALGTEAHPQQKTAAQNIDVPVLDLSNWICPEEYCSAVIGNVLVYRDSHHLTATYARSLSSALWNELVASNGEPFK

SEQ ID NO: 561 - DNA, 1035 bp, Corynebacterium glutamicum; identical to SEQ ID NO: 559
  CDS (101)..(1012): FRXA01263

SEQ ID NO: 562 - protein, 304 aa, Corynebacterium glutamicum; identical to SEQ ID NO: 560

SEQ ID NO: 563 - DNA, 1158 bp, Corynebacterium glutamicum
  CDS (101)..(1135): RXN01266
gattgtgaagttttatatctgtcatattctggtgattttcgccctgctcatgaagtggcggacgagcaatggcccgatatagatttagtaaggaactaaaatgccaaaagtaagtgtggttactggtttttataaccgctgtgagcatttagaacgaaccattgagtctattcttaaccaaacttatagcgattttgaattaattgtttttgatgatgcatcgacagatggaacagcttcacgattgttagagttaaaagaaaaatatgatgatccgcgtttccgatttatcattcatgaagagaataaaggtttcgtaaaagggttatcagaagcaatttctggagctaaagggcagtatattgcagtccagggatcaggcgatgtatctcttcctcgccgtttagagcttcaggtagagtttctagacgcgaatccttcggtaggtgctgtgggtggtgctatctataatattcaagaagatacgggaacacgcaacccacagagatttgaaaagccaattgctacattcgatgatttattgacatctaatccgttcactcacggagaagtgatgtatcgcttagacctttataagagtataggtgggtatcgaagtggctttacttttgctcaagatcgtgatttatggttgaggatggcgaaaaaagcagatctgggtatcattccagattttctttatcaccgttacacacttttagatggtgtctctttcgtcccggataaaactatacgtcagcgatgcttttcagaagctgcggtgcgactggcattaatgccagaagaggaaggagctttagcctactctaggctggaagctgaagggcctactgccgtagttcctatcgctgatagagctgttcagaaatttgtccctaaagcggctattcgcttatgtctatatggtgctccggaaactggtttacacatggctcgagactatatccagaaccctctgcgccgtaccatagttgtagttttgatcagcatctattcgtctagattaattaagcctcttcaagatattctatataagtctatttttaagggggtctcgatttctaaacctattaagagttcactcgtgaagtttacaagaagaattcaagggaagtagcgaaaaaccgcatctaccaa

SEQ ID NO: 564 - protein, 345 aa, Corynebacterium glutamicum
MPKVSVVTGFYNRCEHLERTIESILNQTYSDFELIVFDDASTDGTASRLLELKEKYDDPRFRFIIHEENKGFVKGLSEAISGAKGQYIAVQGSGDVSLPRRLELQVEFLDANPSVGAVGGAIYNIQEDTGTRNPQRFEKPIATFDDLLTSNPFTHGEVMYRLDLYKSIGGYRSGFTFAQDRDLWLRMAKKADLGIIPDFLYHRYTLLDGVSFVPDKTIRQRCFSEAAVRLALMPEEEGALAYSRLEAEGPTAVVPIADRAVQKFVPKAAIRLCLYGAPETGLHMARDYIQNPLRRTIVVVLISIYSSRLIKPLQDILYKSIFKGVSISKPIKSSLVKFTRRIQGK

SEQ ID NO: 565 - DNA, 1158 bp, Corynebacterium glutamicum; identical to SEQ ID NO: 563
  CDS (101)..(1135): FRXA01266

SEQ ID NO: 566 - protein, 345 aa, Corynebacterium glutamicum; identical to SEQ ID NO: 564

SEQ ID NO: 567 - DNA, 1041 bp, Corynebacterium glutamicum
  CDS (101)..(1018): RXN01275
cgccatactaggctcggccttttcgacgggaactcggataggcttctgtaaaaccatccccgttgaagagagactcgtggctgaaataaccaccccattaatggaaaaaattcgctcacccgcagtccaatcagatgcactgcaggtttttaaatcagcacttgctgcgacagtcacgtggtggatttcggttaacctccttaactcccaactaccctttttagctccctgggtagcgttaatgacgatgcaattcaccgtctaccacacctttatcagtggaattcagactgcaattgcttctgtcatcggagttggactttcctttgtcataggcacttacttagacgtaagtgtgtggacttttggccttgcaatggtcataggattaataggtgcacgagtaccaaagctccgcgcggaaggaataggtattgctactacatccatttttcttcttgcctccgggtttgatgatcaacaaccccttctatacgaccgtattttagagatcctgctcggcgtggctgttgccatagccatcaacctcatcatctttcctcccttacgcgaccaggaggcaaacatggtggtaggaaacttagatcggaggatgggtgaggttttacaaaaaatggccgatgagcttgcagaaaagtggaatatcgacaatgcagatgagtggctggaagaaattaattctattaacaatgacctagaaaaagcgtggcactccgtgcggttcgttcgcgaaagccgtcgagttaatcctcgtaaaatccgcatccaagagggccgcccccagcctacggaaacaagttatgaatcaaacctcaccagcattgatgaagggatcgctcatttacgccaccttgcccgtactcttcgtgataccccgattatagattccgactggggatccagtattccagcaacagtgggtatcccttatgcacgatgccggagctttgctcgcagatccgaatcaggaaatagatcctatccgcgaccggctctctaaactttcaagtgagatgagtg

SEQ ID NO: 568 - protein, 306 aa, Corynebacterium glutamicum
MEKIRSPAVQSDALQVFKSALAATVTWWISVNLLNSQLPFLAPWVALMTMQFTVYHTFISGIQTAIASVIGVGLSFVIGTYLDVSVWTFGLAMVIGLIGARVPKLRAEGIGIATTSIFLLASGFDDQQPLLYDRILEILLGVAVAIAINLIIFPPLRDQEANMVVGNLDRRMGEVLQKMADELAEKWNIDNADEWLEEINSINNDLEKAWHSVRFVRESRRVNPRKIRIQEGRPQPTETSYESNLTSIDEGIAHLRHLARTLRDTPIIDSDWGSSIPATVGIPYARCRSFARRSESGNRSYPRPAL

SEQ ID NO: 569 - DNA, 1041 bp, Corynebacterium glutamicum; identical to SEQ ID NO: 567
  CDS (101)..(1018): FRXA01275

SEQ ID NO: 570 - protein, 306 aa, Corynebacterium glutamicum; identical to SEQ ID NO: 568

SEQ ID NO: 571 - DNA, 885 bp, Corynebacterium glutamicum
  CDS (101)..(862): RXN01281
ggacaacctcatcaaatgcaaacatgcgccaccgcgtcccggaaaaccaggggcgataccgcgcttgagtgcgaggtgccgtcaattcccaactacaagagtgggactcagccgttcacattatcagctagccgcagaaaacaccaaatcccttgttagaatggttcccatgactgttcctcaaggaaacgaaccagcaaagaagctcgccactgaccttaaccgaaaccaagtcgtggatgaactttctgcagctgtttcccgaggtcaactcactttggaggaatttgaagatcgctcctccaaagcatggaatgcccgccacttagacactcttgtagagctgatctctgatgtgaacgacaatccctacactctgcttggtcagcaatttcccggcgcctcctatgcgccggcggcctacgagaccactcccccagcgatgcccaatgtgtcagatcctgtaaatattgtccgcaacaggattaccggcaacccgaatggctccaaaatgtcggtctcgtttatgggtggcaccgtgcgcaaaggtggatggcatgtgcctaatgttcacacatccttcgccatgatgggcggcaatcagatcgatttgcgcgacgccttcctggaaagcgaccgcattcagatcaacgcctacacattcatgggtggcatcgagattattgttcccgagggtgtttttgtcatttgtgatggcatgggcattttcggcggcttcgaacagtctgtggacaaggccggtgcactcaatcccgcgcgcctgccaagcaacgcgcccacggtccacatcaaaggcctggcgttcatgggcggagtcagcgtagtcaccaagaaaaacatttaaaaagcttgtcgacgcgcccc

SEQ ID NO: 572 - protein, 254 aa, Corynebacterium glutamicum
VGLSRSHYQLAAENTKSLVRMVPMTVPQGNEPAKKLATDLNRNQVVDELSAAVSRGQLTLEEFEDRSSKAWNARHLDTLVELISDVNDNPYTLLGQQFPGASYAPAAYETTPPAMPNVSDPVNIVRNRITGNPNGSKMSVSFMGGTVRKGGWHVPNVHTSFAMMGGNQIDLRDAFLESDRIQINAYTFMGGIEIIVPEGVFVICDGMGIFGGFEQSVDKAGALNPARLPSNAPTVHIKGLAFMGGVSVVTKKNI

SEQ ID NO: 573 - DNA, 885 bp, Corynebacterium glutamicum; identical to SEQ ID NO: 571
  CDS (101)..(862): FRXA01281

SEQ ID NO: 574 - protein, 254 aa, Corynebacterium glutamicum; identical to SEQ ID NO: 572

SEQ ID NO: 575 - DNA, 1206 bp, Corynebacterium glutamicum
  CDS (101)..(1183): RXN01296
taaaactcctgttcgaaattgcccagacaggtgtccaccaacactgctacattgcattggagatccagaatcgatcactctacgaccaggaaaaactttcatgtccatcgagcaagcaatcacttcactctccgcaagagtgcgggaactaaagcccatcatcgagactgaagaagccaccaaaaccgcactgatcatcccctttatcagcaacgttctcggctacgacgtcactgatcctcgtgaagtcattccggaatacactgctgatgttggcgtcaaaaagggtgagaaggtcgacttcgctatcaaaaccggcgatgatttccacttcctcatcgaatgcaaaaaggtcggctccccactcagcctcgatcacgctaaccagctcgtccgctatttcaatgtcacagacaccgaatttgccattctcaccaacggcgaaatctaccaattctatggacaactcgatgcagccaaccgcatggatgcaaaaccattcatgaccttggatttgaacaatattgatgcccgtcagttccctcatttggaaatgtgtacccgcaagcatttcaacccacaagcgctagccgccaacgctgaagaactgaagtacattgctgaattgaagaaagtcatcgcgaatcaattccaagaacctgacgtagaaatcgtcaagatgcttgcggcgacagtcaccacaaagcgtatgactgcacaaaatctggaattcttcacccgcttggttaatactgcgtcttcccagttcctcaaagacgaggtcaatcgtagattgcgctccgcccaagtctttgaggatcctgtccaaacacaaggtgctgatgcagaaacaccagcagaggacgaagcagtaatcgaagaagtggtttcagaaatcgtgacgacagaagaggaaatccacggtcattcaattgtccgtgcaatttgctgctcagaggtatcggcacaagaaatcaccatgcgtgacgcaaaatcctactgcgctattctcttccaagacaacaaccgaaagccaatcgcccgtttctactttgatcgcaagattccacgcatcggcatcttcaatgctgaaggcgagcaggaacactttgatttggaatccatcgaagatatctacaaccacgctgatcttctgcattcccgcgtcgtagcattgaacgcttaagttctgcctttagttctgca

SEQ ID NO: 576 - protein, 361 aa, Corynebacterium glutamicum
MSIEQAITSLSARVRELKPIIETEEATKTALIIPFISNVLGYDVTDPREVIPEYTADVGVKKGEKVDFAIKTGDDFHFLIECKKVGSPLSLDHANQLVRYFNVTDTEFAILTNGEIYQFYGQLDAANRMDAKPFMTLDLNNIDARQFPHLEMCTRKHFNPQALAANAEELKYIAELKKVIANQFQEPDVEIVKMLAATVTTKRMTAQNLEFFTRLVNTASSQFLKDEVNRRLRSAQVFEDPVQTQGADAETPAEDEAVIEEVVSEIVTTEEEIHGHSIVRAICCSEVSAQEITMRDAKSYCAILFQDNNRKPIARFYFDRKIPRIGIFNAEGEQEHFDLESIEDIYNHADLLHSRVVALNA

SEQ ID NO: 577 - DNA, 1206 bp, Corynebacterium glutamicum; identical to SEQ ID NO: 575
  CDS (101)..(1183): FRXA01296

SEQ ID NO: 578 - protein, 361 aa, Corynebacterium glutamicum; identical to SEQ ID NO: 576

SEQ ID NO: 579 - DNA, 1131 bp, Corynebacterium glutamicum
  CDS (101)..(1108): RXN01306
tgttttagaggtagagcgaaacgtgcctgtaaaactggcgctcgctgtgctcgaagaccacccagacaatcaccccgctccgaaggagaatcgctaagccatgactgaatggtatgtcgttttacccgccactattctactcatcgcgctgtctgcgtttttcgtcatcattgagttcgctttgcttgcagctaggcggaaccggttagaggagactgtggaaacctcgcggtcttcccgcgctgcgttgcgaagcctcaatgaacttactctcatgctcgcgggcgcgcagttgggaatcaccatggtgactttcgcgttgggtgctatcacgaagccgtgggttcattatgctttgatgccgctcttcgaatgggcgcgtataccgctggttatggcagatgtcattgcgtttattttgtcgctgtttatcgtaacgtttctgcacttggtcatcggcgaaatggctccgaaatcctgggcaatcgcgcatccggagacggcacttcgaactatcgcgattcccgcacggggcttcattaacctgtttcgtccattgctgcagtggatcaacaaaatggcgaacgatttggtccgcaaagttggtgaaactcccgttgatcgagctgcagctggtggctatgacaccgataccctccatgccctcattgagcattcccgagaaactggcgctctggatcagcaatccgccgcccaaatcagcggaattatcaagctggataaaatcacggtcggtcaaaccctgaccgcatctccatttacgcacagcgccagcgccacggttgctgaggtgcaagccgcagctcagcgcagtggcagcttgcgtgtgcttatcgacgccccctcccaccttttcccacacgtcattcatgtgcgagacacccttggtgcctcgccagacgagaaggcttcgaagtggtctcgcccaatcctcaccgttgctgagaccgacacgttacaccaagcgctggaatacatgcgggagcataacgagcagatcagtgcggtgctttccgctgatgggaaaacggtgcttggtgtaataacttgggatcacatcttgaaatacctgtggcctgcatcggtgtagctaatttgaggtgcgctgaa

SEQ ID NO: 580 - protein, 336 aa, Corynebacterium glutamicum
MTEWYVVLPATILLIALSAFFVIIEFALLAARRNRLEETVETSRSSRAALRSLNELTLMLAGAQLGITMVTFALGAITKPWVHYALMPLFEWARIPLVMADVIAFILSLFIVTFLHLVIGEMAPKSWAIAHPETALRTIAIPARGFINLFRPLLQWINKMANDLVRKVGETPVDRAAAGGYDTDTLHALIEHSRETGALDQQSAAQISGIIKLDKITVGQTLTASPFTHSASATVAEVQAAAQRSGSLRVLIDAPSHLFPHVIHVRDTLGASPDEKASKWSRPILTVAETDTLHQALEYMREHNEQISAVLSADGKTVLGVITWDHILKYLWPASV

SEQ ID NO: 581 - DNA, 1107 bp, Corynebacterium glutamicum
  CDS (77)..(1084): FRXA01306
cgtgcctgtaaaatgcgctcgctctgctgaagaccacccagacaatcaccccgctccgaaggagaatcgataagccatgactgaatggtatgtcgttttacccgccactattctactcatcgcgctgtctgcgtttttcgtcatcattgagttcgctttgcttgcagctaggcggaaccggttagaggagactgtggaaacctcgcggtcttcccgcgctgcgttgcgaagcctcaatgaacttactctcatgctcgcgggcgcgcagttgggaatcaccatggtgactttcgcgttgggtgctatcacgaagccgtgggttcattatgctttgatgccgctcttcgaatgggcgcgtataccgctggttatggcagatgtcattgcgtttattttgtcgctgtttatcgtaacgtttctgcacttggtcatcggcgaaatggctccgaaatcctgggcaatcgcgcatccggagacggcacttcgaactatcgcgattcccgcacggggcttcattaacctgtttcgtccattgctgcagtggatcaacaaaatggcgaacgatttggtccgcaaagttggtgaaactcccgttgatcgagctgcagctggtggctatgacaccgataccctccatgccctcattgagcattcccgagaaactggcgctctggatcagcaatccgccgcccaaatcagcggaattatcaagctggataaaatcacggtcggtcaaaccctgaccgcatctccatttacgcacagcgccagcgccacggttgctgaggtgcaagccgcagctcagcgcagtggcagcttgcgtgtgcttatcgacgccccctcccaccttttcccacacgtcattcatgtgcgagacacccttggtgcctcgccagacgagaaggcttcgaagtggtctcgcccaatcctcaccgttgctgagaccgacacgttacaccaagcgctggaatacatgcgggagcataacgagcagatcagtgcggtgctttccgctgatgggaaaacggtgcttggtgtaataacttgggatcacatcttgaaatacctgtggcctgcatcggtgtagctaatttgaggtgcgctgaa

SEQ ID NO: 582 - protein, 336 aa, Corynebacterium glutamicum; identical to SEQ ID NO: 580

SEQ ID NO: 583 - DNA, 423 bp, Corynebacterium glutamicum
  CDS (101)..(400): RXN01324
tcctcaacccaatgcttgccggcattgcgatggccttcagttcagttttcgtcgtctccaattccttgcgtctgcgaggattcaaagcaaggagcaactaatgtccaacagcgaatgccacacccacggttacatcgaagaaaagcagcgttacctcgcacgcctcaaaagaatcgaaggccaaacccgaggcattcaccgcatgatcgacgaggaacaatactgcatcgacatcctcacgcagatctccgcagtgaactccgcactcaaaaacgtggcgttcggcctcctcgacgatcacctcgctcactgtgtcaaagaagcagctgacctcggcggcgacgaactcgacgcaaaactcaaagaagtttccgacgccatcgcccgcttcagtaaggcctaaacggatccggtggcattgga

SEQ ID NO: 584 - protein, 100 aa, Corynebacterium glutamicum
MSNSECHTHGYIEEKQRYLARLKRIEGQTRGIHRMIDEEQYCIDILTQISAVNSALKNVAFGLLDDHLAHCVKEAADLGGDELDAKLKEVSDAIARFSKA

SEQ ID NO: 585 - DNA, 2520 bp, Corynebacterium glutamicum
  CDS (101)..(2497): RXN01331
ctaaactcgtctctcgtatctttcagtcatttatgtctgataagcaggcgcgtgcgccacacaattggcacaatcacaagaaagtgaagtgggaacctagatgctgacgacactatggattgcggtgttggtatttaccgttccaggattggtcgtctcgtgggtttctggccttaaagtgccctgggctatcgcagcctccatcccagccaccttcggtatttacggcctgtccgcctggttgctgggcttgtgggagatgcgttttgatctccattctgtagttatttccacattggttttcgctgcggttgctttggtatggcgcttgttttttgtcggtggttggcttgtacgtcggcgtaaagcacgtatccgcaggcagacgctcgcggatgaagagcgggcagaaaatgctgaggtatctgcaggggagcctgccgaatcgagcacaaacgaagcagccgaatctgaatctgaaacctcggagcgtcgcggaatctggcgcgtgatctttgattacatgcgcgacggtggcatcttggatcaccgttggctgctgcctgccgcaggtgctatcactggtgcgtggctgatcattgatcgtgccgttgatctgctcttgagcaccgagcatggtttgggcgatatcgtccaaggctgggatgtccattggcatgcttcgactgtccgttttatagatgagaccggcattgcgtcatccacgatgatggggcagctgcgcaatattgaaacgcagcaagatctgttctacccaagcgcatggcatgctggtgcatgggtgctgtcggatgtcggaaatctgacgattgttgaagccaccaacctcactggcattgtgctgtccggattgttgctgccgttagctgttgcactgattgcatggcggatgatcaacaatcgtggactgaccgcgcagattggtgcgggctttgctggactgatcaccattgcctctccggtactgttctgggttggtaactacgtgggtgcgtggccttatgttgctgcgatcggtgcttcaggtgtggtgcttgcgctgtttatgtccactccgtctgtgccggtaagaatctttgccgcagcattggcgttcatgggtatgttccagctgcatccagccccatccaccatcgtgatcatggtgttgctgctgtggtggctgctcaaactcgtggtggttccaagccagaaagtgaagggctggaaggcgggcatcggtatccgtttgaaggatgtcggcatcctggccatcacgggcatcatcggtgtgctcttcatgctgcctcaggtgatttcaggttccgaacaaaccgaagatgtgctgtcatattctgctgaggaacaagtcacccgcagcgagtcctggttggtgtctattttcatggagacccgccatgttgatttcttcggaaatattgacatcgtcccagtgctggtattcgcagcaatcggtggcgtggttgctttggtgtggcgcggaaacttgtgggcgccggtgttttacttcgccagcgttgcgttgaccgctaactcgctgaagccttttgaagagccgtggggtgattggctcaacatcgtgggcggtctgcattactccacaggacaccgtttgatcatgcctgtcgccatgttcacttttgctgccgcaggtatcggcgctgccgcagtgatccgtttgatctgcttgggaccaataaagaagttcaccactgtttccggtgttgtttctgtggtgatggctcttgttgtggctgtgccattgcagacttgggcgaaggattttgtagaggaaggatccgaaaccacaatccttgcgccacacaatgatgaacgtatggtgagcaacaacgacttggctgcctgggactggttaatccaacagccaggtggagctgacatgaacatcatgggtgaccccgcagatggtaacggctggatgtatgcctacaacggcttgcactccgtggcccgccactatgcatggccagcagcaggcgaaggctctgccaccgcgatgctgttctggtggcctcaacttctaggtgtgggcaccgatgaaaacccagatcaagtcaacgatgtggatcaggctgctcgtgatctcaacgtcggctacttcatgatcagtccgtggacgttctgggatttccagatccccaacttccgccagatcgatctgctgtggcaaaccccaggcgtgacaccggtgtgcaagaagggcgactcggtgatcttcgcagtcaacgatatgttcactgacgccgaactggatcagatgcgtgcacctggtaattctccagaaccactgccagagcttcctaccttgggcgagcttgggttggctgaaactgaagacgaggtagatcagacttattaccatcgtccaacggttcctgctggtgtgaactcagagatgccttcagccgaaactctgtatgcaccggatccaacgaagccgcatacggtccctaactaatcacaaagagtattcagtaa

SEQ ID NO: 586 - protein, 799 aa, Corynebacterium glutamicum
MLTTLWIAVLVFTVPGLVVSWVSGLKVPWAIAASIPATFGIYGLSAWLLGLWEMRFDLHSVVISTLVFAAVALVWRLFFVGGWLVRRRKARIRRQTLADEERAENAEVSAGEPAESSTNEAAESESETSERRGIWRVIFDYMRDGGILDHRWLLPAAGAITGAWLIIDRAVDLLLSTEHGLGDIVQGWDVHWHASTVRFIDETGIASSTMMGQLRNIETQQDLFYPSAWHAGAWVLSDVGNLTIVEATNLTGIVLSGLLLPLAVALIAWRMINNRGLTAQIGAGFAGLITIASPVLFWVGNYVGAWPYVAAIGASGVVLALFMSTPSVPVRIFAAALAFMGMFQLHPAPSTIVIMVLLLWWLLKLVVVPSQKVKGWKAGIGIRLKDVGILAITGIIGVLFMLPQVISGSEQTEDVLSYSAEEQVTRSESWLVSIFMETRHVDFFGNIDIVPVLVFAAIGGVVALVWRGNLWAPVFYFASVALTANSLKPFEEPWGDWLNIVGGLHYSTGHRLIMPVAMFTFAAAGIGAAAVIRLICLGPIKKFTTVSGVVSVVMALVVAVPLQTWAKDFVEEGSETTILAPHNDERMVSNNDLAAWDWLIQQPGGADMNIMGDPADGNGWMYAYNGLHSVARHYAWPAAGEGSATAMLFWWPQLLGVGTDENPDQVNDVDQAARDLNVGYFMISPWTFWDFQIPNFRQIDLLWQTPGVTPVCKKGDSVIFAVNDMFTDAELDQMRAPGNSPEPLPELPTLGELGLAETEDEVDQTYYHRPTVPAGVNSEMPSAETLYAPDPTKPHTVPN

SEQ ID NO: 587 - DNA, 638 bp, Corynebacterium glutamicum
  CDS (40)..(615): FRXA01331
gcctcggactggttaatccaacagccaggtggagctgacatgaacatcatgggtgaccccgcagatggtaacggctggatgtatgcctacaacggcttgcactccgtggcccgccactatgcatggccagcagcaggcgaaggctctgccaccgcgatgctgttctggtggcctcaacttctaggtgtgggcaccgatgaaaacccagatcaagtcaacgatgtggatcaggctgctcgtgatctcaacgtcggctacttcatgatcagtccgtggacgttctgggatttccagatccccaacttccgccagatcgatctgctgtggcaaaccccaggcgtgacaccggtgtgcaagaagggcgactcggtgatcttcgcagtcaacgatatgttcactgacgccgaactggatcagatgcgtgcacctggtaattctccagaaccactgccagagcttcctaccttgggcgagcttgggttggctgaaactgaagacgaggtagatcagacttattaccatcgtccaacggttcctgctggtgtgaactcagagatgccttcagccgaaactctgtatgcaccggatccaacgaagccgcatacggtccctaactaatcacaaagagtattcagtaa

SEQ ID NO: 588 - protein, 192 aa, Corynebacterium glutamicum
MNIMGDPADGNGWMYAYNGLHSVARHYAWPAAGEGSATAMLFWWPQLLGVGTDENPDQVNDVDQAARDLNVGYFMISPWTFWDFQIPNFRQIDLLWQTPGVTPVCKKGDSVIFAVNDMFTDAELDQMRAPGNSPEPLPELPTLGELGLAETEDEVDQTYYHRPTVPAGVNSEMPSAETLYAPDPTKPHTVPN

SEQ ID NO: 589 - DNA, 892 bp, Corynebacterium glutamicum
  CDS (101)..(892): FRXA00668
ctaaactcgtctctcgtatctttcagtcatttatgtctgataagcaggcgcgtgcgccacacaattggcacaatcacaagaaagtgaagtgggaacctagatgctgacgacactatggattgcggtgttggtatttaccgttccaggattggtcgtctcgtgggtttctggccttaaagtgccctgggctatcgcagcctccatcccagccaccttcggtatttacggcctgtccgcctggttgctgggcttgtgggagatgcgttttgatctccattctgtagttatttccacattggttttcgctgcggttgctttggtatggcgcttgttttttgtcggtggttggcttgtacgtcggcgtaaagcacgtatccgcaggcagacgctcgcggatgaagagcgggcagaaaatgctgaggtatctgcaggggagcctgccgaatcgagcacaaacgaagcagccgaatctgaatctgaaacctcggagcgtcgcggaatctggcgcgtgatctttgattacatgcgcgacggtggcatcttggatcaccgttggctgctgcctgccgcaggtgctatcactggtgcgtggctgatcattgatcgtgccgttgatctgctcttgagcaccgagcatggtttgggcgatatcgtccaaggctgggatgtccattggcatgcttcgactgtccgttttatagatgagaccggcattgcgtcatccacgatgatggggcagctgcgcaatattgaaacgcagcaagatctgttctacccaagcgcatggcatgctggtgcatgggtgctgtcggatgtcggaaatctgacgattgttgaagccaccaacctcactggcattgtgctgtccggattgttgctgccgttagctgtt

SEQ ID NO: 590 - protein, 264 aa, Corynebacterium glutamicum
MLTTLWIAVLVFTVPGLVVSWVSGLKVPWAIAASIPATFGIYGLSAWLLGLWEMRFDLHSVVISTLVFAAVALVWRLFFVGGWLVRRRKARIRRQTLADEERAENAEVSAGEPAESSTNEAAESESETSERRGIWRVIFDYMRDGGILDHRWLLPAAGAITGAWLIIDRAVDLLLSTEHGLGDIVQGWDVHWHASTVRFIDETGIASSTMMGQLRNIETQQDLFYPSAWHAGAWVLSDVGNLTIVEATNLTGIVLSGLLLPLAV

SEQ ID NO: 591 - DNA, 750 bp, Corynebacterium glutamicum
  CDS (1)..(750): FRXA00674
atctttgccgcagcattggcgttcatgggtatgttccagctgcatccagccccatccaccatcgtgatcatggtgttgctgctgtggtggctgctcaaactcgtggtggttccaagccagaaagtgaagggctggaaggcgggcatcggtatccgtttgaaggatgtcggcatcctggccatcacgggcatcatcggtgtgctcttcatgctgcctcaggtgatttcaggttccgaacaaaccgaagatgtgctgtcatattctgctgaggaacaagtcacccgcagcgagtcctggttggtgtctattttcatggagacccgccatgttgatttcttcggaaatattgacatcgtcccagtgctggtattcgcagcaatcggtggcgtggttgctttggtgtggcgcggaaacttgtgggcgccggtgttttacttcgccagcgttgcgttgaccgctaactcgctgaagccttttgaagagccgtggggtgattggctcaacatcgtgggcggtctgcattactccacaggacaccgtttgatcatgcctgtcgccatgttcacttttgctgccgcaggtatcggcgctgccgcagtgatccgtttgatctgcttgggaccaataaagaagttcaccactgtttccggtgttgtttctgtggtgatggctcttgttgtggctgtgccattgcagacttgggcgaaggattttgtagaggaaggatccgaaaccacaatccttgcgcca

SEQ ID NO: 592 - protein, 250 aa, Corynebacterium glutamicum
IFAAALAFMGMFQLHPAPSTIVIMVLLLWWLLKLVVVPSQKVKGWKAGIGIRLKDVGILAITGIIGVLFMLPQVISGSEQTEDVLSYSAEEQVTRSESWLVSIFMETRHVDFFGNIDIVPVLVFAAIGGVVALVWRGNLWAPVFYFASVALTANSLKPFEEPWGDWLNIVGGLHYSTGHRLIMPVAMFTFAAAGIGAAAVIRLICLGPIKKFTTVSGVVSVVMALVVAVPLQTWAKDFVEEGSETTILAP

SEQ ID NO: 593 - DNA, 1536 bp, Corynebacterium glutamicum
  CDS (101)..(1513): RXN01337
gctggctatcctcaattccgctcgggtcgcactgccacgcggagcgattagtgattttgatacgcaagaaaaagtttcttagcagggtaacctaaatgtcgtgacatttcgaggcggaaacactggcgcaaagcacgcggtcgttgttggttctggccccaatgggttgaccacggcggcggtgctggccaaagcaggttggcaagtagatgtgtatgaggcggcgccaacccctggaggggcggcgcgctcagaaagcgttctgggggaggggactatcagcgatttgggtgccgcagggcatcctttcggggtggcaagcccagcttttcactatttgggtctggaagatcacggcctggaatgggcgtattctccctttgcgatggcccacccgttagattatggcagggccggactgctggaaacgtcactcccagagaccgccaaaaagcttggacctgatgcacgtcgttggaagaatttgcaccagggcttaaccaaaaacattgataaacacttggccaatctattagggccggtgctgaaatggccagcacatccgattcggatggcaaagtttggcccatttgcgttgctgcccgcgaaacgtctagccagtgccgcttttgaaacagaagaagcccgatccctgtttatcggttcggcgatgcactcggtgactccaccacacaagccgatgaccgcatcacttggattgctttttggcgctctggggatgtcgcgaggatggccggttgcagttgggggaagcggacggatcgtcgatgctctggtcaatgtcataaaccatcacggtggcaccattcactgcgattcacagattgattccctctcacaattccgcgacaccgatgccattattctgaaccaaaccccctcacaggtgctgaaactcaaaggaactgaccttaatgcagggcttccgcaacgcatgagcacctggaaacacggaccaagttcctacaaagtggactacctccttgacgaaccaattccctggagcaatccccaggtaggccaggccacaaccgtccatgtgggcggaagctctgaggaaatcgctttcgcagaagcagaagtcgcagcggggcggatgcccgaacgcccgtttatcattttgtgccaacaacaagtggcggatccttcacgcgcccgggaggggcgccacgtcgtgtgggcctacgcgcatgtgccgcggggtttcgtcgataagcgagctgctttattaatcactgcgcagattgaacgcttcgcccccggtttccgtgatcgcatcgtgcattcagtggataccaacgcggaggatttagaggcgtggaaccccaatcttgttggcggagacatcaccgcagggtccgcgctgcttcggcgaatgccgaccaaaatcggcgagaaaacgtacatggcatccgcctccaacgcgccgggcgggggagtccacggaatgcccggctggtgggcagcgcaagccgttttagcagatcacaggtagaattgcgacatggagcccac

SEQ ID NO: 594 - protein, 471 aa, Corynebacterium glutamicum
VTFRGGNTGAKHAVVVGSGPNGLTTAAVLAKAGWQVDVYEAAPTPGGAARSESVLGEGTISDLGAAGHPFGVASPAFHYLGLEDHGLEWAYSPFAMAHPLDYGRAGLLETSLPETAKKLGPDARRWKNLHQGLTKNIDKHLANLLGPVLKWPAHPIRMAKFGPFALLPAKRLASAAFETEEARSLFIGSAMHSVTPPHKPMTASLGLLFGALGMSRGWPVAVGGSGRIVDALVNVINHHGGTIHCDSQIDSLSQFRDTDAIILNQTPSQVLKLKGTDLNAGLPQRMSTWKHGPSSYKVDYLLDEPIPWSNPQVGQATTVHVGGSSEEIAFAEAEVAAGRMPERPFIILCQQQVADPSRAREGRHVVWAYAHVPRGFVDKRAALLITAQIERFAPGFRDRIVHSVDTNAEDLEAWNPNLVGGDITAGSALLRRMPTKIGEKTYMASASNAPGGGVHGMPGWWAAQAVLADHR

SEQ ID NO: 595 - DNA, 1536 bp, Corynebacterium glutamicum; identical to SEQ ID NO: 593
  CDS (101)..(1513): FRXA01337

SEQ ID NO: 596 - protein, 471 aa, Corynebacterium glutamicum; identical to SEQ ID NO: 594

SEQ ID NO: 597 - DNA, 708 bp, Corynebacterium glutamicum
  CDS (101)..(685): RXN01351
ctggagatttccgatttccagcgcgcccgcatcgacgcgaatgctcaggaattgcaggccgagcgcgaggcagtgcgcgacttgctctaatctttaacgcatgacttcgcttttcgacgccccaaccctccaacgcgtcaccgttttcacgggctcggcgctcggcagttcctcgctgtacacgcaagcggctcaaaccttggcgaaaaccgcggtagaccgcggcatcgacttggtttacggtggcggaaaagtggggctcatgggtatcgtcgcggatgcgttcctggaatcaggtggcgaagcctttggcgtcatcacggaatcacttatgaagggtgagcttgggcatgaaaagctcaccgaacttgaaatcgttcctgatatgcacatccgcaagcgtcgcatggcagaacttggcgatggttttatcgccatgcccggtggcgccggcaccttggaagaacttttcgaggtctggacctggcaacagctgggcattcatcaaaagcccgtcgcactttatgatgtcgatggtttttggcagcccctgctggaaatgcttgagcagatgacccagcgtggatttatcaagcgagacttctttgagtgcctcatcgtggaatccgacccgcatgccctgctaaaggcaatgcagacctggactccaccagcaccaaaatggtaactaaattgtgtgctcgacgg

SEQ ID NO: 598 - protein, 195 aa, Corynebacterium glutamicum
MTSLFDAPTLQRVTVFTGSALGSSSLYTQAAQTLAKTAVDRGIDLVYGGGKVGLMGIVADAFLESGGEAFGVITESLMKGELGHEKLTELEIVPDMHIRKRRMAELGDGFIAMPGGAGTLEELFEVWTWQQLGIHQKPVALYDVDGFWQPLLEMLEQMTQRGFIKRDFFECLIVESDPHALLKAMQTWTPPAPKW

SEQ ID NO: 599 - DNA, 3677 bp, Corynebacterium glutamicum
  CDS (1)..(3654): RXN01362
aaatggcttggcacgcctgcgcagagcttattcttaatccccccagttacccagcatgctcgcacgggcacccacctttatgattccctgcagctgctgttcactctggtggataaaggccaccacccaacagatgctaaggctgtagcttttgatgccgaggctggagaagaaggcctgcacttccgcaacctttcagcggatctcttcctccctgcagccacagaacttattgatcgagttggtctttccaatgaagccctaaacaaggtcttggaaaacctcctgctctcccgggtgcaatccggtaaagaccgcggctttatctcctatgccaccttgggtgttaccgagcttggccaagtttatgagggtctgatgtcctataccggctttatcgcccaggaagatctttttgaggttgcaccacatggcaaagccgataaaggttcctggatgctcccggtctcaaaggctgatgaagtccctgccgatagctttatcgaagttgatcaagaagcccctggtggcggcgtaatcaaggtgcgtaaacgccacccgcgcggatcatttgtgttccgtcagtcctctcgtgaccgcgaacgctcagcgtccttctacaccccacaagtactcaccagctttactgtcacccaggctattgaagaactccaggcatcaaagcgcatcaccacagccaatgatgttctcagcctcaccatctgtgaacctgccatgggttccggcgccttcgctgtggaagcagtacgccaattagcagagctttatttggaattgcgccaagaagaactagagcagcagattccagcggaagaccgtgccaaggaactccaaaaggtcaaagcgcacattgcgctgcaccaggtttatggtgtggaccttaacagcactgctgtggagttggcggaaatctcgctgtggctagacaccatgaatgcagaaatggacgcaccttggtatggcctgcacctgcgtaatggtaactccctcgttggtgccacccgttcgctgtatgcacctagtctgcttaataaaaaagcctggttaactgctactccaacccgctatcggcttgatgatatcgcgcaggctattgatgaaaacaaagcagaacccctcttcaaccacggcatccaccacttcctcttgccctctactggctggggagccactgcagatgccaaagatcttaaagatcttatggctactgaaatcaaggagcttaaatcttggcgtacttccatccgtgcgtctttgagtaaaactcagattaagcagctcaataaccttgccctacgcgtggaaacactatggcgatttgtgctgatgcgtattcgcattgcagaatcccagatctcacgtagcactactctctggggtcaagagccagctgaggtttcggaggttgtcacacgtgagcaaattgaacaagacctctttggcaatattgatggtgcatataaccgtctacgcttggtgatggatgcttggtgtgcgctgtggttctggcctttggatgctgttgctaccgctgagcatccggagcgtccagcccttccagatcttgatgagtggctagccaccctgacggagattctgggtattgatctccctctgaagtccaaaaacgaaaatcagattgtcttaggtccagataccaattggctagccattaatgatgccgaggctactgatcttggtttttctggggcattgagctttgagcgtgttagcgcgaatcacccgtggatcaatgttgcccgccaagtggctaaacaacagagcttcttccactgggatctagacttcgcccacgtttttgccaagggtggatttgatctgcaggttggtaatccaccatgggtgcgaccagatgtgaactttgaggatctgcttgctgaacatgatccgtggtgggctgtaatgagtaaaccaacccaggcatccaaaaaagaacgccagaagaattttcacaacaatcctaagagcctcgaacatgtggtcagtggtgcaggtgaacccgtggctacttctgcgatcctcggttcggttactctctatccgcatcttaaagatcaacgcccggacctctaccggggctttatggaaaagacttggtctaatgcctccccggcaggtgcgatctcactgatccaccccgaatcccacttcactgagaaaaaagctgccccgctacgtcggggagcatatgagcgtctgcgccgccactggcagttcattaatgagttgattctttttgacgtccacgacttggttaaatatggcgtacatgtctatggcgctccgcaggaatctattaactttttaagtgctgcgtcgctttatcacccacaaacagtgcttgattcatttgatcatgacggttcaggtaatctccctggtcttaaagacgacaatggcaactgggaccgtcgcccacacaaggaccgtatccaactggtcaatgccgatactttgacggtgtggaagtccatcctggaggatgaacaaacgccatacttggatacccgcatggtttataccgtcaacacggaagcagcagcagcgttggaaaagttggcttctgcacctcgtatcaaagaactcgggctgcagttctccagtggctggaatgaaaccaccgataagaaaaagggatactttgacgttggttggggctacccagcttcctggtctgatgccattttgcaggggccgcacctgggtgttgctacaccaatgatcaagcagcccaatccgacaatgaagcataatcaagattggtctgaaattgatttcgaggccattcctgcaaacttcatacctgcaacggcgtaccagcccgatcgccaaacaaagcccacttatgatgctgactacggcacctggactttcggggacaagcaggtaccagttgcagacactttccgaattgcatggagggagatggctgccaccacgggatttaggactgtctacccatcagtaattccaccgggagccaaccatgtgcacacagttaatagcgctgcatcacgttcaaacttaaaaaccattctcgttggagcacagcttggtgcaattctaagtgactattttgctcggtcctcgggttcaagccacatatttaacgacattgttcgcaagattccacttccaaatttcacatccttggaaaagcagttcgcccgcacatacctccgcctcaactgcctgacctcagcttatgccccattgtgggaagagatcaccggtgagccgtgggatgttcaggtgcctttgcgcaatgccgagcaacgtcgagcagcgcaaaacgatattgatgccatggtggcattgtctttgggtattagtgctgatgagctgtgcatgatttatcgcactcaattcccagtgatgcgtagatatgatcaagaagatcattttgatgccaatggccgtaaagttcctaaagagatcatcaagctgcagcagaaacttaaagatggccaagagctcagcgtggaaaagcgcacctgggtgcatccccaatcagaagtgtcctatacctttgaatatcctttccgggtgttggatcgtgaagctgatctgcgtgctgcatatgcaaaatttgaaaaccagcttaaggagccatagagcgcttatgtcctcactca

SEQ ID NO: 600 - protein, 1218 aa, Corynebacterium glutamicum
KWLGTPAQSLFLIPPVTQHARTGTHLYDSLQLLFTLVDKGHHPTDAKAVAFDAEAGEEGLHFRNLSADLFLPAATELIDRVGLSNEALNKVLENLLLSRVQSGKDRGFISYATLGVTELGQVYEGLMSYTGFIAQEDLFEVAPHGKADKGSWMLPVSKADEVPADSFIEVDQEAPGGGVIKVRKRHPRGSFVFRQSSRDRERSASFYTPQVLTSFTVTQAIEELQASKRITTANDVLSLTICEPAMGSGAFAVEAVRQLAELYLELRQEELEQQIPAEDRAKELQKVKAHIALHQVYGVDLNSTAVELAEISLWLDTMNAEMDAPWYGLHLRNGNSLVGATRSLYAPSLLNKKAWLTATPTRYRLDDIAQAIDENKAEPLFNHGIHHFLLPSTGWGATADAKDLKDLMATEIKELKSWRTSIRASLSKTQIKQLNNLALRVETLWRFVLMRIRIAESQISRSTTLWGQEPAEVSEVVTREQIEQDLFGNIDGAYNRLRLVMDAWCALWFWPLDAVATAEHPERPALPDLDEWLATLTEILGIDLPLKSKNENQIVLGPDTNWLAINDAEATDLGFSGALSFERVSANHPWINVARQVAKQQSFFHWDLDFAHVFAKGGFDLQVGNPPWVRPDVNFEDLLAEHDPWWAVMSKPTQASKKERQKNFHNNPKSLEHVVSGAGEPVATSAILGSVTLYPHLKDQRPDLYRGFMEKTWSNASPAGAISLIHPESHFTEKKAAPLRRGAYERLRRHWQFINELILFDVHDLVKYGVHVYGAPQESINFLSAASLYHPQTVLDSFDHDGSGNLPGLKDDNGNWDRRPHKDRIQLVNADTLTVWKSILEDEQTPYLDTRMVYTVNTEAAAALEKLASAPRIKELGLQFSSGWNETTDKKKGYFDVGWGYPASWSDAILQGPHLGVATPMIKQPNPTMKHNQDWSEIDFEAIPANFIPATAYQPDRQTKPTYDADYGTWTFGDKQVPVADTFRIAWREMAATTGFRTVYPSVIPPGANHVHTVNSAASRSNLKTILVGAQLGAILSDYFARSSGSSHIFNDIVRKIPLPNFTSLEKQFARTYLRLNCLTSAYAPLWEEITGEPWDVQVPLRNAEQRRAAQNDIDAMVALSLGISADELCMIYRTQFPVMRRYDQEDHFDANGRKVPKEIIKLQQKLKDGQELSVEKRTWVHPQSEVSYTFEYPFRVLDREADLRAAYAKFENQLKEP

SEQ ID NO: 601 - DNA, 1418 bp, Corynebacterium glutamicum
  CDS (1)..(1395): FRXA01362
attaatgagttgattctttttgacgtacacgacttggttaaatatggcgtacatgtctatggcgctccgcaggaatctattaactttttaagtgctgcgtcgctttatcacccacaaacagtgcttgattcatttgatcatgacggttcaggtaatctccctggtcttaaagacgacaatggcaactgggaccgtcgcccacacaaggaccgtatccaactggtcaatgccgatactttgacggtgtggaagtccatcctggaggatgaacaaacgccatacttggatacccgcatggtttataccgtcaacacggaagcagcagcagcgttggaaaagttggcttctgcacctcgtatcaaagaactcgggctgcagttctccagtggctggaatgaaaccaccgataagaaaaagggatactttgacgttggttggggctacccagcttcctggtctgatgccattttgcaggggccgcacctgggtgttgctacaccaatgatcaagcagcccaatccgacaatgaagcataatcaagattggtctgaaattgatttcgaggccattcctgcaaacttcatacctgcaacggcgtaccagcccgatcgccaaacaaagcccacttatgatgctgactacggcacctggactttcggggacaagcaggtaccagttgcagacactttccgaattgcatggagggagatggctgccaccacgggatttaggactgtctacccatcagtaattccaccgggagccaaccatgtgcacacagttaatagcgctgcatcacgttcaaacttaaaaaccattctcgttggagcacagcttggtgcaattctaagtgactattttgctcggtcctcgggttcaagccacatatttaacgacattgttcgcaagattccacttccaaatttcacatccttggaaaagcagttcgcccgcacatacctccgcctcaactgcctgacctcagcttatgccccattgtgggaagagatcaccggtgagccgtgggatgttcaggtgcctttgcgcaatgccgagcaacgtcgagcagcgcaaaacgatattgatgccatggtggcattgtctttgggtattagtgctgatgagctgtgcatgatttatcgcactcaattcccagtgatgcgtagatatgatcaagaagatcattttgatgccaatggccgtaaagttcctaaagagatcatcaagctgcagcagaaacttaaagatggccaagagctcagcgtggaaaagcgcacctgggtgcatccccaatcagaagtgtcctatacctttgaatatcctttccgggtgttggatcgtgaagctgatctgcgtgctgcatatgcaaaatttgaaaaccagcttaaggagccatagagcgcttatgtcctcactca

SEQ ID NO: 602 - protein, 465 aa, Corynebacterium glutamicum
INELILFDVHDLVKYGVHVYGAPQESINFLSAASLYHPQTVLDSFDHDGSGNLPGLKDDNGNWDRRPHKDRIQLVNADTLTVWKSILEDEQTPYLDTRMVYTVNTEAAAALEKLASAPRIKELGLQFSSGWNETTDKKKGYFDVGWGYPASWSDAILQGPHLGVATPMIKQPNPTMKHNQDWSEIDFEAIPANFIPATAYQPDRQTKPTYDADYGTWTFGDKQVPVADTFRIAWREMAATTGFRTVYPSVIPPGANHVHTVNSAASRSNLKTILVGAQLGAILSDYFARSSGSSHIFNDIVRKIPLPNFTSLEKQFARTYLRLNCLTSAYAPLWEEITGEPWDVQVPLRNAEQRRAAQNDIDAMVALSLGISADELCMIYRTQFPVMRRYDQEDHFDANGRKVPKEIIKLQQKLKDGQELSVEKRTWVHPQSEVSYTFEYPFRVLDREADLRAAYAKFENQLKEP

SEQ ID NO: 603 - DNA, 1866 bp, Corynebacterium glutamicum
  CDS (1)..(1866): FRXA01364
acgggcacccacctttatgattccctgcagctgctgttcactctggtggataaaggccaccacccaacagatgctaaggctgtagcttttgatgccgaggctggagaagaaggcctgcacttccgcaacctttcagcggatctcttcctccctgcagccacagaacttattgatcgagttggtctttccaatgaagccctaaacaaggtcttggaaaacctcctgctctcccgggtgcaatccggtaaagaccgcggctttatctcctatgccaccttgggtgttaccgagcttggccaagtttatgagggtctgatgtcctataccggctttatcgcccaggaagatctttttgaggttgcaccacatggcaaagccgataaaggttcctggatgctcccggtctcaaaggctgatgaagtccctgccgatagctttatcgaagttgatcaagaagcccctggtggcggcgtaatcaaggtgcgtaaacgccacccgcgcggatcatttgtgttccgtcagtcctctcgtgaccgcgaacgctcagcgtccttctacaccccacaagtactcaccagctttactgtcacccaggctattgaagaactccaggcatcaaagcgcatcaccacagccaatgatgttctcagcctcaccatctgtgaacctgccatgggttccggcgccttcgctgtggaagcagtacgccaattagcagagctttatttggaattgcgccaagaagaactagagcagcagattccagcggaagaccgtgccaaggaactccaaaaggtcaaagcgcacattgcgctgcaccaggtttatggtgtggaccttaacagcactgctgtggagttggcggaaatctcgctgtggctagacaccatgaatgcagaaatggacgcaccttggtatggcctgcacctgcgtaatggtaactccctcgttggtgccacccgttcgctgtatgcacctagtctgcttaataaaaaagcctggttaactgctactccaacccgctatcggcttgatgatatcgcgcaggctattgatgaaaacaaagcagaacccctcttcaaccacggcatccaccacttcctcttgccctctactggctggggagccactgcagatgccaaagatcttaaagatcttatggctactgaaatcaaggagcttaaatcttggcgtacttccatccgtgcgtctttgagtaaaactcagattaagcagctcaataaccttgccctacgcgtggaaacactatggcgatttgtgctgatgcgtattcgcattgcagaatcccagatctcacgtagcactactctctggggtcaagagccagctgaggtttcggaggttgtcacacgtgagcaaattgaacaagacctctttggcaatattgatggtgcatataaccgtctacgcttggtgatggatgcttggtgtgcgctgtggttctggcctttggatgctgttgctaccgctgagcatccggagcgtccagcccttccagatcttgatgagtggctagccaccctgacggagattctgggtattgatctccctctgaagtccaaaaacgaaaatcagattgtcttaggtccagataccaattggctagccattaatgatgccgaggctactgatcttggtttttctggggcattgagctttgagcgtgttagcgcgaatcacccgtggatcaatgttgcccgccaagtggctaaacaacagagcttcttccactgggatctagacttcgcccacgtttttgccaagggtggatttgatctgcaggttggtaatccaccatgggtgcgaccagatgtgaactttgaggatctgcttgctgaacatgat

SEQ ID NO: 604 - protein, 622 aa, Corynebacterium glutamicum
TGTHLYDSLQLLFTLVDKGHHPTDAKAVAFDAEAGEEGLHFRNLSADLFLPAATELIDRVGLSNEALNKVLENLLLSRVQSGKDRGFISYATLGVTELGQVYEGLMSYTGFIAQEDLFEVAPHGKADKGSWMLPVSKADEVPADSFIEVDQEAPGGGVIKVRKRHPRGSFVFRQSSRDRERSASFYTPQVLTSFTVTQAIEELQASKRITTANDVLSLTICEPAMGSGAFAVEAVRQLAELYLELRQEELEQQIPAEDRAKELQKVKAHIALHQVYGVDLNSTAVELAEISLWLDTMNAEMDAPWYGLHLRNGNSLVGATRSLYAPSLLNKKAWLTATPTRYRLDDIAQAIDENKAEPLFNHGIHHFLLPSTGWGATADAKDLKDLMATEIKELKSWRTSIRASLSKTQIKQLNNLALRVETLWRFVLMRIRIAESQISRSTTLWGQEPAEVSEVVTREQIEQDLFGNIDGAYNRLRLVMDAWCALWFWPLDAVATAEHPERPALPDLDEWLATLTEILGIDLPLKSKNENQIVLGPDTNWLAINDAEATDLGFSGALSFERVSANHPWINVARQVAKQQSFFHWDLDFAHVFAKGGFDLQVGNPPWVRPDVNFEDLLAEHD

SEQ ID NO: 605 - DNA, 1042 bp, Corynebacterium glutamicum
  CDS (101)..(1042): RXN01379
cagaaattgagtaatgctctcgagccagaccgtgaacttattaggcctttggccgtcattcttccgcagcccgcaactttgaacaccgaggtttaacacaatgagtgcatttgattcgatcctaaatgttgaagagtggatcagtgaccactacctcaccaatgacgatgccaaaggtgcctcattttccaagcgggtgcgcgagcgcattaaagaatggaaaaccaccgaggacgcaacccagcagagtggccctttaactcgtttttccagcaaccgcctgcagttgcagcatgctctttctgagcttgacgacgccaccaccgccgccagtttagtggcctctgcactggggtatggtgtccccagcgcgcgccacgcgcagcgcggctccgacacaatatcctattcctcttgggtgggaaatgccggcagtgtggaatttcttgcagcgactcccgctgaaagctttgaagagaacttccgatcccttccccttgagccagtagcggtcaatgacaagccccaggatatcaccgcagccaaattggtgggccagattttccttagtgatactccccctgcttttgttgttatcaccgctggtaaatgggtggttttagccgagcgtgaaacctggcctctaggccgccacctagctattgatatttccctggtggtggaacgtaatgacaccaaagcccagggtgagatgcagcagacggtcgtagcactagcccgcgaaaataccgagcgtgccgccgatggcaccacctggtgggaagaaaccattgagcaatcccgcgaacatgctgtcaaggtttctggcgagctacgcagtgcggtgcgtgaatccattgaaatcctgggcaatgacgtgctcacacgctatgaagctaaagagctctccaccgctgagatcgacggtggcgagctagctaagcaatctttgcgctatctctaccgcattttgttcctgctttttgccgaggcttcaccagagcttgaaatcctgccaaccggcaccccggaatatgacgag

SEQ ID NO: 606 - protein, 314 aa, Corynebacterium glutamicum
MSAFDSILNVEEWISDHYLTNDDAKGASFSKRVRERIKEWKTTEDATQQSGPLTRFSSNRLQLQHALSELDDATTAASLVASALGYGVPSARHAQRGSDTISYSSWVGNAGSVEFLAATPAESFEENFRSLPLEPVAVNDKPQDITAAKLVGQIFLSDTPPAFVVITAGKWVVLAERETWPLGRHLAIDISLVVERNDTKAQGEMQQTVVALARENTERAADGTTWWEETIEQSREHAVKVSGELRSAVRESIEILGNDVLTRYEAKELSTAEIDGGELAKQSLRYLYRILFLLFAEASPELEILPTGTPEYDE

SEQ ID NO: 607 - DNA, 921 bp, Corynebacterium glutamicum
  CDS (1)..(921): FRXA01379
ctaaatgttgaagagtggatcagtgaccactacctcaccaatgacgatgccaaaggtgcctcattttccaagcgggtgcgcgagcgcattaaagaatggaaaaccaccgaggacgcaacccagcagagtggccctttaactcgtttttccagcaaccgcctgcagttgcagcatgctctttctgagcttgacgacgccaccaccgccgccagtttagtggcctctgcactggggtatggtgtccccagcgcgcgccacgcgcagcgcggctccgacacaatatcctattcctcttgggtgggaaatgccggcagtgtggaatttcttgcagcgactcccgctgaaagctttgaagagaacttccgatcccttccccttgagccagtagcggtcaatgacaagccccaggatatcaccgcagccaaattggtgggccagattttccttagtgatactccccctgcttttgttgttatcaccgctggtaaatgggtggttttagccgagcgtgaaacctggcctctaggccgccacctagctattgatatttccctggtggtggaacgtaatgacaccaaagcccagggtgagatgcagcagacggtcgtagcactagcccgcgaaaataccgagcgtgccgccgatggcaccacctggtgggaagaaaccattgagcaatcccgcgaacatgctgtcaaggtttctggcgagctacgcagtgcggtgcgtgaatccattgaaatcctgggcaatgacgtgctcacacgctatgaagctaaagagctctccaccgctgagatcgacggtggcgagctagctaagcaatctttgcgctatctctaccgcattttgttcctgctttttgccgaggcttcaccagagcttgaaatcctgccaaccggcaccccggaatatgacgag

SEQ ID NO: 608 - protein, 307 aa, Corynebacterium glutamicum
LNVEEWISDHYLTNDDAKGASFSKRVRERIKEWKTTEDATQQSGPLTRFSSNRLQLQHALSELDDATTAASLVASALGYGVPSARHAQRGSDTISYSSWVGNAGSVEFLAATPAESFEENFRSLPLEPVAVNDKPQDITAAKLVGQIFLSDTPPAFVVITAGKWVVLAERETWPLGRHLAIDISLVVERNDTKAQGEMQQTVVALARENTERAADGTTWWEETIEQSREHAVKVSGELRSAVRESIEILGNDVLTRYEAKELSTAEIDGGELAKQSLRYLYRILFLLFAEASPELEILPTGTPEYDE

SEQ ID NO: 609 - DNA, 780 bp, Corynebacterium glutamicum
  CDS (101)..(757): RXN01390
cgtccagataatcaatctgcgaagccagtggcttccgaagctccaacaactattacgccggcaagctctggtgcattagcatccgatgctccgacgtcttatgttcaggcgcagccttcccagcaacaagacatcctcagcaagttccgccagctccgccgacacaagttactcagtcagattaggccgtcctgaagagcctggttaccagccagaaccgtcttattcggagccttacactgactctgatttcgcgccagcaggtgcggccgctgcggcagctgcagtagctccaccaatgattgcggaacagccacaaattgttgaagatgcccgccgaggtaccctcgatttcggcctgttgattatccgcgcagtcattggtgtctatttgatcgtccgtggagtctttacattcttcacccttggaggatctgccggtcttgctggcctcgaggcagagttcgctggttaccagtggcctgaaatcctcgcgatcctgcttccatctattgaacttgcggctggtgtcttcctgctccttggtctgatgaccccagtggcagcagcggtagccacggtggcgacatcctttaccacccttcaccaagtcaacactcatgaaggtggttggggtgaacttagtgagccattgatgctggcactgatcctcactatcgtggttgtcggacttcagttcaccggccccggcaagatttcccttgactctggccgaggttggcaaagcgtccactggtgagctcgtggatcttcgtggtc

SEQ ID NO: 610 - protein, 219 aa, Corynebacterium glutamicum
MFRRSLPSNKTSSASSASSADTSYSVRLGRPEEPGYQPEPSYSEPYTDSDFAPAGAAAAAAAVAPPMIAEQPQIVEDARRGTLDFGLLIIRAVIGVYLIVRGVFTFFTLGGSAGLAGLEAEFAGYQWPEILAILLPSIELAAGVFLLLGLMTPVAAAVATVATSFTTLHQVNTHEGGWGELSEPLMLALILTIVVVGLQFTGPGKISLDSGRGWQSVHW

SEQ ID NO: 611 - DNA, 780 bp, Corynebacterium glutamicum; identical to SEQ ID NO: 609
  CDS (101)..(757): FRXA01390

SEQ ID NO: 612 - protein, 219 aa, Corynebacterium glutamicum; identical to SEQ ID NO: 610

SEQ ID NO: 613 - DNA, 813 bp, Corynebacterium glutamicum
  CDS (101)..(790): RXN01391
atggtgtgaaaccatcatggctcgatcacaaaaaagaacacctgctatcaggtcaaccaaaaaagttaaaagtgtaatatccagcatcatcacgattgccgtggctgcagtcgcttttgcagcttacgttatagatggtggggtagaagaggcgtctggaacaccgacgtcttcggaaagctcggtagcggcaactgctccagcggcatctagcgagactgcggctgaataccgtgcgatgctcgcttcccttgacgttaaaggtcgtgcgccaggaacaggatatgaccgcgaattattcggaccagcatggaccgacactgtttccgtggaatatggacacaatggctgcgatacccgcaacgacatcctgcaacgcgacctggatgacatccaacttcgcgaaggcaccaaggattgtatcgtcacgagcggcctgctcagcgatccattttctggcgaacttattgatttcgttcgcggtgaacgttccggcgacgtgcagatcgatcacctggtcccattacatgacgcatgggtcaagggagcacagcagtgggatgagcaaactcgaaagaactttgccaacgatcccgacaaccttctcgccgttaaaggtacgcttaaccagcaaaaaggtgcaggcgatgcagcaacctggcttccaccaaacacagcttttaggtgcgattacgcaaagaaaatcatcaccgttaaagatcgctacaacgtgtgggtgactgaggctgaagcaagcgccctggaacgccaattagatacgtgtgctgcataacagtcacataagcatttggg

SEQ ID NO: 614 - protein, 230 aa, Corynebacterium glutamicum
VAAVAFAAYVIDGGVEEASGTPTSSESSVAATAPAASSETAAEYRAMLASLDVKGRAPGTGYDRELFGPAWTDTVSVEYGHNGCDTRNDILQRDLDDIQLREGTKDCIVTSGLLSDPFSGELIDFVRGERSGDVQIDHLVPLHDAWVKGAQQWDEQTRKNFANDPDNLLAVKGTLNQQKGAGDAATWLPPNTAFRCDYAKKIITVKDRYNVWVTEAEASALERQLDTCAA

SEQ ID NO: 615 - DNA, 813 bp, Corynebacterium glutamicum; identical to SEQ ID NO: 613
  CDS (101)..(790): FRXA01391

SEQ ID NO: 616 - protein, 230 aa, Corynebacterium glutamicum; identical to SEQ ID NO: 614

SEQ ID NO: 617 - DNA, 1623 bp, Corynebacterium glutamicum
  CDS (101)..(1600): RXN01400
gagcagctatcacccttatgcatcggctccgggtgaggcggtgccggtgtcctttgatcagcaacgacatgtgggtgccggcgagcgaccgggtagttggatggcgattagtgtttctatgcctaaggcgatcagccgtgaggaattggagcgcgcgtggcttgaagtgattgaacggcacggcaccttgcgcacagtatttagcacgggaatgggtggggaagtgcagcaacaccgcattgatgtgggcccgggaaaatggattgaccacgccgttgcgcctggtgagagcattaatgaggcgttgcgggcggtgttgaatcggcagtgttcgccgtactcgaggccatcgcatagtttgtgcattattgatgcgcatccgcgtcccacggtgattattggtagtgatcattcgcatgtggatatgtggtccatgctggtgattgtgcgcgatttgttggctgcgctcgatatggaacttcccgttgagccgccgttggcgtttgaatcgcacaccgcggaactcctcgcggctccacctgcaccggagcggattcaccagcggtggcgtgaaattttggaagctggtggtggaaaaatgcctcagttcccgcttccgcttggcgatgccatctccatgcctgaacgcgttgaagtccgcgacattttcggggtcaatggcttggcgatttactcggcacgcgcccgcgcacaacaggtaagctccctggccttgactatttcagtgatggctgatgttacggcggcgctggcggaccttccgttgcgtgctgtattcccagtccatagccgtttcgatcagcgctggcacgatagtgtcgggtggtttatctccaattcggtcattgaggtgccagattccgatcctcacactgcagcccaagctgttcgcgaggctgtttctttgggaagctacccgctggctgagctgcttgaaccgtggggtggcatgccggaaacgccaggaatgtttgctatttcttggcttgacctgcgccgactcccagtgagcattgacgatattggcctccaagcccagtatgtcagcgcttcactgcgcaccgatggtgtgatgctgtggtttattttggatcgctccggcgcgcaccttcgctgtcgttatcctgactctttggtggcgcgggaaaatgtaggccgctggattgatgcgattgttgctcagatgcgcgccgaagctgggacggtgaatctgcaggccggcggggaacagctgacacttcggcatggaactcgcgccgatatttccgagatcgccccgctacttgcccgaaacgcagctgacccttgtgagctggtggatcttgaacatgcccttgacctgctgacacacgagtcttcgcatttcctggcggtggttcgaaacgctcgtggcaagataatcgcagcgatgcagttgactattgttccggagttttcccgcggtggtgcgcttcatcttcacatcgaggggccgttcattattccggaatatcgcaccaccgatttggataaaaagctgcgcgcctgggctgtggagcatgggcgtgcgcgaggggtgaaggttgaggaggtggtgggatagttggtttattggcgcctcgt

SEQ ID NO: 618 - protein, 500 aa, Corynebacterium glutamicum
MAISVSMPKAISREELERAWLEVIERHGTLRTVFSTGMGGEVQQHRIDVGPGKWIDHAVAPGESINEALRAVLNRQCSPYSRPSHSLCIIDAHPRPTVIIGSDHSHVDMWSMLVIVRDLLAALDMELPVEPPLAFESHTAELLAAPPAPERIHQRWREILEAGGGKMPQFPLPLGDAISMPERVEVRDIFGVNGLAIYSARARAQQVSSLALTISVMADVTAALADLPLRAVFPVHSRFDQRWHDSVGWFISNSVIEVPDSDPHTAAQAVREAVSLGSYPLAELLEPWGGMPETPGMFAISWLDLRRLPVSIDDIGLQAQYVSASLRTDGVMLWFILDRSGAHLRCRYPDSLVARENVGRWIDAIVAQMRAEAGTVNLQAGGEQLTLRHGTRADISEIAPLLARNAADPCELVDLEHALDLLTHESSHFLAVVRNARGKIIAAMQLTIVPEFSRGGALHLHIEGPFIIPEYRTTDLDKKLRAWAVEHGRARGVKVEEVVG

SEQ ID NO: 619 - DNA, 1623 bp, Corynebacterium glutamicum; identical to SEQ ID NO: 617
  CDS (101)..(1600): FRXA01400

SEQ ID NO: 620 - protein, 500 aa, Corynebacterium glutamicum; identical to SEQ ID NO: 618

SEQ ID NO: 621 - DNA, 845 bp, Corynebacterium glutamicum
  CDS (1)..(822): RXN01409
tgggtggatttccccgacgtcaccgcacgtttggggtatgaatacatgcagctgacccctcatgtagatttcggtcctttcttccgccaccccaaggcagacgatgatctcgtggcagccctgaaaaagcgtgccaaggatgccggagtcaccattcctgcactgttgccagtgcagcgtatttcctggccggaggaaacccagcgtgttgcagcagtacgcaacatcaagcgcatcatccagttggccgttgatctggaagtagacaccctcaacacggagttttctggacgcccagaacgctccgaggattccgaagatgccttctaccgctccatggaagaactcctgccaatcctggaaaaagagggcatcaagttcaacatcgacccacaccctgatgatttcgtggaaaacggtattgaagcatggcgagtcatccgcggtctgaactccaagcaggtgggctttgtttacgtggcacctcactcattccacatgggtgatcaggctgaggcaatcctgccagcagtaggcgatcgccttggggctgtgtacctgtcagataccttcgaccaccacaaatcccacggcctgcgctacatcactaaccctccaggcaacgcagtgcgcgtgcaccagcacctaaaaatcggtgatggcgatgtgaactttgaagagatcttctcactgctgcgctctaccggttaccttgaccgtgaagatgcactgttggtctccaacgtgtttgcagaagatgaagcagcagatgaagtatcccgctaccagctggagaaaatccgctcactcatcgaaaacgcatagagttatctcgaaactaccaa

SEQ ID NO: 622 - protein, 274 aa, Corynebacterium glutamicum
WVDFPDVTARLGYEYMQLTPHVDFGPFFRHPKADDDLVAALKKRAKDAGVTIPALLPVQRISWPEETQRVAAVRNIKRIIQLAVDLEVDTLNTEFSGRPERSEDSEDAFYRSMEELLPILEKEGIKFNIDPHPDDFVENGIEAWRVIRGLNSKQVGFVYVAPHSFHMGDQAEAILPAVGDRLGAVYLSDTFDHHKSHGLRYITNPPGNAVRVHQHLKIGDGDVNFEEIFSLLRSTGYLDREDALLVSNVFAEDEAADEVSRYQLEKIRSLIENA

SEQ ID NO: 623 - DNA, 839 bp, Corynebacterium glutamicum
  CDS (1)..(816): FRXA01409
gatttccccgacgtcaccgcacgtttggggtatgaatacatgcagctgacccctcatgtagatttcggtcctttcttccgccaccccaaggcagacgatgatctcgtggcagccctgaaaaagcgtgccaaggatgccggagtcaccattcctgcactgttgccagtgcagcgtatttcctggccggaggaaacccagcgtgttgcagcagtacgcaacatcaagcgcatcatccagttggccgttgatctggaagtagacaccctcaacacggagttttctggacgcccagaacgctccgaggattccgaagatgccttctaccgctccatggaagaactcctgccaatcctggaaaaagagggcatcaagttcaacatcgacccacaccctgatgatttcgtggaaaacggtattgaagcatggcgagtcatccgcggtctgaactccaagcaggtgggctttgtttacgtggcacctcactcattccacatgggtgatcaggctgaggcaatcctgccagcagtaggcgatcgccttggggctgtgtacctgtcagataccttcgaccaccacaaatcccacggcctgcgctacatcactaaccctccaggcaacgcagtgcgcgtgcaccagcacctaaaaatcggtgatggcgatgtgaactttgaagagatcttctcactgctgcgctctaccggttaccttgaccgtgaagatgcactgttggtctccaacgtgtttgcagaagatgaagcagcagatgaagtatcccgctaccagctggagaaaatccgctcactcatcgaaaacgcatagagttatctcgaaactaccaa

SEQ ID NO: 624 - protein, 272 aa, Corynebacterium glutamicum
DFPDVTARLGYEYMQLTPHVDFGPFFRHPKADDDLVAALKKRAKDAGVTIPALLPVQRISWPEETQRVAAVRNIKRIIQLAVDLEVDTLNTEFSGRPERSEDSEDAFYRSMEELLPILEKEGIKFNIDPHPDDFVENGIEAWRVIRGLNSKQVGFVYVAPHSFHMGDQAEAILPAVGDRLGAVYLSDTFDHHKSHGLRYITNPPGNAVRVHQHLKIGDGDVNFEEIFSLLRSTGYLDREDALLVSNVFAEDEAADEVSRYQLEKIRSLIENA

SEQ ID NO: 625 - DNA, 3075 bp, Corynebacterium glutamicum
  CDS (101)..(3052): RXN01434
ggtttcctgcgcaccgtgatgattggtgcggcgctgtcgccggccatcgcttcggcgttcaacactgccaacacgctgcccaacctgatcactggaaatcgtgttgggtgcggtgctgacatcgctggttattccggtccttacccgcgcggaaaaagaagacgccgacggcggttccgggttcttcaggcggctgctcaccctgtcggtgacgctgctgggtggtgtcaccatcctgtcgattatcggcgcgccgctgctgacacggatgatgctgtcctctgagggacaagtcaacgtggtcatgtccacggcctttgcgtattggctgctgccacagattttcttctacggcctgtttgccctgttcatggctgtgttgaacacccgtgaagtgttcaaacccggcgcgtgggcacctgttgtcaacaatgtgatcaccttgaccgtgctgggcgtgtacatggtgctgcctgcgcgtttgcacccgcatgagcaggtgggcatttttgatccgcagatcattttcctcggcgtgggcaccacccttggtgtggttgcacagtgtctaatcatgattccgtacctgcgtcgcgcgggcattgatatgcgccctctgtggggtatcgatgcgcgtttgaagcaattcggtggcatggcgatggcgatcatcgtgtacgtggcaatctcccagttcggttacatcatcaccactcgcattgcgtcgattgcagacgatgctgcgccgtttatttatcagcagcactggatgttgctgcaagttccttatggcatcatcggcgtcaccttgctcaccgcgattatgccgcgactgtcccgcaacgcggcagacggcgatgatagggcagtagtctctgaccttcagttgggttccaagctaaccttcatcgcactgatccccatcgtggtgttcttcaccgccttcggtgtccctattgccaatggcctttttgcctacggccaattcgatgccaacgccgccaacatccttggttggactctgagcttctctgctttcacgctgattccttacgctttggtgctgctacatctgcgtgtgttttatgcgcgtgaagaggtctggaccccaaccttcatcatcgccggcatcaccgccaccaaggtcgtgctttccctgttggcaccgctgctgtcgagctccccggagcgtgtggtggtgcttcttggtgcggccaacggtttcagtttcatcaccggcgcggtcatcggcgcgtatctgttgcgcaacaaactcggcctgttgggtatgcgctctttggctaaaacctccctgtgggcgttgggctctgcggcggttggtgcagcagcagcatgggcgttggggtggctgattcaagccgtcgtgggcgatttcttgctgggcactctaagctccgtaggctacttgttgaacctggctgtgttgggtgtcttcttcatcttcgtcaccggcatcgtgttgtcacgttctggtttgccggaggtccaaaacttgggccaggcactgacccgcatcccaggtttgagccggtttattcgcccgaataccaagatctctttggatgtcggcgaagtctccgagcaggatttctccacccagctggtcgcgccaagcgagttcgcagcaacccctgtgccgccaccgatgtccgccggtattgtccgcggacctcgcctggttcccggcgccccagtcggcgacggtcgtttccgtctgctcgccgatcacggcggcgtccaaggcgcgcgtttctggcaggcccgcgagatcgccaccggcaaggaagtcgcgctgatctttgtggatacttccggcaacgccccatttgcgccactgtcttcggcagccgcagcgggcatcgcctacgaggtgcagcgccgcaccaagaagctggccagcttgggcagcttggcggtagcccccaacatccactccgaggcgtaccgcaacggttgcctcattgtggccgattgggtgcctggctccagcttgagcgccgtcgcggaatccggtgccgatccccgcgccgccgcgttcgcgctcgcggaactaactgaaaccatcggcgaggcccacgagatgggtatcccggccggcttggacaacaagtgccgaattcgtatcaacaccgacggccatgccgtcctcgccttgccggcgattttgcccgatgcctcagagctccgcgacgccaagtccctggcctcggccgccgagatgcttatcgacgcgaccctcgctcccagcgacgtcaaggcaatggtcactgaagcccaggggctagctacagaagacaatcccgattacgcatcacttgccatggcgatgcgcacctgcggactgttcaccgaggaaccaacccaccttgtggtgaagaaggaaaagacaccaaagcctgcgacacgtgatggtttcggtgcctccgactacaccgtcaagggcatggcagccatcgccgctgtggtgatcatcttggtttccctggtggccgccggtaccgcgttcctcaccagcttcttcggcagcagcaccaacgaacaatccccgttggcctctgttgaagccaccacctctgcaacaccagaacctgtggggccaccggtctacctggatctggatcaagcccgcacgtgggatgacggtgcaggaacagatgtcaccgacgtcaccgacggcaacacctccaccgcatggacctccaccggcggcgacggcctcctagttgacctgtccacgcctgcccgcctcgaccgcgtcatcttgaccaccggcaccggctccgacagcaacgtgacctcgaccgtgaagatctacgcattcaacgacgcctcaccacactccctgtcggaaggcatcgagatcggcaccgtggattattccggccgcagtctcagccacagcatccgcgattcctccaagcttccgggtcaggtggaatccgtggtgattctggtcgatgaggttcgttcctcacaaacctcagacaccaatccacagatgcagatcgctgaagtacaacttgttggttggtaaattacgcgtttgtgattgac

SEQ ID NO: 626 - protein, 984 aa, Corynebacterium glutamicum
VLGAVLTSLVIPVLTRAEKEDADGGSGFFRRLLTLSVTLLGGVTILSIIGAPLLTRMMLSSEGQVNVVMSTAFAYWLLPQIFFYGLFALFMAVLNTREVFKPGAWAPVVNNVITLTVLGVYMVLPARLHPHEQVGIFDPQIIFLGVGTTLGVVAQCLIMIPYLRRAGIDMRPLWGIDARLKQFGGMAMAIIVYVAISQFGYIITTRIASIADDAAPFIYQQHWMLLQVPYGIIGVTLLTAIMPRLSRNAADGDDRAVVSDLQLGSKLTFIALIPIVVFFTAFGVPIANGLFAYGQFDANAANILGWTLSFSAFTLIPYALVLLHLRVFYAREEVWTPTFIIAGITATKVVLSLLAPLLSSSPERVVVLLGAANGFSFITGAVIGAYLLRNKLGLLGMRSLAKTSLWALGSAAVGAAAAWALGWLIQAVVGDFLLGTLSSVGYLLNLAVLGVFFIFVTGIVLSRSGLPEVQNLGQALTRIPGLSRFIRPNTKISLDVGEVSEQDFSTQLVAPSEFAATPVPPPMSAGIVRGPRLVPGAPVGDGRFRLLADHGGVQGARFWQAREIATGKEVALIFVDTSGNAPFAPLSSAAAAGIAYEVQRRTKKLASLGSLAVAPNIHSEAYRNGCLIVADWVPGSSLSAVAESGADPRAAAFALAELTETIGEAHEMGIPAGLDNKCRIRINTDGHAVLALPAILPDASELRDAKSLASAAEMLIDATLAPSDVKAMVTEAQGLATEDNPDYASLAMAMRTCGLFTEEPTHLVVKKEKTPKPATRDGFGASDYTVKGMAAIAAVVIILVSLVAAGTAFLTSFFGSSTNEQSPLASVEATTSATPEPVGPPVYLDLDQARTWDDGAGTDVTDVTDGNTSTAWTSTGGDGLLVDLSTPARLDRVILTTGTGSDSNVTSTVKIYAFNDASPHSLSEGIEIGTVDYSGRSLSHSIRDSSKLPGQVESVVILVDEVRSSQTSDTNPQMQIAEVQLVGW

SEQ ID NO: 627 - DNA, 389 bp, Corynebacterium glutamicum
  CDS (1)..(366): FRXA01434
gtcaccgacggcaacacctccaccgcatggacctccaccggcggcgacggcctcctagttgacctgtccacgcctgcccgcctcgaccgcgtcatcttgaccaccggcaccggctccgacagcaacgtgacctcgaccgtgaagatctacgcattcaacgacgcctcaccacactccctgtcggaaggcatcgagatcggcaccgtggattattccggccgcagtctcagccacagcatccgcgattcctccaagcttccgggtcaggtggaatccgtggtgattctggtcgatgaggttcgttcctcacaaacctcagacaccaatccacagatgcagatcgctgaagtacaacttgttggttggtaaattacgcgtttgtgattgac

SEQ ID NO: 628 - protein, 122 aa, Corynebacterium glutamicum
VTDGNTSTAWTSTGGDGLLVDLSTPARLDRVILTTGTGSDSNVTSTVKIYAFNDASPHSLSEGIEIGTVDYSGRSLSHSIRDSSKLPGQVESVVILVDEVRSSQTSDTNPQMQIAEVQLVGW

SEQ ID NO: 629 - DNA, 1290 bp, Corynebacterium glutamicum
  CDS (101)..(1267): RXN01448
gtaatctcagcagttaaaaagggcagttccgcatcagggggactgccctttttcgtgtcttctcatgctcttgtgaatatgcatagctaatcttgaggccatggcaaagaagaaactggggactgtcgccagactgtctgaactggataagtccctgcgcaatagattgctgcgggttcgttcccgactgctgtttattgttcattccgcaattggtgcgggtgtggcgtattggatcgccgtggaagtgatcaaacacggacaaccgtttttcgcaccgatgtccgcggtgattattttgggtctctccggaggagaccgcatcaaaagagccacggaactcaccctgggctgtgctttaggcgttggtttgggtgatttactgatcatgcaaatcggcacgggctattggcagatatttgtggtagttggattagcgctgctggtggcctcgtttgtttcaccggcaccgttggtgagtaatcagatggccattggtggcattttgattgccacgatgttcccgccaggtgatggtggaagcattgaccgtatgatcgacgccttcattggtggtggcgtgggaattttggtcatcgcacttcttccctcatctcctcttgacgcaggccggcatcaagtggccaacgttttggggatcgcagctagtgtgctggaagacgtggcagcttccctaaaagccaaggatgcagccaaactcaacaatgctttggaagcattgagaaggtcgcaggcgtcggtgaacaagctggaaactgcggcatcttcaggcaaggaagcaaccaccgtatcgccatttttatggggagatagggcccgcgtgagatcgctgtatcgcattctggcgccagtggacaacgtcatccgaaatgctcgagtccttgcgcgacgggcagtggtgctgaccgaagacaatgacaccgtcagtgatgaacaaatccacgtgattgaggaaatcgcagacattgcactgcgactgtcagacctttatgagcaccacaaagaaatcagtgaagcactggaaattcctgagttggttaaccgactgcgtcaactgggcagtgaagtgggcgaggacatcgccgaagatcgagtgctatccgcacaagtaattttggcgcaatcgcgatccatcattgtggacctgttgcagatctgcggcatgtccagggaatctgcggtggcagtgttggttccgacctcagagagtccggcttaccctccggagctgtgggatgacgaagactagccttttatcgcggttcggtt

SEQ ID NO: 630 - protein, 389 aa, Corynebacterium glutamicum
MAKKKLGTVARLSELDKSLRNRLLRVRSRLLFIVHSAIGAGVAYWIAVEVIKHGQPFFAPMSAVIILGLSGGDRIKRATELTLGCALGVGLGDLLIMQIGTGYWQIFVVVGLALLVASFVSPAPLVSNQMAIGGILIATMFPPGDGGSIDRMIDAFIGGGVGILVIALLPSSPLDAGRHQVANVLGIAASVLEDVAASLKAKDAAKLNNALEALRRSQASVNKLETAASSGKEATTVSPFLWGDRARVRSLYRILAPVDNVIRNARVLARRAVVLTEDNDTVSDEQIHVIEEIADIALRLSDLYEHHKEISEALEIPELVNRLRQLGSEVGEDIAEDRVLSAQVILAQSRSIIVDLLQICGMSRESAVAVLVPTSESPAYPPELWDDED

SEQ ID NO: 631 - DNA, 842 bp, Corynebacterium glutamicum
  CDS (40)..(819): FRXA01448
gcctcgtttgtttcaccggcaccgttggtgagtaatcagatggccattggtggcattttgattgccacgatgttcccgccaggtgatggtggaagcattgaccgtatgatcgacgccttcattggtggtggcgtgggaattttggtcatcgcacttcttccctcatctcctcttgacgcaggccggcatcaagtggccaacgttttggggatcgcagctagtgtgctggaagacgtggcagcttccctaaaagccaaggatgcagccaaactcaacaatgctttggaagcattgagaaggtcgcaggcgtcggtgaacaagctggaaactgcggcatcttcaggcaaggaagcaaccaccgtatcgccatttttatggggagatagggcccgcgtgagatcgctgtatcgcattctggcgccagtggacaacgtcatccgaaatgctcgagtccttgcgcgacgggcagtggtgctgaccgaagacaatgacaccgtcagtgatgaacaaatccacgtgattgaggaaatcgcagacattgcactgcgactgtcagacctttatgagcaccacaaagaaatcagtgaagcactggaaattcctgagttggttaaccgactgcgtcaactgggcagtgaagtgggcgaggacatcgccgaagatcgagtgctatccgcacaagtaattttggcgcaatcgcgatccatcattgtggacctgttgcagatctgcggcatgtccagggaatctgcggtggcagtgttggttccgacctcagagagtccggcttaccctccggagctgtgggatgacgaagactagccttttatcgcggttcggtt

SEQ ID NO: 632 - protein, 260 aa, Corynebacterium glutamicum
MAIGGILIATMFPPGDGGSIDRMIDAFIGGGVGILVIALLPSSPLDAGRHQVANVLGIAASVLEDVAASLKAKDAAKLNNALEALRRSQASVNKLETAASSGKEATTVSPFLWGDRARVRSLYRILAPVDNVIRNARVLARRAVVLTEDNDTVSDEQIHVIEEIADIALRLSDLYEHHKEISEALEIPELVNRLRQLGSEVGEDIAEDRVLSAQVILAQSRSIIVDLLQICGMSRESAVAVLVPTSESPAYPPELWDDED

SEQ ID NO: 633 - DNA, 933 bp, Corynebacterium glutamicum
  CDS (101)..(910): RXN01459
gattcggcgattcacgaatatccaccctacaacctgtgttcgcttacagcgttgttcggatcgtagcaataggaaatagttgccttgtagattggtaaatatgaactctaatggctttggtttctcttttggcaacaacgatgacgacgatgacaaaaaccgcaacaacgacccattcggccttttcggtggcaacttcggattcggaggacaaggtggcgctggtggccccggcggattaggcgatattttaaaccagttcggccagatgctgtccggaatgggagattcgatgaactcccccgaagcagcaggcccggttaattatgatttagcagcacgcatcgcccgccagcagattggtcgcgtagcgccggtgaaggattctgagaaggaagcagtcgaagagtcccttcgccttgctgaactctggctcgataacgccacccagctccccacttccgggcaccgcgtcgaagcgtggaatccagaaaactggttagaaaacaccctgcctgtgtggaagcgtcttgtctcccctgttgcggagcaaatgaacaaagcccaattagaaaacctccctgaagaagcccgcgagatgatgggcccgatgtcttctttgatgaactccatgtcttcgatgaacttcggagttcaattaggaaatgcgctgggcgacctcgcaaagcagaccctcaccggctctgacttcggtttgcctatctccccagtcggcgtatctgccgtcctgcccggcaacatcgccgaagcatccaaaggcctcaacgtggcaccgcaagaaatgctcgtttacatctgtgcccgcgaagccgccgccaacgcctcttcaagcacgtgccgtggcttgtcgagcgcctcgtttcctccgttgaggaatacgccgtcggcctagaaatcgacacctcacacatt

SEQ ID NO: 634 - protein, 270 aa, Corynebacterium glutamicum
MNSNGFGFSFGNNDDDDDKNRNNDPFGLFGGNFGFGGQGGAGGPGGLGDILNQFGQMLSGMGDSMNSPEAAGPVNYDLAARIARQQIGRVAPVKDSEKEAVEESLRLAELWLDNATQLPTSGHRVEAWNPENWLENTLPVWKRLVSPVAEQMNKAQLENLPEEAREMMGPMSSLMNSMSSMNFGVQLGNALGDLAKQTLTGSDFGLPISPVGVSAVLPGNIAEASKGLNVAPQEMLVYICAREAAANASSSTCRGLSSASFPPLRNTPSA

SEQ ID NO: 635 - DNA, 933 bp, Corynebacterium glutamicum; identical to SEQ ID NO: 633
  CDS (101)..(910): FRXA01459

SEQ ID NO: 636 - protein, 270 aa, Corynebacterium glutamicum; identical to SEQ ID NO: 634

SEQ ID NO: 637 - DNA, 417 bp, Corynebacterium glutamicum
  CDS (101)..(394): RXN01460
gcaacatcgccgaagcatccaaaggcctcaacgtggcaccgcaagaaatgctcgtttacatctgtgcccgcgaagccgccgccaacgcctcttcaagcacgtgccgtggcttgtcgagcgcctcgtttcctccgttgaggaatacgccgtcggcctagaaatcgacacctcacacattcaagaggccatgggcaacttccaaatggacaacccagatcctgaacgcctccaggaaatgatgaacgaactccaaggtatggacctgtccccacgcatcggatcccgcaacgccaacgcagtatcccgcctggaaactctcctcgcactcgtcgaaggctgggtcgacatcgtagttacccaagccctgagcgaacgcattccatcaccgacgccatgaacgaagcctggaagcgccgc

SEQ ID NO: 638 - protein, 98 aa, Corynebacterium glutamicum
VPWLVERLVSSVEEYAVGLEIDTSHIQEAMGNFQMDNPDPERLQEMMNELQGMDLSPRIGSRNANAVSRLETLLALVEGWVDIVVTQALSERIPSPTP

SEQ ID NO: 639 - DNA, 417 bp, Corynebacterium glutamicum; identical to SEQ ID NO: 637
  CDS (101)..(394): FRXA01460

SEQ ID NO: 640 - protein, 98 aa, Corynebacterium glutamicum; identical to SEQ ID NO: 638

SEQ ID NO: 641 - DNA, 930 bp, Corynebacterium glutamicum
  CDS (101)..(907): RXN01471
cctccaaccagagctataaaaaaggttgtagaagaaatttcttaacatacatcgttgtgttgccaggggtttaacagattagttgctaaggtctgtctccatgcagagttttaagacgcttgaatcttggcctgtcgacaatgtttcggccagtgtcatctccgacggcgccgtgcacttttacggcgacgtcgatcgtgtttttgaactcatgagtgtgacaaaactcctggccacctacggtttccttgttgccatcgaagaaggtgtttttgagctcgattcaccgatgggtcctgaaggatccacagtgaggcatctgctctcacatgcttccggcgtggcattcgataagccggtagcggaaaagggagtgggggagcgccgcatttactcctctgctggcatggacatcttggcggatgctgttgccgctgaagctgaaatgccgtttgcagagtatctccgcgaggctgtgttcgagcctttgggaatggagaactctgaactatggggttctgcgggccacgaggcgcgcagcacagtggctgatctgaccaagttcggccaagagctcaccgcaccaactctgatctcaccagaaacccttgcagaggctttccaggtgcaattcccggaactgattggcaccgtccccggttatggcatgcagaagccgtgtccgtggggattgggctttgaaattaagggacagaagtcgccgcactggacaggtgacttgatgccggagaacactgctggacactttggacagtcgggaacattcttttggactgttccaggctcaggtcaagtcggggttgttttgactgaccgaaatttcggtccttgggctaaaccgttgtggactgccttcaatgacgaagtctgggccgagttaaattcataaacttttgccgtaattacggt

SEQ ID NO: 642 - protein, 269 aa, Corynebacterium glutamicum
MQSFKTLESWPVDNVSASVISDGAVHFYGDVDRVFELMSVTKLLATYGFLVAIEEGVFELDSPMGPEGSTVRHLLSHASGVAFDKPVAEKGVGERRIYSSAGMDILADAVAAEAEMPFAEYLREAVFEPLGMENSELWGSAGHEARSTVADLTKFGQELTAPTLISPETLAEAFQVQFPELIGTVPGYGMQKPCPWGLGFEIKGQKSPHWTGDLMPENTAGHFGQSGTFFWTVPGSGQVGVVLTDRNFGPWAKPLWTAFNDEVWAELNS

SEQ ID NO: 643 - DNA, 930 bp, Corynebacterium glutamicum; identical to SEQ ID NO: 641
  CDS (101)..(907): FRXA01471

SEQ ID NO: 644 - protein, 269 aa, Corynebacterium glutamicum; identical to SEQ ID NO: 642

SEQ ID NO: 645 - DNA, 363 bp, Corynebacterium glutamicum
  CDS (101)..(340): RXN01479
agcgctgcccgtgccataaatttcgaagaagcgcgaaacaggtagagtctaaggtgtcattcttggtacaagttttatatttagggagagttatccacacatgatccagttagtgataggcgctgcagcaggctacgtgcttggcacaaaggccggccgcaagcgttaccaccagatcaaaaagggatatgaggcagcgattaactcccctgccaccaaatctgcagtaaacgccgcccgcaaagccattgccaacaagctggatccgcagccccgcatgaaggaagtaaaaaacctgcggactgcggacgggcatgaagtcctcgagcaagaccaggactaaattaccctctaaacgcccgg

SEQ ID NO: 646 - protein, 80 aa, Corynebacterium glutamicum
MIQLVIGAAAGYVLGTKAGRKRYHQIKKGYEAAINSPATKSAVNAARKAIANKLDPQPRMKEVKNLRTADGHEVLEQDQD

SEQ ID NO: 647 - DNA, 351 bp, Corynebacterium glutamicum
  CDS (101)..(328): FRXA01479
gccataaatttcgaagaagcgcgaaacaggtagagtctaaggtgtcattcttggtacaagttttatatttagggagagttatccacacatgatccagttagtgataggcgctgcagcaggctacgtgcttggcacaaaggccggccgcaagcgttaccaccagatcaaaaagggatatgaggcagcgattaactcccctgccaccaaatctgcagtaaacgccgcccgcaaagccattgccaacaagctggatccgcagccccgcatgaaggaagtaaaaaacctgcggactgcggacgggcatgaagtcctcgagcaagaccaggactaaattaccctctaaacgcccgg

SEQ ID NO: 648 - protein, 76 aa, Corynebacterium glutamicum
VIGAAAGYVLGTKAGRKRYHQIKKGYEAAINSPATKSAVNAARKAIANKLDPQPRMKEVKNLRTADGHEVLEQDQD

SEQ ID NO: 649 - DNA, 669 bp, Corynebacterium glutamicum
  CDS (101)..(646): RXN01484
gagtttactcttaaccgcagtagtgcagccagccctgagggtggtggcgtattcgatgctcagaacgcctaataatcggcacaaaattgattcaattttggtgttgggcacagctcaatatgatggagttccatcgaggcagtttgctgctcgtttgaggcatgccgcgaagctgtggcgtcttcatgaaatccagcatgtatatactgtcggcggaaaacttcctggcgatcgtttcaccgaagcagaagtcgcgcgggagtatttgatcaaagagggcgtggatccggatctgatttttgtctctgcagttggcaatgacactgtctcctcctatgaggcgcttgatccggaaaagcttggtcgggtgctgattgttactgatccgaaccattcgtatcgggcggtgcgcatcgcgcgacgcatgggctttgacgcgaaaccttccccgacaacctatagtcccgcgaagtttccgtcgatagtttattttctgaccttgtcccatgagtggggcggggtagtagtacaggacgtgtcgcggctcttgggtgaacgggtgcccgataaggtgaagcatctttgcgcgcaatccaaggtctgctgcgcccttcgcggcgtgcacgccatgagcaacttcggaggctgaaaaagtagatgtacccctat

SEQ ID NO: 650 - protein, 182 aa, Corynebacterium glutamicum
VLGTAQYDGVPSRQFAARLRHAAKLWRLHEIQHVYTVGGKLPGDRFTEAEVAREYLIKEGVDPDLIFVSAVGNDTVSSYEALDPEKLGRVLIVTDPNHSYRAVRIARRMGFDAKPSPTTYSPAKFPSIVYFLTLSHEWGGVVVQDVSRLLGERVPDKVKHLCAQSKVCCALRGVHAMSNFGG

SEQ ID NO: 651 - DNA, 669 bp, Corynebacterium glutamicum; identical to SEQ ID NO: 649
  CDS (101)..(646): FRXA01484

SEQ ID NO: 652 - protein, 182 aa, Corynebacterium glutamicum; identical to SEQ ID NO: 650

SEQ ID NO: 653 - DNA, 2175 bp, Corynebacterium glutamicum
  CDS (101)..(2152): RXN01485
ctcagggctggctgcactactgcggttaagagtaaactcttggctaaaaatcttctcacgttaactagtgtgccagctggactcgtctaaggtggggaccatgaactttagtttggtgcatcttcgggaaaacgtccgccgtgtatcggtcactgtggcaattggagctggcgcgctccttatcagtggaccattttttactgctcacactgcagaagccacagaaacatatgtcttggctgaatcaccagaattttaccaagacaatgtcactgactacaccggccagatttcctcgtccgatatcaccaacattcaggctgccatcgatgatgtaaaggcatctgaacaaaaggttattttcgttgttttcctaagctctttcgacggagttgaccctgaaacgtggacgcagcaagcactccaagccaacggcggcggaaacgtcttgatttatgcactcgctcccgaggaacggcagtacggcatccaaggtggtactcaatggaccgacgctgaactcgacgccgccaacaacgctgctttccaggcactttcccaagaagattgggcaggctctgcactagcgctggcagaatcagttggttctagttcttccagctcttcgggctcgtccagctcttccgatttttccggcgcttggttggctgctgcgggcgttggcacagtggccgctggtggcggaatttgggcctattcccgcagccgcaagaagaaaacaagtgctgcaaccttggaagatgcacgcgaaatcgacccgcgcgataccaaccgcctcatgcagcttcccatggaaactctcgaacaccttgcccaagaagagctcacctccactgatgactccatccgtcgcggaaaagaagagctcgctatcgctacctccgagttcggaccagagcgcacccgcagcttcaaccgcgccatgaaccactccaccggcaccctgcaaaaagcctttgagattcagcagcgcctcaacgattctatcccagaatccgaagccgaacgtcaatccatgctggtagaaatcatttcatcctgtggccaagccgacgatgccctcgacgccgaagcccaaaactttgccgatatgcgcaacctgctgatcaacgcgggcagcaaattggatgctctcacccaaaaatccgtcgacctgcgcacccgcctccccaaggcccaagaaacactcgctggcctgcgcactcgctactcagcagaggtccttgaaagcatcgacgacaacgtcgacctcgccagcgcttcgctcgacgaagcagaagaagtcctgccacaggcgtacgagatagagtccatgcccgcaggcgagcagggcgggcttatcgacgcgatccgtcacatcgagcacgccatcactaccgcagacaaactcctcgcgggcgtcgagcatgccgatgaaaacatctccacagccaaagcaaacgttgccgatctgatccaagaaatctcagacgaaatcaacgaagccggccaactcaaacaaagcgcaggagccgacggtgcccgtgccgactgggcctccctcgacgatgctgtccgcgcagccagcgcagcactaatcaccgcatcagcagacgccgaaaaggatccgctcggaacctacacagaacttgtcgatgtcgactccgccctcgacactcaacttgacacacttcgcgccaccgcagctgatcaagcccgccagctacgcgtattcgaccaacagctgcaatctgcaagaagccaaatccaaaaggccgaagacctcatctccacccgcggtcgcatcgtaaaatccgaagcccgcacccacctggccaacgcacaaaagctgtacgccatggcacaacaaaaccgcacccgcgacacccgtgcaggaattgattacggacgtcaagcagcagtcgcagcccaacgcgccagcaagtcagcacaaaacgacatcaccacctacaacaatcgccacaattccggtggcggaaccaccggtgcgattgtcaccggcatggtgatcaactcgattctcaacagcggccgcggtggcggtttctgtggaggcggaggctttggtggaggcggtggcggcttcagcggtggtggcggtggcggaggagggttccgcggaggccgcttctagcctgaaacgagcaaaaccaa

SEQ ID NO: 654 - protein, 684 aa, Corynebacterium glutamicum
MNFSLVHLRENVRRVSVTVAIGAGALLISGPFFTAHTAEATETYVLAESPEFYQDNVTDYTGQISSSDITNIQAAIDDVKASEQKVIFVVFLSSFDGVDPETWTQQALQANGGGNVLIYALAPEERQYGIQGGTQWTDAELDAANNAAFQALSQEDWAGSALALAESVGSSSSSSSGSSSSSDFSGAWLAAAGVGTVAAGGGIWAYSRSRKKKTSAATLEDAREIDPRDTNRLMQLPMETLEHLAQEELTSTDDSIRRGKEELAIATSEFGPERTRSFNRAMNHSTGTLQKAFEIQQRLNDSIPESEAERQSMLVEIISSCGQADDALDAEAQNFADMRNLLINAGSKLDALTQKSVDLRTRLPKAQETLAGLRTRYSAEVLESIDDNVDLASASLDEAEEVLPQAYEIESMPAGEQGGLIDAIRHIEHAITTADKLLAGVEHADENISTAKANVADLIQEISDEINEAGQLKQSAGADGARADWASLDDAVRAASAALITASADAEKDPLGTYTELVDVDSALDTQLDTLRATAADQARQLRVFDQQLQSARSQIQKAEDLISTRGRIVKSEARTHLANAQKLYAMAQQNRTRDTRAGIDYGRQAAVAAQRASKSAQNDITTYNNRHNSGGGTTGAIVTGMVINSILNSGRGGGFCGGGGFGGGGGGFSGGGGGGGGFRGGRF

SEQ ID NO: 655 - DNA, 2175 bp, Corynebacterium glutamicum; identical to SEQ ID NO: 653
  CDS (101)..(2152): FRXA01485

SEQ ID NO: 656 - protein, 684 aa, Corynebacterium glutamicum; identical to SEQ ID NO: 654

SEQ ID NO: 657 - DNA, 927 bp, Corynebacterium glutamicum
  CDS (101)..(904): RXN01492
tgaagtgggcgcgttagcttcggcgcgtggcaaaccacatttgctggactgcaggcataatggacaaagacttttagcaacaactatgtggaggtgacaggtgaccacaactctgtgggcggtttctgacctccatgcagcggtgaaagctaacgctgatccaattgagaatattcagcctaaggatccgtctgactggttgattgttgcaggtgacgtggcggaacgtaccgaattggtgctggaaattttggcacgtttgcgcaggcgctttgccaaggtgatctgggttccgggtaaccatgagttgttttctcgctccgcggaccgctatcaggggcgcgataagtactctgaactcgttgaaggctgccgcaagattgatgtgttgactccggaggacccttacttaacctttggtggggttactatcgttccgttgtttacactctatgactactcgttccgtcgacctggtttcaccgtggagcaggctgtgcaagcggcgcgggatcgtcaagtgatgatgactgatgagttttctattgcgccttttgttgatatccgagcgtggtgctgggatcgcttagcctattccattaagcgtttgagcaagatcaacgggccaacaattttgattaaccactggccgctggtggtggaaccgacttatcagatgcgctggcaggaacttgcattgtggtgcggtactcgccacaccaggggatgggccgaacgctacaacgcggaagccgttatttacggtcatctgcatatgcccggaataaccaacgtcaacggtgtgaaacacattgaagtgtcgttgggttatccgcgcgaatgggagcattggtctgggcagcatgtgtggccatatccagtgatggaggtggacaatgctggatgagtctttgtttccaaattcgg

SEQ ID NO: 658 - protein, 268 aa, Corynebacterium glutamicum
VTTTLWAVSDLHAAVKANADPIENIQPKDPSDWLIVAGDVAERTELVLEILARLRRRFAKVIWVPGNHELFSRSADRYQGRDKYSELVEGCRKIDVLTPEDPYLTFGGVTIVPLFTLYDYSFRRPGFTVEQAVQAARDRQVMMTDEFSIAPFVDIRAWCWDRLAYSIKRLSKINGPTILINHWPLVVEPTYQMRWQELALWCGTRHTRGWAERYNAEAVIYGHLHMPGITNVNGVKHIEVSLGYPREWEHWSGQHVWPYPVMEVDNAG

SEQ ID NO: 659 - DNA, 927 bp, Corynebacterium glutamicum; identical to SEQ ID NO: 657
  CDS (101)..(904): FRXA01492

SEQ ID NO: 660 - protein, 268 aa, Corynebacterium glutamicum; identical to SEQ ID NO: 658

SEQ ID NO: 661 - DNA, 597 bp, Corynebacterium glutamicum
  CDS (101)..(574): RXN01518
agcagaacctgatgccgtcctgcacggcacgaccattgcagaacatgtggataatcttgatcccacagacattgaaggtgtcaccaagatttaaggagtcgtggctttcatgcagaaaacgtcagcgggttggttgatcgcaacgggaggtttcctcgccgctgtgtccgccattttgacgtggcgtttttatggatccatgacctctatttccatcacggtatccatcactttttggttgttggccgtggtgtgtggtttcgcaggtgtgaaggtccaaggtcgcctcgatgaggggctgatcggccaggacaaatcccaaatgaaccccgtgaccattgcctatctggccatgctgggtcgagcgtgtgcgtggggtggcgcaattttcggcggcgtttatgtgggaattggcagttatgtaatcccacgcgccggtgagttgtccgcagcatcgaatgatcttccgggagttattgcctgtgcgctgggcggaatcgcactctcagctgccggactttatttagagcgaagctgtgaggctccgcctccccaatctggcgaagcgatcagctagattggaattcatgaatcaag

SEQ ID NO: 662 - protein, 158 aa, Corynebacterium glutamicum
VAFMQKTSAGWLIATGGFLAAVSAILTWRFYGSMTSISITVSITFWLLAVVCGFAGVKVQGRLDEGLIGQDKSQMNPVTIAYLAMLGRACAWGGAIFGGVYVGIGSYVIPRAGELSAASNDLPGVIACALGGIALSAAGLYLERSCEAPPPQSGEAIS

SEQ ID NO: 663 - DNA, 597 bp, Corynebacterium glutamicum; identical to SEQ ID NO: 661
  CDS (101)..(574): FRXA01518

SEQ ID NO: 664 - protein, 158 aa, Corynebacterium glutamicum; identical to SEQ ID NO: 662

SEQ ID NO: 665 - DNA, 1727 bp, Corynebacterium glutamicum
  CDS (46)..(1704): RXN01549
tgaattccgtttctagattttttttattgattgtgagagtgcattgtggctaatgattttatagaaccaaatgatgcccccgatgcacctgataatggtgactcgggaagctcggggtttgttgatgaagcaaaagataagacccgctcagctgcacaaggcttaggttatggcgcactacgtgtaggttttggtactgcagcacttgcagccaatggtgctcgctctatgggtaatttggctaaaaacctgtggacacgaatgatggggcttgccctgtctgccggtactggtatctctgctgccacaggtggcatgatcactgcacgtgtaggcgcaatgctggcaggtacaggctcggtgttgtcgtcggtgacgactattgcgttgattgtgtcgatgattgtggtgccggcaggtcgaaaagacggcattatcgagttgtgtgagccgccagtaacggccaacccgtttaccattgacgcaggtgatatgactgagaacgcgaagttggtgtacggtgcgctgtcgtatcttgggatgaatgatcaaaatatcgccggtgtcttgggcaactttgagacagaatcaggtatcgacccgactgcggtggagggtatttttgatgaaccaaataccatcggtcctcggaagagagctgcgtgggataagaactttgaacctcagccgatgggtattgggcttgggcagtggacagcagggcgcacacagatgttgctagattttgccgccgatagaaaccgagactggcattacatcgacgtgcagcttgcatttgctattagtggcgataatgaaagcgatcgcaaggtttttctggaaatggttgataataaaaactccagtagcaatagccccaccgcagcgtccgagtacttcctgcgtgagtgggagcgcccggcagatgtcgcaggtaatgcacccattcgtgcagagcaagcatctaagtggtacgcgcagatgggtggttggcaaaagaactcaaccttgggtgagtctgtgatcgctatggctgatggtgcagcagcaaaatccacggcgcgtgatgagcaggatgctcttaatgattgtcctgaagaggaccgcacctcaggtggaaatacgtccgctgcagaagcaatggtgactatttcacatccttatctggctgattctcgtggcaatgacggtactgatatttaccgctatatccatgatgaagtgctcaccggtgatccgtattacgcatcctgtgaccgtggcgttgctaccgctattcgctggtcgggcacggatgatacgttcccagcaggtccaacagcagcacagtatgaatacgttgtgggcacaggatcgggccgttgggaggaaatcggcaatcttgccaccatgtcagagaacgatttgttacctggcgatgtgcttcttggtgcaccgaatcacgttgcgatgtatgtcagcaatgaggttgttgtggacatgttgggccctggtaatgcagagcctaatgcagctattggtcatgcatcgttgaatgaccgctcacctggtctggataccttgagtctggatggatggggcgtgaacttcaaggtgttccgcaacacccaggctgagacaaactcagtgttctctggtgtacagattccggctggtaaagaaattggcgaaatgactaacccaactcgaactactcctgcaggataagtttttttcatcgctgggtt

SEQ ID NO: 666 - protein, 553 aa, Corynebacterium glutamicum
VANDFIEPNDAPDAPDNGDSGSSGFVDEAKDKTRSAAQGLGYGALRVGFGTAALAANGARSMGNLAKNLWTRMMGLALSAGTGISAATGGMITARVGAMLAGTGSVLSSVTTIALIVSMIVVPAGRKDGIIELCEPPVTANPFTIDAGDMTENAKLVYGALSYLGMNDQNIAGVLGNFETESGIDPTAVEGIFDEPNTIGPRKRAAWDKNFEPQPMGIGLGQWTAGRTQMLLDFAADRNRDWHYIDVQLAFAISGDNESDRKVFLEMVDNKNSSSNSPTAASEYFLREWERPADVAGNAPIRAEQASKWYAQMGGWQKNSTLGESVIAMADGAAAKSTARDEQDALNDCPEEDRTSGGNTSAAEAMVTISHPYLADSRGNDGTDIYRYIHDEVLTGDPYYASCDRGVATAIRWSGTDDTFPAGPTAAQYEYVVGTGSGRWEEIGNLATMSENDLLPGDVLLGAPNHVAMYVSNEVVVDMLGPGNAEPNAAIGHASLNDRSPGLDTLSLDGWGVNFKVFRNTQAETNSVFSGVQIPAGKEIGEMTNPTRTTPAG

SEQ ID NO: 667 - DNA, 942 bp, Corynebacterium glutamicum
  CDS (59)..(919): FRXA01549
cagcttgcatttgctattagtggcgataatgaaagcgatcgcaaggtttttctggaaaatggttgataataaaaactccagtagcaatagccccaccgcagcgtccgagtacttcctgcgtgagtgggagcgcccggcagatgtcgcaggtaatgcacccattcgtgcagagcaagcatctaagtggtacgcgcagatgggtggttggcaaaagaactcaaccttgggtgagtctgtgatcgctatggctgatggtgcagcagcaaaatccacggcgcgtgatgagcaggatgctcttaatgattgtcctgaagaggaccgcacctcaggtggaaatacgtccgctgcagaagcaatggtgactatttcacatccttatctggctgattctcgtggcaatgacggtactgatatttaccgctatatccatgatgaagtgctcaccggtgatccgtattacgcatcctgtgaccgtggcgttgctaccgctattcgctggtcgggcacggatgatacgttcccagcaggtccaacagcagcacagtatgaatacgttgtgggcacaggatcgggccgttgggaggaaatcggcaatcttgccaccatgtcagagaacgatttgttacctggcgatgtgcttcttggtgcaccgaatcacgttgcgatgtatgtcagcaatgaggttgttgtggacatgttgggccctggtaatgcagagcctaatgcagctattggtcatgcatcgttgaatgaccgctcacctggtctggataccttgagtctggatggatggggcgtgaacttcaaggtgttccgcaacacccaggctgagacaaactcagtgttctctggtgtacagattccggctggtaaagaaattggcgaaatgactaacccaactcgaactactcctgcaggataagtttttttcatcgctgggtt

SEQ ID NO: 668 - protein, 287 aa, Corynebacterium glutamicum
MVDNKNSSSNSPTAASEYFLREWERPADVAGNAPIRAEQASKWYAQMGGWQKNSTLGESVIAMADGAAAKSTARDEQDALNDCPEEDRTSGGNTSAAEAMVTISHPYLADSRGNDGTDIYRYIHDEVLTGDPYYASCDRGVATAIRWSGTDDTFPAGPTAAQYEYVVGTGSGRWEEIGNLATMSENDLLPGDVLLGAPNHVAMYVSNEVVVDMLGPGNAEPNAAIGHASLNDRSPGLDTLSLDGWGVNFKVFRNTQAETNSVFSGVQIPAGKEIGEMTNPTRTTPAG

SEQ ID NO: 669 - DNA, 363 bp, Corynebacterium glutamicum
  CDS (46)..(363): FRXA02011
tgaattccgtttctagattttttttattgattgtgagagtgcattgtggctaatgattttatagaaccaaatgatgcccccgatgcacctgataatggtgactcgggaagctcggggtttgttgatgaagcaaaagataagacccgctcagctgcacaaggcttaggttatggcgcactacgtgtaggttttggtactgcagcacttgcagccaatggtgctcgctctatgggtaatttggctaaaaacctgtggacaccaatgatggggcttgccctgtctgccggtactggtatctctgctgccacaggtggcatgatcactgcacgtgtaggcgcaatgctggcaggtacaggctcggcg

SEQ ID NO: 670 - protein, 106 aa, Corynebacterium glutamicum
VANDFIEPNDAPDAPDNGDSGSSGFVDEAKDKTRSAAQGLGYGALRVGFGTAALAANGARSMGNLAKNLWTPMMGLALSAGTGISAATGGMITARVGAMLAGTGSA

SEQ ID NO: 671 - DNA, 939 bp, Corynebacterium glutamicum
  CDS (101)..(916): RXN01557
taaaggtgtgaaaatagttcctcacgtggggaactatactgatccttgatgcgttaacttgattgacgacgaaaaatcaattgaaaggatcggggactccgtgcgaagcagcaatcccgtttttagttcccttaaggaaactcaacgtccacaaggccagaacccatacggtggttacgacaacttcggtggtgtctaccagcaaaacgtagctccacagaaggcggagcgcccaatgactgtggatgatgtgatcaccaagactggtatcactctcgcggttattatcgtttttgcattggtcacctttggcgtgtggttggttagccccggcctcggaatgatcttgacccttgttggtgccatcggtggtttcatcaccgttctggtcagcaccttcggcaagaagtacggatctgcggcagtcactttgatttacgcagtattcgaaggcctcttcgtcggcggaatttcccttctgctgtccggcttcacagttggtaacgccaacgcaggtggcctcattggccaggcagtccttggcaccatcggtgtattcattggcatgctgtttgtatacaagactggcgctatcaaggtcactcctaagttcaaccgcatcctcaccggcatgatggttggcgtcctggttcttgtcctgggcaacgttgtatgggcactgttcactggtggcgcaagcccactgcgtgacggtggaatcatcgcgattatcttctccctcttctgcatcggcctggcagcattcagcttcctctccgacttcgatgcagctgaccgcctcgtccgcgaaggtgcaccttccaagatggcatggggcgttgcgcttggtcttgcagtgaccttggtctggctctacaccgaaatcctacgtctgcttagctacttccaaaaccgctagtttacgcagcacaagacccc

SEQ ID NO: 672 - protein, 272 aa, Corynebacterium glutamicum
VRSSNPVFSSLKETQRPQGQNPYGGYDNFGGVYQQNVAPQKAERPMTVDDVITKTGITLAVIIVFALVTFGVWLVSPGLGMILTLVGAIGGFITVLVSTFGKKYGSAAVTLIYAVFEGLFVGGISLLLSGFTVGNANAGGLIGQAVLGTIGVFIGMLFVYKTGAIKVTPKFNRILTGMMVGVLVLVLGNVVWALFTGGASPLRDGGIIAIIFSLFCIGLAAFSFLSDFDAADRLVREGAPSKMAWGVALGLAVTLVWLYTEILRLLSYFQNR

SEQ ID NO: 673 - DNA, 939 bp, Corynebacterium glutamicum; identical to SEQ ID NO: 671
  CDS (101)..(916): FRXA01557

SEQ ID NO: 674 - protein, 272 aa, Corynebacterium glutamicum; identical to SEQ ID NO: 672

SEQ ID NO: 675 - DNA, 1158 bp, Corynebacterium glutamicum
  CDS (101)..(1135): RXN01574
aaaaatccgcacaccccacattgctcaaaggaattgacaaggcgcttcgcaaggccgagtaaggtgggcaacgagtcggtgagagtatgaggaatatttgatgagcaacaaacgcatcggtgtagtgatcgtttcctacggacacgaacaagatgttgccaacctggtagacacatttgcagatcagctgaaaactggtgaccgcgtagttgtcgtggacaaccgcaaaccttgggtgttaaaagacgccgtgggggagcgcctggaaaaacacggcgcagagatcatcaaccacgacaacggtggtttcgccgctggctgcaacgtgggcgcagcgcacatcgtggatgacgttgacctgctgttcttcctcaaccccgacacagtgatcgacgatcccaccctgttcaattcgctgagacgcgtcgatgaacagtgggcagcattcatgccgtacctgctgcttcctgacagcaccattaactccgcaggcaacgccctgcatatttccggactgtcgtgggtgactggtctggatgaaaaaccagttgaaggctcatctgaagttaccgatatttccattgcctctggcgcctgccttgccgtgcgcgtggactggtggaaacgcctcggtggcatggaagaactgtatttcatgtaccacgaagacactgacttctccgcccgcttgctgctggccggcggtcgaattggtctcctgcattccgcgtatgtcacccaccattacgactacgccaagggtgactacaagtggatttacatcgaacgaaaccgacacgttttgctgctcagcgtgctgccgcttccattgctgttcgtgctgatcccgcagatcctcggtgtgaacctgggactgtgggcgattgccgcaaaggaaaagagggtcggactcaaggtgaagtcccttcgcctcctgatccgcgatctaccagcgattttcaaactgcgtaggagcacgcaggagcttgccgaactcacaccatcgcaatatctggcaaaaatggaatggcgcctagacaatcccaacctaggcaacattggatccaacaagattgttgcgactggatataagacctattacaagttgtgtatgagtatcctgaaattgctcgcttaacaccccataaagagggtgaa

SEQ ID NO: 676 - protein, 345 aa, Corynebacterium glutamicum
MSNKRIGVVIVSYGHEQDVANLVDTFADQLKTGDRVVVVDNRKPWVLKDAVGERLEKHGAEIINHDNGGFAAGCNVGAAHIVDDVDLLFFLNPDTVIDDPTLFNSLRRVDEQWAAFMPYLLLPDSTINSAGNALHISGLSWVTGLDEKPVEGSSEVTDISIASGACLAVRVDWWKRLGGMEELYFMYHEDTDFSARLLLAGGRIGLLHSAYVTHHYDYAKGDYKWIYIERNRHVLLLSVLPLPLLFVLIPQILGVNLGLWAIAAKEKRVGLKVKSLRLLIRDLPAIFKLRRSTQELAELTPSQYLAKMEWRLDNPNLGNIGSNKIVATGYKTYYKLCMSILKLLA

SEQ ID NO: 677 - DNA, 1158 bp, Corynebacterium glutamicum; identical to SEQ ID NO: 675
  CDS (101)..(1135): FRXA01574

SEQ ID NO: 678 - protein, 345 aa, Corynebacterium glutamicum; identical to SEQ ID NO: 676

SEQ ID NO: 679 - DNA, 1143 bp, Corynebacterium glutamicum
  CDS (101)..(1120): RXN01589
agggatgtagatgcgccctcatattggtacaaaaatataaattatcagcatgatttggacgctttaattcaaaaattgtaagctgttaggaggtccacaaatggtagaacaaataaaagataaactaggacgtcccatccgtgacttacggttatctgtgacagatcggtgtaactttaggtgtgattattgcatgcctaaagaggtatttggagatgatttcgtatttttacctaaaaatgaactgttaacgtttgatgaaatggctagaatcgctaaggtatatgcagaattaggtgtaaaaaaaatacgcattacaggtggagaaccattgatgcgacgcgatttagatgtacttatagctaaattaaatcaaatcgatggtattgaagatattggtttgactacaaatggtttgttattaaaaaagcatggacaaaagttatatgatgctgggctacgcagaattaatgtcagtttggatgctattgatgatacgctatttcaatcaatcaataatcgtaatattaaagcgactacgattttagaacaaattgattacgcgacgtctattggtttgaatgtaaaagtaaatgttgttatacaaaaaggtattaacgatgatcaaatcataccaatgcttgaatattttaaagataaacatatagagattcgatttatagaatttatggatgttggtaatgataatggatgggatttcagtaaagttgtaactaaagatgaaatgcttacaatgatagagcagcactttgaaatcgatcctgtagaaccaaaatattttggggaagtagcaaaatattatcgccataaggataatggtgttcaatttggtttgattacaagtgtttcacaatcattttgttctacatgtacacgcgcaaggctgtcatcagatgggaagttttacggatgtttatttgcaactgtcgatggatttaacgttaaagcgtttattcgttctggcgtgaccgacgaagaattaaaagaacaatttaaagctttatggcaaataagagatgatcgatattcagatgagagaactgctcaaacagttgccaatcgtcaacgtaaaaagataaacatgaattatattggtggttaatgtgtagggaccactacata

SEQ ID NO: 680 - protein, 340 aa, Corynebacterium glutamicum
MVEQIKDKLGRPIRDLRLSVTDRCNFRCDYCMPKEVFGDDFVFLPKNELLTFDEMARIAKVYAELGVKKIRITGGEPLMRRDLDVLIAKLNQIDGIEDIGLTTNGLLLKKHGQKLYDAGLRRINVSLDAIDDTLFQSINNRNIKATTILEQIDYATSIGLNVKVNVVIQKGINDDQIIPMLEYFKDKHIEIRFIEFMDVGNDNGWDFSKVVTKDEMLTMIEQHFEIDPVEPKYFGEVAKYYRHKDNGVQFGLITSVSQSFCSTCTRARLSSDGKFYGCLFATVDGFNVKAFIRSGVTDEELKEQFKALWQIRDDRYSDERTAQTVANRQRKKINMNYIGG

SEQ ID NO: 681 - DNA, 1425 bp, Corynebacterium glutamicum
  CDS (101)..(1402): RXN01592
gattcaatggtagaggtatttcatttcctcccattggatcacactctttttgtcgttctataataaagtctttacccggttctcaacatcaaggaacaacatggctgataacttcgaccgctctcgtgacaacgatcgctcaagcgaccgcactcctcgtggagaccgcggcgatcgcggtggctaccgaaactcccgcggcaacgatgaccgcggaaactaccgtcaaaaccgagatggtgaatcacgagatcgcggcggatacctcggtgaccgtcgcgacaaccgctcaggtgaatatcgtcaacgtgacgataggcgtgacgatcgtagggacaaccgaagcgatgaccgccgcggtggttaccgctccgatcgcaactttgacgatcgcaacagcaacatgcgtgatgatcgtcgcggcggcgaccgttcatacagccgtaatgatcgctccgatcgtggctatcgtagcaatgaccgctacgaccgtaatgatcgtcgcgatgacaacagggacaccaggggtggcgatcgcggagaccgtcgctacgacaggcgcgatgaccgacgtgatgatcgtcgcgatgatcgtcgtggcggacagggccaggggcgtccaggtggagatcgtcgacatgcgaaccgtgcaggtgcaggtcgcgatcagcagcgtgattcgctgcatccacagcgcgctggtttccgtgaagagcgcttgaacactcgtctcaatgagcctgatttgccgggcgatattgatatcaaggacttggatcctttggtcctgcaggatttgaaggttttgtctaaggacaacgcagatgccgtcgcaaagcatatgatcatggctgcgacctggctggccgacgatcctcaattggcactgcgccacgcccgtgctgcgaaggatcgcgcgggacgcgtgtccgtcgtgcgtgagacgaacggcattgctgcttaccatgctggtgagtggaaggaagctctttcggagcttcgtgctgcgcgccgcatgtcgggtggtcctggtttgattgctgtgatggctgactgtgagcgtggcttgggtcgtcctgagaaggcgattgagctggctcgagaagaggatttgagctctttggatcaggataacctgatcgagttagcgattgttgttgctggagcacgccatgatttgggtcagcatgactctgcgattgtggaattgcagaaggttaatccaagcttgaagagcaccggtttcacccattctcgtttgtcttacgcttacgccgatgcgcttgttttggctggtcgtggcgatgaagcacgtgagtggttccagcacgctgccaccttggatgaggacggctacctcgatgcagaggagcgtatcgagcagctcgataatgggaacaactagactattggtctagagtgtaa

SEQ ID NO: 682 - protein, 434 aa, Corynebacterium glutamicum
MADNFDRSRDNDRSSDRTPRGDRGDRGGYRNSRGNDDRGNYRQNRDGESRDRGGYLGDRRDNRSGEYRQRDDRRDDRRDNRSDDRRGGYRSDRNFDDRNSNMRDDRRGGDRSYSRNDRSDRGYRSNDRYDRNDRRDDNRDTRGGDRGDRRYDRRDDRRDDRRDDRRGGQGQGRPGGDRRHANRAGAGRDQQRDSLHPQRAGFREERLNTRLNEPDLPGDIDIKDLDPLVLQDLKVLSKDNADAVAKHMIMAATWLADDPQLALRHARAAKDRAGRVSVVRETNGIAAYHAGEWKEALSELRAARRMSGGPGLIAVMADCERGLGRPEKAIELAREEDLSSLDQDNLIELAIVVAGARHDLGQHDSAIVELQKVNPSLKSTGFTHSRLSYAYADALVLAGRGDEAREWFQHAATLDEDGYLDAEERIEQLDNGNN

SEQ ID NO: 683 - DNA, 1316 bp, Corynebacterium glutamicum
  CDS (1)..(1293): FRXA01592
aacttcgaccgctctcgtgacaacgatcgctcaagcgcccgcactcctcgtggagaccgcggcgatcgcggtggctaccgaaactcccgcggcaacgatgaccgcggaaactaccgtcaaaaccgagatggtgaatcacgagatcgcggcggatacctcggtgaccgtcgcgacaaccgctcaggtgaatatcgtcaacgtgacgataggcgtgacgatcgtagggacaaccgaagcgatgaccgccgcggtggttaccgctccgatcgcaactttgacgatcgcaacagcaacatgcgtgatgatcgtcgcggcggcgaccgttcatacagccgtaatgatcgctccgatcgtggctatcgtagcaatgaccgctacgaccgtaatgatcgtcgcgatgacaacagggacaccaggggtggcgatcgcggagaccgtcgctacgacaggcgcgatgaccgacgtgatgatcgtcgcgatgatcgtcgtggcggacagggccaggggcgtccaggtggagatcgtcgacatgcgaaccgtgcaggtgcaggtcgcgatcagcagcgtgattcgctgcatccacagcgcgctggtttccgtgaagagcgcttgaacactcgtctcaatgagcctgatttgccgggcgatattgatatcaaggacttggatcctttggtcctgcaggatttgaaggttttgtctaaggacaacgcagatgccgtcgcaaagcatatgatcatggctgcgacctggctggccgacgatcctcaattggcactgcgccacgcccgtgctgcgaaggatcgcgcgggacgcgtgtccgtcgtgcgtgagacgaacggcattgctgcttaccatgctggtgagtggaaggaagctctttcggagcttcgtgctgcgcgccgcatgtcgggtggtcctggtttgattgctgtgatggctgactgtgagcgtggcttgggtcgtcctgagaaggcgattgagctggctcgagaagaggatttgagctctttggatcaggataacctgatcgagttagcgattgttgttgctggagcacgccatgatttgggtcagcatgactctgcgattgtggaattgcagaaggttaatccaagcttgaagagcaccggtttcacccattctcgtttgtcttacgcttacgccgatgcgcttgttttggctggtcgtggcgatgaagcacgtgagtggttccagcacgctgccaccttggatgaggacggctacctcgatgcagaggagcgtatcgagcagctcgataatgggaacaactagactattggtctagagtgtaa

SEQ ID NO: 684 - protein, 431 aa, Corynebacterium glutamicum
NFDRSRDNDRSSARTPRGDRGDRGGYRNSRGNDDRGNYRQNRDGESRDRGGYLGDRRDNRSGEYRQRDDRRDDRRDNRSDDRRGGYRSDRNFDDRNSNMRDDRRGGDRSYSRNDRSDRGYRSNDRYDRNDRRDDNRDTRGGDRGDRRYDRRDDRRDDRRDDRRGGQGQGRPGGDRRHANRAGAGRDQQRDSLHPQRAGFREERLNTRLNEPDLPGDIDIKDLDPLVLQDLKVLSKDNADAVAKHMIMAATWLADDPQLALRHARAAKDRAGRVSVVRETNGIAAYHAGEWKEALSELRAARRMSGGPGLIAVMADCERGLGRPEKAIELAREEDLSSLDQDNLIELAIVVAGARHDLGQHDSAIVELQKVNPSLKSTGFTHSRLSYAYADALVLAGRGDEAREWFQHAATLDEDGYLDAEERIEQLDNGNN

SEQ ID NO: 685 - DNA, 1305 bp, Corynebacterium glutamicum
  CDS (101)..(1282): RXN01597
gagtagaaccacttctcgccgccagtgcataagagttttcttggaattttttaggcgcgcctccaccaaaggttgagactttggttccacaatgggctgcatgagtctgttcaaccgcaaagccgacctgcccggcctgcaaggtgccacccgaatctgcaccccgcagggcaaagggctaaagcgcctgtccgaaggcgatctcgcaatcattgatgcaccagatctatccaggaccttcgcccaacgattgctagcagcaaaacccgccgcagtcctcaacgtttcccggttcaccaccggatcggtgcccaactttggaccgcaaatgcttatcgacggcggcatccagctcgtggaaggctttggccaggagctgctcgacggcaccaaagacggtaagaaaggtcgcctgacagaagatggacagctcttctacggcgaacgactgatctctaacggcagtgttctcagtggacctgcggctgaaaatgcatttgcagacgcccagcaatcactgctggaccgcatggaagcctatttcggcaacaccattcagttcattcactcagaagcaccgctcctgatcgatggcctcggcattcccgataccggaaatgccattgaaggccgcaaagttctcattgcctcaccaggggataaccaccgcagcaggctcaaagaactccgcagcttcatccgcgaatacgatccagtactcatcggtgtcgatggggcagcagacaccttggtggaattggggtacaagcccgcgctgatcgtcggcaatcccactggtatcggcgcagatgcgctgcgcagtggcgccaacgtaattttgccagctgatccagacggccacgctgttggtctggagcgcatccaggatcttggcatcggtgcgatgaccttcccatcctcagtaaattcctccacggatctggcgctcctgcttgcggatttccacaacccgcagatgatcgtcaacgtcggcggtcctgtcacccttgatggtgtttttgaaaaccgagaagattccgatcccgcggcgcttttgacgcgcgccaagctaggcaccaagcttgtcgacggatccgtcatcgcaagtctttacacagtgcgcagctccagcaaccttggatggatgtgggcactgttagccattttggtggttcttgcagtcgtgattgttatcgctggcaccgcaggatcaggctcttttaccgacaacctcattgacacctggaacagcttcgcgctgacagtgcagggttggttcaaataggaaggcaacatggctaaacg

SEQ ID NO: 686 - protein, 394 aa, Corynebacterium glutamicum
MSLFNRKADLPGLQGATRICTPQGKGLKRLSEGDLAIIDAPDLSRTFAQRLLAAKPAAVLNVSRFTTGSVPNFGPQMLIDGGIQLVEGFGQELLDGTKDGKKGRLTEDGQLFYGERLISNGSVLSGPAAENAFADAQQSLLDRMEAYFGNTIQFIHSEAPLLIDGLGIPDTGNAIEGRKVLIASPGDNHRSRLKELRSFIREYDPVLIGVDGAADTLVELGYKPALIVGNPTGIGADALRSGANVILPADPDGHAVGLERIQDLGIGAMTFPSSVNSSTDLALLLADFHNPQMIVNVGGPVTLDGVFENREDSDPAALLTRAKLGTKLVDGSVIASLYTVRSSSNLGWMWALLAILVVLAVVIVIAGTAGSGSFTDNLIDTWNSFALTVQGWFK

SEQ ID NO: 687 - DNA, 1305 bp, Corynebacterium glutamicum; identical to SEQ ID NO: 685
  CDS (101)..(1282): FRXA01597

SEQ ID NO: 688 - protein, 394 aa, Corynebacterium glutamicum; identical to SEQ ID NO: 686

SEQ ID NO: 689 - DNA, 1086 bp, Corynebacterium glutamicum
  CDS (101)..(1063): RXN01598
cgctggcaccgcaggatcaggctcttttaccgacaacctcattgacacctggaacagcttcgcgctgacagtgcagggttggttcaaataggaaggcaacatggctaaacgacgtggaagaggcgccgcaaccttcgccgcactgggatttggtgcagcagccggcattgcctttggaacttatgtgcttgcacccaaccttcctgaaaacattgacccaaatgcaccaacatcagctgaattagtcgaggcagagaccttggctgaggttaatgcggtgcaggccgatcaagcagacagcatcattgaccacatcgtggaagacgtggtggctggcacactgaccgatcgccccgtactggtgatgcgcaccgctgacgctgaagaatcagacgttgccgatgtgtcatggctgttgcagcaagcaggagctattaatgctggatccattacacttgaggagaatttcttctcccaagacggcgcggaccagctgaaatcaatcgtggcaaatacgttgcctgcaggcgctcagctttctgaaacccaactggatccaggaactcacgctggcgaggcacttggtgccgctttgctgctcaaccctgaaactggtgaaccactagccagcactgcagagcgcggactattgctcaacgtgctgcgcgacaacggttacatctcgtacgaagacggcaccattttgccaggccaggtcatcgtgatgattactggcgatagcgacggctcaggtgatggtgccttcgctgcagaaacacaatcgctgtttgctcgcgcacttgacgcccaaggatcaggcgtggtggttgcaggacgtattcacactgctgctgatactggagttattggacggcttcgtgccaaccctgatgctgcagaaaacgtctctacaattgattccgtgaatcgtacttggggcaagatggctaccgtgctatcagttcgtgaggaactagccggtaggtctggagcgtttggttccgctgcctccgcagacgcggcaagtccgtctctcgatggaactgcagcagcgccagcgcagtaggttttccaagcctttaaaac

SEQ ID NO: 690 - protein, 321 aa, Corynebacterium glutamicum
MAKRRGRGAATFAALGFGAAAGIAFGTYVLAPNLPENIDPNAPTSAELVEAETLAEVNAVQADQADSIIDHIVEDVVAGTLTDRPVLVMRTADAEESDVADVSWLLQQAGAINAGSITLEENFFSQDGADQLKSIVANTLPAGAQLSETQLDPGTHAGEALGAALLLNPETGEPLASTAERGLLLNVLRDNGYISYEDGTILPGQVIVMITGDSDGSGDGAFAAETQSLFARALDAQGSGVVVAGRIHTAADTGVIGRLRANPDAAENVSTIDSVNRTWGKMATVLSVREELAGRSGAFGSAASADAASPSLDGTAAAPAQ

SEQ ID NO: 691 - DNA, 1086 bp, Corynebacterium glutamicum; identical to SEQ ID NO: 689
  CDS (101)..(1063): FRXA01598

SEQ ID NO: 692 - protein, 321 aa, Corynebacterium glutamicum; identical to SEQ ID NO: 690

SEQ ID NO: 693 - DNA, 507 bp, Corynebacterium glutamicum
  CDS (101)..(484): RXN01618
ggccgtgcgcgcctccagcgagcctggccgtgccggaaaagtgctcattcgtttctaaacgtttaaggcccattagacccctgatttaaaaggatctcacatgatcattatcggagcagttttcgccatcctcgcagttctactgcatgttttcatcttctacatggaatcattcgcatggactagtgagaaagcacgtggagttttcggcaccaccgaaatcgacgccgaaaacaccaaggagatggcctacaaccaaggcttctacaacttcttcctggcagtcatcgccggcgtgggtgttgcgttcctcttcgctggttcaactggcatcggcgcagccctcgcactcgctggcaccggttccatgctggcagccgctgcagtgttggctttgagctcacccgacaagcgtggtgcagccttcaagcaaggcacgttcccgctgctcgcagtggtgttccttgtgattggattgctggtttaagcagttttttaaaggaactt

SEQ ID NO: 694 - protein, 128 aa, Corynebacterium glutamicum
MIIIGAVFAILAVLLHVFIFYMESFAWTSEKARGVFGTTEIDAENTKEMAYNQGFYNFFLAVIAGVGVAFLFAGSTGIGAALALAGTGSMLAAAAVLALSSPDKRGAAFKQGTFPLLAVVFLVIGLLV

SEQ ID NO: 695 - DNA, 507 bp, Corynebacterium glutamicum; identical to SEQ ID NO: 693
  CDS (101)..(484): FRXA01618

SEQ ID NO: 696 - protein, 128 aa, Corynebacterium glutamicum; identical to SEQ ID NO: 694

SEQ ID NO: 697 - DNA, 675 bp, Corynebacterium glutamicum
  CDS (101)..(652): RXN01634
attggatctaggaaaaattatgaacatctcaaagctcggactgaggatcgcggtcacagcaacggcgaccacaacggcgcttgccctcggtggcacgcacatggcagttggtcaagaaactgatctgctcaacgctatggaaacactcgctggggttccctcagacttggtggtcactgaaatcctccccgataccaccagctatgacaattttgaattctttgaagttcacaacaccggcagtgcacccgtgaccattggggaaggggagtacaccttcgcctattcctttgacgattccgccgatacgtcccgcgacaaggcactggatcttggcggggaagtcacggtagatgcaggcgaaaccattgtggtgtggattgagtactccagttcaactgttgataccgctgcgtttagtgagcaagacttccgtgatttctacggcatggattcctcagcccgcatcttccgagcaactggccaggcgggtctcgctaacggtggtgatcgtggcatccgagttctgtacaatggtgaagtttctggttggtcccactacccatcagatagcgcagcggttcaaaagggaattgacttcgcgctgccaaaagtaggggagcaggccagcattgcaagtgcgcaccaaaactgatccaactccaggatcaatta

SEQ ID NO: 698 - protein, 184 aa, Corynebacterium glutamicum
MAVGQETDLLNAMETLAGVPSDLVVTEILPDTTSYDNFEFFEVHNTGSAPVTIGEGEYTFAYSFDDSADTSRDKALDLGGEVTVDAGETIVVWIEYSSSTVDTAAFSEQDFRDFYGMDSSARIFRATGQAGLANGGDRGIRVLYNGEVSGWSHYPSDSAAVQKGIDFALPKVGEQASIASAHQN

SEQ ID NO: 699 - DNA, 675 bp, Corynebacterium glutamicum; identical to SEQ ID NO: 697
  CDS (101)..(652): FRXA01634

SEQ ID NO: 700 - protein, 184 aa, Corynebacterium glutamicum; identical to SEQ ID NO: 698

SEQ ID NO: 701 - DNA, 864 bp, Corynebacterium glutamicum
  CDS (101)..(841): RXN01635
agggaattgacttcgcgctgccaaaagtaggggagcaggccagcattgcaagtgcgcaccaaaactgatccaactccaggatcaattacttctgatcaagttgattcctggcggattggacactccagaagagcctgaagcccctgaagactctctttttgaagggcgcactccccctagggatgcaagcacccgcttgatcctcactgaactaatggtcaactccaccaacatgggcagttctgatggttttgagtatgtggaaatcaccaacactactgccgaacccatcgatttttccgattacaccttgaactacctgtacccgcaggatgagttcaccaacaccaacgaagccgtctgggctgcggaacctggtgatgtcattattcagcctggaaaatctctcgtgttttggatcaaaaatggccccaatgatgaggcaaccgcagcagatttcaatgcagaatatggcaccaacctggaggctggaaaagaccttgttgaaatctcctcaggtgggatggccaatggtactgccagaggaatgcagattcagaccaacactggccacatagtcaaccgtggtttctacaacatggctggcgcttctgatgtgaaagccaacgagggtcttcatttcgcagtggatgagtctgatcttctgaagcaaacgcttgtcggcagcggtgcgccaaccccgggcactgtgtacacttcgcagattcctaatccactgtctgccgttatcgctgattcttctgtaccactcatcacagataataccgcaaccagtatcaaccctgcggagccgtttaccttcgccttcaaatatcaccgatgatgtccaggtgcgcacggcaa

SEQ ID NO: 702 - protein, 247 aa, Corynebacterium glutamicum
LIPGGLDTPEEPEAPEDSLFEGRTPPRDASTRLILTELMVNSTNMGSSDGFEYVEITNTTAEPIDFSDYTLNYLYPQDEFTNTNEAVWAAEPGDVIIQPGKSLVFWIKNGPNDEATAADFNAEYGTNLEAGKDLVEISSGGMANGTARGMQIQTNTGHIVNRGFYNMAGASDVKANEGLHFAVDESDLLKQTLVGSGAPTPGTVYTSQIPNPLSAVIADSSVPLITDNTATSINPAEPFTFAFKYHR

SEQ ID NO: 703 - DNA, 864 bp, Corynebacterium glutamicum; identical to SEQ ID NO: 701
  CDS (101)..(841): FRXA01635

SEQ ID NO: 704 - protein, 247 aa, Corynebacterium glutamicum; identical to SEQ ID NO: 702

SEQ ID NO: 705 - DNA, 1293 bp, Corynebacterium glutamicum
  CDS (101)..(1270): RXN01647
gctgggggaatacatggctgaaggcatgttgatgcccacgacatcggcgcaggtgtcggggcataaatttctggtgcggcgcatcgaacatgggttggtgatgggcgatgtgcgcatgattcatgatccacttggtaggcgccggcgggcgttggtgtttggggtggtggcgtgcgtgatgttggcggtgggatcattggcgttggctatttttcgacccgcgaaggatccggccgatgcgccgttgatccgctctgaatccggcgcgctctttgtgcagctggatgggtcggtgcatccggtggctaatgtggcctcggctcggttgattgtgggggagccggtggatccggtgaacgccagcgatgcgatcatcgcgggcatgccgcgcggagtgccggtgggggttcctgatgcgccggggcttttcagcagcaccgaagaacccgagcaagattggtttgtgtgccaggatgtcggcactggggatctacacattacggttcctaggggcggactagggcccaccctgattgcggaaggaaatgggtggctgggggcgtcgaaaagcgaaaccggcgaggtcacctggaacctgattaccgcggacgggcgccgcgaactgccggcgtggggcagcgaacatgggcgcattatgcgccgccacctggggatttccgaggacaccccgcgcgtatacctgaccactgagctgctcaacgcgatccccgagcacgacgcggtccgcttcccagccccgctgcccgagcttgtcgacgcctccacccgcaactggttacggctcgacggggcgctcgccgaaatcacgccgctacagcgcgggttgcttatcgacgccggttccggtgttttccccgaccccaccgcgcttcttggtgtgcatgaagaaacagccaacaccttgacgctgcccgagcaaacagtttcttggcaagatctggacggtggttttgcctgcgcggatggtgaaggccagatcggtttcctggaaactctggaatcgggggtggcgctatctggtgattccagggcgaaaagtttcagcacaaacgctggtggggcagtgggcgtggacagtggctttggctactatgtggtctctgattttgggctgatgcaccctgtttctactggtgaatcgatggttgccctaggaatcactgacgtgcaggtcgtgccgtggagcgtgctgcgattgttgccgcagggaagtgaattagcaaaagagacagcgctcgcgcccacctattaaggagtatggtggccttacat

SEQ ID NO: 706 - protein, 390 aa, Corynebacterium glutamicum
MGDVRMIHDPLGRRRRALVFGVVACVMLAVGSLALAIFRPAKDPADAPLIRSESGALFVQLDGSVHPVANVASARLIVGEPVDPVNASDAIIAGMPRGVPVGVPDAPGLFSSTEEPEQDWFVCQDVGTGDLHITVPRGGLGPTLIAEGNGWLGASKSETGEVTWNLITADGRRELPAWGSEHGRIMRRHLGISEDTPRVYLTTELLNAIPEHDAVRFPAPLPELVDASTRNWLRLDGALAEITPLQRGLLIDAGSGVFPDPTALLGVHEETANTLTLPEQTVSWQDLDGGFACADGEGQIGFLETLESGVALSGDSRAKSFSTNAGGAVGVDSGFGYYVVSDFGLMHPVSTGESMVALGITDVQVVPWSVLRLLPQGSELAKETALAPTY

SEQ ID NO: 707 - DNA, 911 bp, Corynebacterium glutamicum
  CDS (1)..(888): FRXA01647
atgccgcgcggagtgccggtgggggttcctgatgcgccggggcttttcagcagcaccgaagaacccgagcaagattggtttgtgtgccaggatgtcggcactggggatctacacattacggttcctaggggcggactagggcccaccctgattgcggaaggaaatgggtggctgggggcgtcgaaaagcgaaaccggcgaggtcacctggaacctgattaccgcggacgggcgccgcgaactgccggcgtggggcagcgaacatgggcgcattatgcgccgccacctggggatttccgaggacaccccgcgcgtatacctgaccactgagctgctcaacgcgatccccgagcacgacgcggtccgcttcccagccccgctgcccgagcttgtcgacgcctccacccgcaactggttacggctcgacggggcgctcgccgaaatcacgccgctacagcgcgggttgcttatcgacgccggttccggtgttttccccgaccccaccgcgcttcttggtgtgcatgaagaaacagccaacaccttgacgctgcccgagcaaacagtttcttggcaagatctggacggtggttttgcctgcgcggatggtgaaggccagatcggtttcctggaaactctggaatcgggggtggcgctatctggtgattccagggcgaaaagtttcagcacaaacgctggtggggcagtgggcgtggacagtggctttggctactatgtggtctctgattttgggctgatgcaccctgtttctactggtgaatcgatggttgccctaggaatcactgacgtgcaggtcgtgccgtggagcgtgctgcgattgttgccgcagggaagtgaattagcaaaagagacagcgctcgcgcccacctattaaggagtatggtggccttacat

SEQ ID NO: 708 - protein, 296 aa, Corynebacterium glutamicum
MPRGVPVGVPDAPGLFSSTEEPEQDWFVCQDVGTGDLHITVPRGGLGPTLIAEGNGWLGASKSETGEVTWNLITADGRRELPAWGSEHGRIMRRHLGISEDTPRVYLTTELLNAIPEHDAVRFPAPLPELVDASTRNWLRLDGALAEITPLQRGLLIDAGSGVFPDPTALLGVHEETANTLTLPEQTVSWQDLDGGFACADGEGQIGFLETLESGVALSGDSRAKSFSTNAGGAVGVDSGFGYYVVSDFGLMHPVSTGESMVALGITDVQVVPWSVLRLLPQGSELAKETALAPTY

SEQ ID NO: 709 - DNA, 1856 bp, Corynebacterium glutamicum
  CDS (1)..(1833): RXN01658
gatccacagatcctgtcaccaaccttcacccagcaacagcagctgcgaaacttctacggtttcccagaccagctggcgatggaccgctttgaagtagatggcaaactccgcgactttgttgtggcagcacgtgagctcgatccaaacgccctgcagcaaaaccagcaggactggattaaccgtcacactgtttatacccacggcaacggcttcattgcagctcaagcaaaccaggtggatgaggtcgcccgcgacgtcggatccactcgtggtggttaccctgtctacaccgtctctgatttgcagtcgaatgctcgtgctgcagaaagcgaagatgctgaggagcttggcatcaaggttgatgagcctcgtgtgtactacggaccactgattgcttctgcgactgatggtgctgactacgcaattgtcggtgacaccggcgatggcccagtcgagtacgacactgacacctccagctacacctacgaaggtgctggcggcgtggacattggaaacatggtcaaccgtgcgatgtttgcattgcgctaccaggaaatgaacatgctcctgtctgatcgtgttggttccgaatccaagatcctatttgagcgcgatcctcgttcccgtgtggaaaaggttgcaccttggttgaccactgactccaagacctacccaactgtgattgatggtcgcatcaagtggatcgtcgatggctacaccaccttggatagtcttccgtactccacgcgcacctcactgacggaagcgactcaggatgctgtcatgcctgacggcaccccacagccactgatcacagatagggtcggttacatccgcaactccgtgaaggctgttgttgatgcgtacgacggaactgttgaactctacgaattcgacaccgaagatcctgttctgaaggcatggcgtggcgtgttcccagacaccgtgaaggacgggtcggagatttccgatgagcttcgcgcacacctgcgttacccagaagatttgttcaaggtccagcgtgacatgctggccaagtacaacgttgatgattctggaacattcttcaccaacgatgcgttctggtctgtcccaggtgacccaactgcagcggagggccgccaggaacttaagcagcctccttactacgtggtggcagcagacccagagaccggtgagtccagcttccagctgatcaccccgttccgtggacttcagcgcgagtacctctctgcacacatgtctgcgtcgtctgatccagttacctacggtgaaatcactgttcgtgtgctgcctaccgattctgtgacccagggtccaaagcaggcccaggatgcgatgatgtcatctgaccaggttgctcaggaccaaacactgtggcgtggatcgaacgatctgcacaacggaaacctgttgaccttgccagttggtggcggagagatcctctacgttgagccgatttactcgcagcgcaaggatcaggcatcggccttcccgaagcttctgcgcgtgctggtcttctacaagggtcaggttggttacgcaccaacgatcgctgaagccctatcgcaggtcggcattgatccgaaggaagcgcaggacatcgaagaggtagatggcaccgctacgacgccatcgactgatgagactgacactgacactgatcagcctgcaaccgaaaccccaactgcaccagtgagtgaggcggaaggaatcgcggccatcaacgatgcgttgagcaaccttgaagctgctcgcgatagctctttcgaagagtatggtcgtgcactcgatgcgcttgatcgtgccgtcgatagctaccagtccgcacagtagcgtttgagtaaacagcccga

SEQ ID NO: 710 - protein, 611 aa, Corynebacterium glutamicum
DPQILSPTFTQQQQLRNFYGFPDQLAMDRFEVDGKLRDFVVAARELDPNALQQNQQDWINRHTVYTHGNGFIAAQANQVDEVARDVGSTRGGYPVYTVSDLQSNARAAESEDAEELGIKVDEPRVYYGPLIASATDGADYAIVGDTGDGPVEYDTDTSSYTYEGAGGVDIGNMVNRAMFALRYQEMNMLLSDRVGSESKILFERDPRSRVEKVAPWLTTDSKTYPTVIDGRIKWIVDGYTTLDSLPYSTRTSLTEATQDAVMPDGTPQPLITDRVGYIRNSVKAVVDAYDGTVELYEFDTEDPVLKAWRGVFPDTVKDGSEISDELRAHLRYPEDLFKVQRDMLAKYNVDDSGTFFTNDAFWSVPGDPTAAEGRQELKQPPYYVVAADPETGESSFQLITPFRGLQREYLSAHMSASSDPVTYGEITVRVLPTDSVTQGPKQAQDAMMSSDQVAQDQTLWRGSNDLHNGNLLTLPVGGGEILYVEPIYSQRKDQASAFPKLLRVLVFYKGQVGYAPTIAEALSQVGIDPKEAQDIEEVDGTATTPSTDETDTDTDQPATETPTAPVSEAEGIAAINDALSNLEAARDSSFEEYGRALDALDRAVDSYQSAQ

SEQ ID NO: 711 - DNA, 1485 bp, Corynebacterium glutamicum
  CDS (1)..(1485): FRXA01658
gatccacagatcctgtcaccaaccttcacccagcaacagcagctgcgaaacttctacggtttcccagaccagctggcgatggaccgctttgaagtagatggcaaactccgcgactttgttgtggcagcacgtgagctcgatccaaacgccctgcagcaaaaccagcaggactggattaaccgtcacactgtttatacccacggcaacggcttcattgcagctcaagcaaaccaggtggatgaggtcgcccgcgacgtcggatccactcgtggtggttaccctgtctacaccgtctctgatttgcagtcgaatgctcgtgctgcagaaagcgaagatgctgaggagcttggcatcaaggttgatgagcctcgtgtgtactacggaccactgattgcttctgcgactgatggtgctgactacgcaattgtcggtgacaccggcgatggcccagtcgagtacgacactgacacctccagctacacctacgaaggtgctggcggcgtggacattggaaacatggtcaaccgtgcgatgtttgcattgcgctaccaggaaatgaacatgctcctgtctgatcgtgttggttccgaatccaagatcctatttgagcgcgatcctcgttcccgtgtggaaaaggttgcaccttggttgaccactgactccaagacctacccaactgtgattgatggtcgcatcaagtggatcgtcgatggctacaccaccttggatagtcttccgtactccacgcgcacctcactgacggaagcgactcaggatgctgtcatgcctgacggcaccccacagccactgatcacagatagggtcggttacatccgcaactccgtgaaggctgttgttgatgcgtacgacggaactgttgaactctacgaattcgacaccgaagatcctgttctgaaggcatggcgtggcgtgttcccagacaccgtgaaggacgggtcggagatttccgatgagcttcgcgcacacctgcgttacccagaagatttgttcaaggtccagcgtgacatgctggccaagtacaacgttgatgattctggaacattcttcaccaacgatgcgttctggtctgtcccaggtgacccaactgcagcggagggccgccaggaacttaagcagcctccttactacgtggtggcagcagacccagagaccggtgagtccagcttccagctgatcaccccgttccgtggacttcagcgcgagtacctctctgcacacatgtctgcgtcgtctgatccagttacctacggtgaaatcactgttcgtgtgctgcctaccgattctgtgacccagggtccaaagcaggcccaggatgcgatgatgtcatctgaccaggttgctcaggaccaaacactgtggcgtggatcgaacgatctgcacaacggaaacctgttgaccttgccagttggtggcggagagatcctctacgttgagccgatttactcgcagcgcaaggatcaggca

SEQ ID NO: 712 - protein, 495 aa, Corynebacterium glutamicum
DPQILSPTFTQQQQLRNFYGFPDQLAMDRFEVDGKLRDFVVAARELDPNALQQNQQDWINRHTVYTHGNGFIAAQANQVDEVARDVGSTRGGYPVYTVSDLQSNARAAESEDAEELGIKVDEPRVYYGPLIASATDGADYAIVGDTGDGPVEYDTDTSSYTYEGAGGVDIGNMVNRAMFALRYQEMNMLLSDRVGSESKILFERDPRSRVEKVAPWLTTDSKTYPTVIDGRIKWIVDGYTTLDSLPYSTRTSLTEATQDAVMPDGTPQPLITDRVGYIRNSVKAVVDAYDGTVELYEFDTEDPVLKAWRGVFPDTVKDGSEISDELRAHLRYPEDLFKVQRDMLAKYNVDDSGTFFTNDAFWSVPGDPTAAEGRQELKQPPYYVVAADPETGESSFQLITPFRGLQREYLSAHMSASSDPVTYGEITVRVLPTDSVTQGPKQAQDAMMSSDQVAQDQTLWRGSNDLHNGNLLTLPVGGGEILYVEPIYSQRKDQA

SEQ ID NO: 713 - DNA, 669 bp, Corynebacterium glutamicum
  CDS (101)..(646): RXN01659
ttgatgcgcgccgcggtgagcagcctgccgatccagagcgtgaagaatctgatgatttagtcgagattgataccgtctctggattccgcctgctcagtacgtggcgggggttgcgcagcgttttgtcgacgagcgcattcacgtcggtttggattccatgccagaagctgtgactgctgtgtggatggaatctgattgggtgttggcggaaaccatcaagggttccacgccttccgattgggaagagattttgcggccgttggcgctgctcacggacgcgtctttcacgttgccacctcgttccacgcgtgcgcaaaccttggatttgaagcatttggaaccaagccgtctgaagccggagcagccagaaaagccagcgtttactcccaatgcttcggaagaagatttgtctcagccgttggtgatccgccccgaggagccgttgcagatgccggttcgcggtgtgcaggaaagccgcggagtggtcgagccacggtcattgggtgcggatgatgtggagtcgattgcggagggcgatccagagcgtccgagcgatctttatggcacgcgtgtgctgcgtgatctcaatggtcagtccagtattttccaagattccaccgacgcggatgagccaccaaaaaagtggtagaaaactggtgtttttcggcc

SEQ ID NO: 714 - protein, 182 aa, Corynebacterium glutamicum
VAGVAQRFVDERIHVGLDSMPEAVTAVWMESDWVLAETIKGSTPSDWEEILRPLALLTDASFTLPPRSTRAQTLDLKHLEPSRLKPEQPEKPAFTPNASEEDLSQPLVIRPEEPLQMPVRGVQESRGVVEPRSLGADDVESIAEGDPERPSDLYGTRVLRDLNGQSSIFQDSTDADEPPKKW

SEQ ID NO: 715 - DNA, 509 bp, Corynebacterium glutamicum
  CDS (1)..(486): FRXA01659
ccagaagctgtgactgctgtgtggatggaatctgattgggtgttggcggaaaccatcaagggttccacgccttccgattgggaagagattttgcggccgttggcgctgctcacggacgcgtctttcacgttgccacctcgttccacgcgtgcgcaaaccttggatttgaagcatttggaaccaagccgtctgaagccggagcagccagaaaagccagcgtttactcccaatgcttcggaagaagatttgtctcagccgttggtgatccgccccgaggagccgttgcagatgccggttcgcggtgtgcaggaaagccgcggagtggtcgagccacggtcattgggtgcggatgatgtggagtcgattgcggagggcgatccagagcgtccgagcgatctttatggcacgcgtgtgctgcgtgatctcaatggtcagtccagtattttccaagattccaccgacgcggatgagccaccaaaaaagtggtagaaaactggtgtttttcggcc

SEQ ID NO: 716 - protein, 162 aa, Corynebacterium glutamicum
PEAVTAVWMESDWVLAETIKGSTPSDWEEILRPLALLTDASFTLPPRSTRAQTLDLKHLEPSRLKPEQPEKPAFTPNASEEDLSQPLVIRPEEPLQMPVRGVQESRGVVEPRSLGADDVESIAEGDPERPSDLYGTRVLRDLNGQSSIFQDSTDADEPPKKW

SEQ ID NO: 717 - DNA, 981 bp, Corynebacterium glutamicum
  CDS (101)..(958): RXN01663
tattttgctggttggtcacagtggagcgctaaccccgagaatcctatcgaggcctaaaatcgtggcttgagtacgcactgccagtaaggtgtgtgatgtgatggaaataagtgtcttgatcatcgccgcactgatcttggtggcaggcatcgtactgtggcgcgcggactcgtctaaacaggcagctaaaaaggctgaatcacctgtgggctcagtcgcacctgcgcccgtgctggttgaagaagagccggaccctgagtttgagccagaactggaccctgaaccagaagcgcaaccagaaccagagctggaagttgcgcctagatttgcgccagaaccagttcaagatcttgagccggatcaggctgaggacatttattttgatgattcccctgaactcgatgctgatgttgaaaatgccttggctgagcttactgaggtagaagactacccggaagagccagtgcagtctgagcaacctcaagcccctgccacggcggaggtagctgcggacgaggagcaacggggcgtcgataagcattcgtttttgagctctttgcctggttcgcagcgccgggagcgccgaaactgggcggcgaagcaccacttcgatttcatcaaggaagatgcctttttgaccgatgaatggtcaaggggtgcggcatcgactggtgccgttgcacgtgatgtggtcagtggcatggctgaaggatatgaaacgcatctggtggatttggcgggcgtgcccgtgatggcgatgcgccgtggaattacctctgacgtggtcattgatgcgcgccgcggtgagcagcctgccgatccagagcgtgaagaatctgatgatttagtcgagattgataccgtctctggattccgcctgctcagtacgtggcgggggttgcgcagcgttttgtcgacgagcgcattcacgtcggtttggattccatgccagaagctgtgactgctgtgtggatggaatct

SEQ ID NO: 718 - protein, 286 aa, Corynebacterium glutamicum
MEISVLIIAALILVAGIVLWRADSSKQAAKKAESPVGSVAPAPVLVEEEPDPEFEPELDPEPEAQPEPELEVAPRFAPEPVQDLEPDQAEDIYFDDSPELDADVENALAELTEVEDYPEEPVQSEQPQAPATAEVAADEEQRGVDKHSFLSSLPGSQRRERRNWAAKHHFDFIKEDAFLTDEWSRGAASTGAVARDVVSGMAEGYETHLVDLAGVPVMAMRRGITSDVVIDARRGEQPADPEREESDDLVEIDTVSGFRLLSTWRGLRSVLSTSAFTSVWIPCQKL

SEQ ID NO: 719 - DNA, 535 bp, Corynebacterium glutamicum
  CDS (101)..(535): FRXA01663
tattttgctggttggtcacagtggagcgctaaccccgagaatcctatcgaggcctaaaatcgtggcttgagtacgcactgccagtaaggtgtgtgatgtgatggaaataagtgtcttgatcatcgccgcactgatcttggtggcaggcatcgtactgtggcgcgcggactcgtctaaacaggcagctaaaaaggctgaatcacctgtgggctcagtcgcacctgcgcccgtgctggttgaagaagagccggaccctgagtttgagccagaactggaccctgaaccagaagcgcaaccagaaccagagctggaagttgcgcctagatttgcgccagaaccagttcaagatcttgagccggatcaggctgaggacatttattttgatgattcccctgaactcgatgctgatgttgaaaatgccttggctgagcttactgaggtagaagactacccggaagagccagtgcagtctgagcaacctcaagcccctgccacggcggaggtagctgcggacgaggagcaacggggcgtcgat

SEQ ID NO: 720 - protein, 145 aa, Corynebacterium glutamicum
MEISVLIIAALILVAGIVLWRADSSKQAAKKAESPVGSVAPAPVLVEEEPDPEFEPELDPEPEAQPEPELEVAPRFAPEPVQDLEPDQAEDIYFDDSPELDADVENALAELTEVEDYPEEPVQSEQPQAPATAEVAADEEQRGVD

SEQ ID NO: 721 - DNA, 1038 bp, Corynebacterium glutamicum
  CDS (101)..(1015): RXN01669
cacccacagtcaccaagaacatagccactccacacacaaccactccacacacaaccacgagggtcacgaccaccatcaccccaccggattcaaaggatttttgtacgagattttcgttccacactcccatgacaccgccgactcgattgatgatgctatggaggcgaactcagagggtattcgagcgctgaagtttagccttgtattgatgctgctcacgacggttttgcaggctatcattgtgtctttttctggatctgttgcactgttggcggatacggttcacaacctttccgacgcattgactgcgattcctctttggattgctttcatactttcccggcgcgcagcgactcaaaaatatacgtatggattcaatcgtgcagaggatttagcggggttgtttattgtcgcgatgattgctctttcggcgattgttgctgcatggcaggcgatcgaccggatgattaatcctcgcccgatggagaatattgaatgggtgattgcggcaggtgttattggtttcttaggaaatgaggctgtggcaatgtatcgcattcgggttggtaagaggattggctcggctgctttggttgcagatggcgttcatgctcgcacggatggttttacttcacttgcagttgtcgcaggtggtgttggagtttttctgggattccccctggctgacccaattatcggattgatcatttctgcgatgattgccacccttcttgttggtacgatccgttcggttggcagacgcctcatggatggaattgagccggagttggtagagaaggctacgcacgcgatctggcatgtgaaggaaattgagtcgattgatcgactgaggttgaggtgggttggacaccgtcttcacggcgatgccacggtcagcacttctacatcatcgctatcggaagccaccgcaatcgcccttgaggctgagctttccgtcaaacaacatcttcccaatgtggatgaaatgactgtgaccatcaccccttccaaaccttgagtcccgtgatacaattgttg

SEQ ID NO: 722 - protein, 305 aa, Corynebacterium glutamicum
LYEIFVPHSHDTADSIDDAMEANSEGIRALKFSLVLMLLTTVLQAIIVSFSGSVALLADTVHNLSDALTAIPLWIAFILSRRAATQKYTYGFNRAEDLAGLFIVAMIALSAIVAAWQAIDRMINPRPMENIEWVIAAGVIGFLGNEAVAMYRIRVGKRIGSAALVADGVHARTDGFTSLAVVAGGVGVFLGFPLADPIIGLIISAMIATLLVGTIRSVGRRLMDGIEPELVEKATHAIWHVKEIESIDRLRLRWVGHRLHGDATVSTSTSSLSEATAIALEAELSVKQHLPNVDEMTVTITPSKP

SEQ ID NO: 723 - DNA, 755 bp, Corynebacterium glutamicum
  CDS (1)..(732): FRXA01669
cacaacctttccgacgcattgactgcgattcctctttggattgctttcatactttcccggcgcgcagcgactcaaaaatatacgtatggattcaatcgtgcagaggatttagcggggttgtttattgtcgcgatgattgctctttcggcgattgttgctgcatggcaggcgatcgaccggatgattaatcctcgcccgatggagaatattgaatgggtgattgcggcaggtgttattggtttcttaggaaatgaggctgtggcaatgtatcgcattcgggttggtaagaggattggctcggctgctttggttgcagatggcgttcatgctcgcacggatggttttacttcacttgcagttgtcgcaggtggtgttggagtttttctgggattccccctggctgacccaattatcggattgatcatttctgcgatgattgccacccttcttgttggtacgatccgttcggttggcagacgcctcatggatggaattgagccggagttggtagagaaggctacgcacgcgatctggcatgtgaaggaaattgagtcgattgatcgactgaggttgaggtgggttggacaccgtcttcacggcgatgccacggtcagcacttctacatcatcgctatcggaagccaccgcaatcgcccttgaggctgagctttccgtcaaacaacatcttcccaatgtggatgaaatgactgtgaccatcaccccttccaaaccttgagtcccgtgatacaattgttg

SEQ ID NO: 724 - protein, 244 aa, Corynebacterium glutamicum
HNLSDALTAIPLWIAFILSRRAATQKYTYGFNRAEDLAGLFIVAMIALSAIVAAWQAIDRMINPRPMENIEWVIAAGVIGFLGNEAVAMYRIRVGKRIGSAALVADGVHARTDGFTSLAVVAGGVGVFLGFPLADPIIGLIISAMIATLLVGTIRSVGRRLMDGIEPELVEKATHAIWHVKEIESIDRLRLRWVGHRLHGDATVSTSTSSLSEATAIALEAELSVKQHLPNVDEMTVTITPSKP

SEQ ID NO: 725 - DNA, 465 bp, Corynebacterium glutamicum
  CDS (101)..(442): RXN01672
agtagcaaagggtgcagtcgaaggaccagcatccaagactgctgccgaagaaaccgactccgttgacaacggatccgacgaaaacggcgaggaataatttatggcatcccgagaagtatccatcacccgaatctcaccactagcaaccttccgagttgcactggcaatgtccatcatcggactcgtggcgtggatcatctgcgtaaccgtcctctatttcggacttaacgtggctggcgtctggcagaacttcaacgatgtcatcggcggtgttggtgcagaacaaaccatcaccttcgggctcgtcctgagcatttccgcacttctgggagctatcggagcgattaccgtcgctgtgcttgcaccattgtgtgcaatcatctacaactcgattgttgacctcttcggtggactgcagattcaactgcaagaagaagtagactaacctctgaaacacaaacccct

SEQ ID NO: 726 - protein, 114 aa, Corynebacterium glutamicum
MASREVSITRISPLATFRVALAMSIIGLVAWIICVTVLYFGLNVAGVWQNFNDVIGGVGAEQTITFGLVLSISALLGAIGAITVAVLAPLCAIIYNSIVDLFGGLQIQLQEEVD

SEQ ID NO: 727 - DNA, 332 bp, Corynebacterium glutamicum
  CDS (1)..(309): FRXA01672
tcaccactagcaaccttccgagttgcactggcaatgtccatcatcggactcgtggcgtggatcatctgcgtaaccgtcctctatttcggacttaacgtggctggcgtctggcagaacttcaacgatgtcatcggcggtgttggtgcagaacaaaccatcaccttcgggctcgtcctgagcatttccgcacttctgggagctatcggagcgattaccgtcgctgtgcttgcaccattgtgtgcaatcatctacaactcgattgttgacctcttcggtggactgcagattcaactgcaagaagaagtagactaacctctgaaacacaaacccct

SEQ ID NO: 728 - protein, 103 aa, Corynebacterium glutamicum
SPLATFRVALAMSIIGLVAWIICVTVLYFGLNVAGVWQNFNDVIGGVGAEQTITFGLVLSISALLGAIGAITVAVLAPLCAIIYNSIVDLFGGLQIQLQEEVD

SEQ ID NO: 729 - DNA, 1023 bp, Corynebacterium glutamicum
  CDS (101)..(1000): RXN01694
cgacaccaataatttattgggtatccaccaattaccgctgtgagcactgcaaattacgtattcgaaaagccatgtccaccacgtgttctatcctggcggcatgcaaaaaatcaccccaaacatctggtgccaaggcaccgcagacgaagcagccgaattctacgtcaatgcgttttctgagtttccgggtggcgcagaagtactcaccacagttaagtatcccgaagctggcttgctggacttccaggagcctttcgcaggaaaaaccttgacggtggaactcgctatctcaggctttaagatcatcttgatcaatgctggtgaagagttcactcccaacccatcgatcagcttcatggtgaattttgatgcggtgcgtgatgaaaatgccaaagagcaccttgatgcggtgtgggaaaaactccatgaaggcggcagcacactgatgccagtcgatacttacccattttcggaatactacgggtgggtacaagacaaatatggtgtgagctggcaattgatgctcagccgcccagaagaaaagccaggtcccgcagtaatcccaacgctcttatttggtggggcagctcaaaatcaggcaggcccagctcaagaaaactacgttgaggtgttcccgaactcccaacttggtgatcgtgcaccttatggacagcaaacaggtcctgccactcctgaggccctcatgttttcccagttccaactcgacggtcagtggattttcgcgatggattccggagttgagcaagatttcaccttcagtgagggtgtctcattgatgtatgaagctcatggtcaagaagaactcgatgccatctggaatgcactctcggcagttccagaagctgaggcttgtggttggttgaaggacaagttcggcgtgagctggcagattgttcccgacaacatggaggagctcatggctaaacccggcgcgtatgaaaagcttcttgcgatgaagaagatcaatatcgcggagttctagcagttctaagcgctccacgc

SEQ ID NO: 730 - protein, 300 aa, Corynebacterium glutamicum
MQKITPNIWCQGTADEAAEFYVNAFSEFPGGAEVLTTVKYPEAGLLDFQEPFAGKTLTVELAISGFKIILINAGEEFTPNPSISFMVNFDAVRDENAKEHLDAVWEKLHEGGSTLMPVDTYPFSEYYGWVQDKYGVSWQLMLSRPEEKPGPAVIPTLLFGGAAQNQAGPAQENYVEVFPNSQLGDRAPYGQQTGPATPEALMFSQFQLDGQWIFAMDSGVEQDFTFSEGVSLMYEAHGQEELDAIWNALSAVPEAEACGWLKDKFGVSWQIVPDNMEELMAKPGAYEKLLAMKKINIAEF

SEQ ID NO: 731 - DNA, 1023 bp, Corynebacterium glutamicum; identical to SEQ ID NO: 729
  CDS (101)..(1000): FRXA01694

SEQ ID NO: 732 - protein, 300 aa, Corynebacterium glutamicum; identical to SEQ ID NO: 730

SEQ ID NO: 733 - DNA, 1302 bp, Corynebacterium glutamicum
  CDS (101)..(1279): RXN01696
aggtgacggtgatacaattttgccataactgacttaacccagaacgttgtccggaagcacacagacctttgtgcggcttccttttctaggagcatgtaacttgtctaccccaatcggccttggccttcctccgaccccacctccagtgttggcgccacgtcgtaaaacacgccaactcatggtcggcaaagtgggcgttggttcggatcacccgatttccgtccagtcgatgaccaccaccaaaacccacgacatcaacggcaccctgcaacagatcgcacagttgacagccaccggttgtgacatcgtccgcgttgcctgcccaaagactgttgatgcggaagcactgccgatcatcgcaaagaagtctccgatcccagtgatcgcagatatccacttccagcccaagtacatcttcgcggcaatcgatgcaggttgcgccgccgttcgtgtgaacccaggcaacatcaaggaattcgatggtcgcgttaaagaagtagcaaaagctgcaggcgatgccggaattccaattcgtattggtgtcaacggcggatccctggataagcgcatcctggacaaataccacggcaaagccaccccagaagctctcgtggaatccgcaatgtgggaagccggcctgtttgaagagcacggcttcggcgacatcgcaatctctgtgaagcactccgacccagtactcatggtggaggcctaccgccagctcgctgaacaaagcgactacccactgcacctcggtgttactgaagctggtcccaagttcatgggaacaatcaagtcttccgtagcattcggcgctctgctgtcccagggcatcggcgacactatccgtgtgtctctttctgctgacccagtggaagaaatcaaggttggcgaccagattctgcagtccctcaacctgcgcccacgcaagctggaaatcgtgtcctgcccatcatgtggccgcgcacaggtcgatgtgtactcacttgctgaagaagtcaccgaagcactcgacggcatggaagttccactgcgcgtcgctgtcatgggttgcgttgttaacggcccaggtgaggctcgcgacgctgacctcggtgttgcatccggtaacggcaagggccagatctttgtcaagggcgaagtcatcaagactgtcccagaatcccagatcgtggaaaccctcatcgaagaagcaatgcgtatcgcagaggaaatggacccagaagtcctcgctgcagcaagtgcttccggtatgaaggctgaagtgaaggtaaccaagtaagttttggttaattaaggcac

SEQ ID NO: 734 - protein, 393 aa, Corynebacterium glutamicum
LSTPIGLGLPPTPPPVLAPRRKTRQLMVGKVGVGSDHPISVQSMTTTKTHDINGTLQQIAQLTATGCDIVRVACPKTVDAEALPIIAKKSPIPVIADIHFQPKYIFAAIDAGCAAVRVNPGNIKEFDGRVKEVAKAAGDAGIPIRIGVNGGSLDKRILDKYHGKATPEALVESAMWEAGLFEEHGFGDIAISVKHSDPVLMVEAYRQLAEQSDYPLHLGVTEAGPKFMGTIKSSVAFGALLSQGIGDTIRVSLSADPVEEIKVGDQILQSLNLRPRKLEIVSCPSCGRAQVDVYSLAEEVTEALDGMEVPLRVAVMGCVVNGPGEARDADLGVASGNGKGQIFVKGEVIKTVPESQIVETLIEEAMRIAEEMDPEVLAAASASGMKAEVKVTK

SEQ ID NO: 735 - DNA, 620 bp, Corynebacterium glutamicum
  CDS (1)..(597): FRXA01696
cactccgacccagtactcatggtggaggcctaccgccagctcgctgaacaaagcgactacccactgcacctcggtgttactgaagctggtcccaagttcatgggaacaatcaagtcttccgtagcattcggcgctctgctgtcccagggcatcggcgacactatccgtgtgtctctttctgctgacccagtggaagaaatcaaggttggcgaccagattctgcagtccctcaacctgcgcccacgcaagctggaaatcgtgtcctgcccatcatgtggccgcgcacaggtcgatgtgtactcacttgctgaagaagtcaccgaagcactcgacggcatggaagttccactgcgcgtcgctgtcatgggttgcgttgttaacggcccaggtgaggctcgcgacgctgacctcggtgttgcatccggtaacggcaagggccagatctttgtcaagggcgaagtcatcaagactgtcccagaatcccagatcgtggaaaccctcatcgaagaagcaatgcgtatcgcagaggaaatggacccagaagtcctcgctgcagcaagtgcttccggtatgaaggctgaagtgaaggtaaccaagtaagttttggttaattaaggcac

SEQ ID NO: 736 - protein, 199 aa, Corynebacterium glutamicum
HSDPVLMVEAYRQLAEQSDYPLHLGVTEAGPKFMGTIKSSVAFGALLSQGIGDTIRVSLSADPVEEIKVGDQILQSLNLRPRKLEIVSCPSCGRAQVDVYSLAEEVTEALDGMEVPLRVAVMGCVVNGPGEARDADLGVASGNGKGQIFVKGEVIKTVPESQIVETLIEEAMRIAEEMDPEVLAAASASGMKAEVKVTK

SEQ ID NO: 737 - DNA, 1080 bp, Corynebacterium glutamicum
  CDS (101)..(1057): RXN01697
tagatcaactaagtatgaacgcgaatccgactttggtcgtactgcaagaatcgaccagagcccgattaaaaaatgcccccgcgcaacgaaactagtaatcatgtttcaaggactaaaagaactcaccgcagcaaaaggccgcacgctgctgatcaccgtcaccgtcgggctgatcgccgtgctggttactttcctctctgccctcaccgccgggcttggccaccaatcagtatccgcactgaaatacctagcgggtgataatgaacttatcctcgccgattccggatccaccacgctttccgcgtccacgctttctgatcaagcagttgcccaactcgaagacgaaggcgcacagatgctgtggcaggtccgcgaccgagtagcagacacccccaccatgctcctcaactcccctgaccttgcgcctggtgaagtatcccttcctgccgaactcgctgattcggaactcgctactgcgcatgatgtagtggattcttccaacgatctgtacctcgatcacctgcccgtggtattgatgaacacctccgatttagcctcactcgcgcaagtccgaggcgtgacaggaccagcaggcgcattcgcctctgacgttgcgctcccctccgacaccgttgcgctctctggatccgaacggtggaacgcatccgcctcctaccagggcgaacagatgtcactcaacctcatgatcgtcatgctgtatgttatctccgcactcgtgctcggcgcattcttcaccgtctggaccatccaacgcctccgcggcatcgccatctctagtgctttgggagcagcccgccgagtacttatcgccgacgctctcggccaagccatcatcgtcttaggaatcggcatcaccgcaggcacattgatcacagtcatctccgcattcggcatgggagacgcaatgcccgtggtcatctcctcctccaccacgctcttccccgcacttatcctcgccgcagcaggactcatcggtgccgccatttcactcggccccatccttcgcgtcgaaccacgctccgcactcatgaacgcataagaaaaggaacctcacatgac

SEQ ID NO: 738 - protein, 319 aa, Corynebacterium glutamicum
MFQGLKELTAAKGRTLLITVTVGLIAVLVTFLSALTAGLGHQSVSALKYLAGDNELILADSGSTTLSASTLSDQAVAQLEDEGAQMLWQVRDRVADTPTMLLNSPDLAPGEVSLPAELADSELATAHDVVDSSNDLYLDHLPVVLMNTSDLASLAQVRGVTGPAGAFASDVALPSDTVALSGSERWNASASYQGEQMSLNLMIVMLYVISALVLGAFFTVWTIQRLRGIAISSALGAARRVLIADALGQAIIVLGIGITAGTLITVISAFGMGDAMPVVISSSTTLFPALILAAAGLIGAAISLGPILRVEPRSALMNA

SEQ ID NO: 739 - DNA, 826 bp, Corynebacterium glutamicum
  CDS (101)..(826): FRXA01697
tagatcaactaagtatgaacgcgaatccgactttggtcgtactgcaagaatcgaccagagcccgattaaaaaatgcccccgcgcaacgaaactagtaatcatgtttcaaggactaaaagaactcaccgcagcaaaaggccgcacgctgctgatcaccgtcaccgtcgggctgatcgccgtgctggttactttcctctctgccctcaccgccgggcttggccaccaatcagtatccgcactgaaatacctagcgggtgataatgaacttatcctcgccgattccggatccaccacgctttccgcgtccacgctttctgatcaagcagttgcccaactcgaagacgaaggcgcacagatgctgtggcaggtccgcgaccgagtagcagacacccccaccatgctcctcaactcccctgaccttgcgcctggtgaagtatcccttcctgccgaactcgctgattcggaactcgctactgcgcatgatgtagtggattcttccaacgatctgtacctcgatcacctgcccgtggtattgatgaacacctccgatttagcctcactcgcgcaagtccgaggcgtgacaggaccagcaggcgcattcgcctctgacgttgcgctcccctccgacaccgttgcgctctctggatccgaacggtggaacgcatccgcctcctaccagggcgaacagatgtcactcaacctcatgatcgtcatgctgtatgtcatctccgcactcgtgctcggcgcattcttcaccgtctggaccatccaacgcctccgcggcatcgccatctctagtgctttgggagcagcccgccgagtactt

SEQ ID NO: 740 - protein, 242 aa, Corynebacterium glutamicum
MFQGLKELTAAKGRTLLITVTVGLIAVLVTFLSALTAGLGHQSVSALKYLAGDNELILADSGSTTLSASTLSDQAVAQLEDEGAQMLWQVRDRVADTPTMLLNSPDLAPGEVSLPAELADSELATAHDVVDSSNDLYLDHLPVVLMNTSDLASLAQVRGVTGPAGAFASDVALPSDTVALSGSERWNASASYQGEQMSLNLMIVMLYVISALVLGAFFTVWTIQRLRGIAISSALGAARRVL

SEQ ID NO: 741 - DNA, 472 bp, Corynebacterium glutamicum
  CDS (101)..(472): RXN01701
gccgatcaaattcattgattgttaatcggaagttttttgaacaggtaaagctaggggacctgttcagtgcctgttggcggatgtattaaggagaatgcccatgctgagccacgaagaaattgttgcgatcgcagaagatttgctgtctaaacgctacggcggtgtacaaactctttctgacgtggagcagctcaacggttccggcacctccgcggtgctgcgtgccagggtggctaactccccattcctccaacagcgctccgtggtgctgaagtacgtgcccagcaccggagacgtctttgatgattctgcgctggtgcgtgaaatcgtctcctaccagttcaccacctccttgtcggaagatgtccgcccagggccagtcattttggcctatgacattgacaagcgcatcctggtcatttcagattccggcaacggcgacacctttgcggatctgatcgatcagcgtccg

SEQ ID NO: 742 - protein, 124 aa, Corynebacterium glutamicum
MLSHEEIVAIAEDLLSKRYGGVQTLSDVEQLNGSGTSAVLRARVANSPFLQQRSVVLKYVPSTGDVFDDSALVREIVSYQFTTSLSEDVRPGPVILAYDIDKRILVISDSGNGDTFADLIDQRP

SEQ ID NO: 743 - DNA, 433 bp, Corynebacterium glutamicum
  CDS (101)..(433): FRXA01701
gccgatcaaattcattgattgttaatcggaagttttttgaacaggtaaagctaggggacctgttcagtgcctgttggcggatgtattaaggagaatgcccatgctgagccacgaagaaattgttgcgatcgcagaagatttgctgtctaaacgctacggcggtgtacaaactctttctgacgtggagcagctcaacggttccggcacctccgcggtgctgcgtgccagggtggctaactccccattcctccaacagcgctccgtggtgctgaagtacgtgcccagcaccggagacgtctttgatgattctgcgctggtgcgtgaaatcgtctcctaccagttcaccacctccttgtcggaagatgtccgcccagggccagtcattttggcctatgacattgacaagcgcatcctggtcatttcagattccggc

SEQ ID NO: 744 - protein, 111 aa, Corynebacterium glutamicum
MLSHEEIVAIAEDLLSKRYGGVQTLSDVEQLNGSGTSAVLRARVANSPFLQQRSVVLKYVPSTGDVFDDSALVREIVSYQFTTSLSEDVRPGPVILAYDIDKRILVISDSG

SEQ ID NO: 745 - DNA, 1236 bp, Corynebacterium glutamicum
  CDS (101)..(1213): RXN01703
gttagacaaatgggtaaacagagctgacctagcggaatccgccatcaacgaaaggcattccgcgagggtttggggtctgcctcgaacaaatcttgggtttgtggcatggccatccaacgccaaagaaaaactgtttatccactggcactactggtggcaagcgcattatctagactgcctggtggatgctgctcgtcgacgcaccacaaaggcccgtcgcgaccgcatcagggacaccatccgcggcatttcggtgcgcaatgtgggcaagctgacctcgaatcgttattacgacgacaaagcttggctggcccttgctcttgggcgtgccggaaaagtgcgaaaggtgcgcacaccaaaatcattgccctcgttggaacaaaacatcgtcgatggcattgattcccttactggtgtgctgccgtggcgttccggcgaaaccttctacaacgttccctccaacggtcctgctgcgatcatgatggcccgcaccgaccgtttggacgaggctatgaaaatcaccgattggatttttgacaacctgatcgatggcgacggccttgtgatggacggattgcgcatgcgcatgcacggacctgagcttgtccgttccatccacccgtattgccaaggtgtcgccattggtgcgtgtttggaaattgctctcaaactgcgtgagcgcgcaggcttgaccactactgtggtggatcactggtcggatgccgataaggcagaagactccctcaaatactttgcacacatccacgctgtggttcaggctgtgtcgcggaagatgaccaacttccacggcgttattgattgggacaccggtgacggcgacggcggtttgttcaagggcattttggtccgctatttagctgatgtggccatccgcctgcctgacgattcaccaaccaaccgggaaaccaaaaagattgcagcacgcctggtactggaatcggcggaaagcgtatggaaccaccgattggaagttgatggccttccggtattcgccacagactggacaacggatgcacgcctgccacaaaactttggtttgagttcctctagtttgagcgatctggtgagtgttgtgcgcgtggatgaacgtgatctgtccgtgcaattgtccggttggatgctcatggaagcagcagcgaaagtggccgaagaactggaaaacaacggcaatagttacaccggtcgctcccgatagccccgatagtgtatgtgctg

SEQ ID NO: 746 - protein, 371 aa, Corynebacterium glutamicum
VAWPSNAKEKLFIHWHYWWQAHYLDCLVDAARRRTTKARRDRIRDTIRGISVRNVGKLTSNRYYDDKAWLALALGRAGKVRKVRTPKSLPSLEQNIVDGIDSLTGVLPWRSGETFYNVPSNGPAAIMMARTDRLDEAMKITDWIFDNLIDGDGLVMDGLRMRMHGPELVRSIHPYCQGVAIGACLEIALKLRERAGLTTTVVDHWSDADKAEDSLKYFAHIHAVVQAVSRKMTNFHGVIDWDTGDGDGGLFKGILVRYLADVAIRLPDDSPTNRETKKIAARLVLESAESVWNHRLEVDGLPVFATDWTTDARLPQNFGLSSSSLSDLVSVVRVDERDLSVQLSGWMLMEAAAKVAEELENNGNSYTGRSR

SEQ ID NO: 747 - DNA, 494 bp, Corynebacterium glutamicum
  CDS (1)..(471): FRXA01703
ctcaaatactttgcacacatccacgctgtggttcaggctgtgtcgcggaagatgaccaacttccacggcgttattgattgggacaccggtgacggcgacggcggtttgttcaagggcattttggtccgctatttagctgatgtggccatccgcctgcctgacgattcaccaaccaaccgggaaaccaaaaagattgcagcacgcctggtactggaatcggcggaaagcgtatggaaccaccgattggaagttgatggccttccggtattcgccacagactggacaacggatgcacgcctgccacaaaactttggtttgagttcctctagtttgagcgatctggtgagtgttgtgcgcgtggatgaacgtgatctgtccgtgcaattgtccggttggatgctcatggaagcagcagcgaaagtggccgaagaactggaaaacaacggcaatagttacaccggtcgctcccgatagccccgatagtgtatgtgctg

SEQ ID NO: 748 - protein, 157 aa, Corynebacterium glutamicum
LKYFAHIHAVVQAVSRKMTNFHGVIDWDTGDGDGGLFKGILVRYLADVAIRLPDDSPTNRETKKIAARLVLESAESVWNHRLEVDGLPVFATDWTTDARLPQNFGLSSSSLSDLVSVVRVDERDLSVQLSGWMLMEAAAKVAEELENNGNSYTGRSR

SEQ ID NO: 749 - DNA, 555 bp, Corynebacterium glutamicum
  CDS (101)..(532): RXN01709
gcaagtggaaccacgatgggaacggtaactgctgccgctgcggtattactcgtagtttcagaaattaggtgtcgatgcagcaatacggaactttgccaatgtgtttgaacaagctctcgggctcaccacccttgcacaaacagctggagcgggcgcagcggggggcttgggtttcatggcaatggcgttgttgtctgcagggatgcgctccggcgtggacatgattcttaatgaaaccgggggtgaaaagatgcttgcacaggcagatttagtcatcactggagaaggacgcattgatgcacagaccctcagcgggaaagctcctactggaatcgccaaacgggcacgtgcgaaaggaattccagtactggcggtttgtgggcagagcctattgggtccagcaatctcaaatgagctatttgaagacatctacagctttaccgatttcgaatctgacatcaatgaatgcattcgaaacccgctcccaattttggaaggtatcggttttaacatcgccaaacatcatctgagttagcgatatttcagcaaaccgat

SEQ ID NO: 750 - protein, 144 aa, Corynebacterium glutamicum
VFEQALGLTTLAQTAGAGAAGGLGFMAMALLSAGMRSGVDMILNETGGEKMLAQADLVITGEGRIDAQTLSGKAPTGIAKRARAKGIPVLAVCGQSLLGPAISNELFEDIYSFTDFESDINECIRNPLPILEGIGFNIAKHHLS

SEQ ID NO: 751 - DNA, 368 bp, Corynebacterium glutamicum
  CDS (16)..(345): FRXA01709
ttgttgtctgcagggatgcgctccggcgtggacatgattcttaatgaaaccgggggtgaaaagatgcttgcacaggcagatttagtcatcactggagaaggacgcattgatgcacagaccctcagcgggaaagctcctactggaatcgccaaacgggcacgtgcgaaaggaattccagtactggcggtttgtgggcagagcctattgggtccagcaatctcaaatgagctatttgaagacatctacagctttaccgatttcgaatctgacatcaatgaatgcattcgaaacccgctcccaattttggaaggtatcggttttaacatcgccaaacatcatctgagttagcgatatttcagcaaaccgat

SEQ ID NO: 752 - protein, 110 aa, Corynebacterium glutamicum
MRSGVDMILNETGGEKMLAQADLVITGEGRIDAQTLSGKAPTGIAKRARAKGIPVLAVCGQSLLGPAISNELFEDIYSFTDFESDINECIRNPLPILEGIGFNIAKHHLS

SEQ ID NO: 753 - DNA, 1281 bp, Corynebacterium glutamicum
  CDS (101)..(1258): RXN01711
tctcgtgagtttctccccggtagcaccttctatatcagcccccacgccgcgtcggagcaggtgggatagcatcggcaacgcggttgcatggccgttggccatgttgttgatggcgcatcgcttcttcgtgcttgcgattaacggcgcagtcaccgacgatttcacgacggtttatagtgctttacgacgtttcgttgaaggtattccggtctacaacgaggtctaccacttcgtcgatccgcactacctctataacccgggcgccaccctcctattggcaccattgggatatatcacccatttcacgttggctcggtggatgttcatcgcggtgaacctccttgccattgttttagcgttcgggctgctgaccagactctccggttgggcgctgcgcagcatggtgtggccgattgcgatcgccttggcgatgctgacagaaaccgtgcaaaacaccctcattttctccaacatcaacggcatcctgctgctcatgttggcgattttcctgtggtgcgtggtgcacaaaaaatcctggttgggcggactagtcattggtttggccattttgatcaaacccatgttcctgccacttctcttcctacctttggtgaaaaagcaatggggatcgctcatcctcggcattttaaccccagtgattttcaatgcagtggcctggttcttagttccgggagcatctgaatacgtcacccgcacgatgccctaccttggtgaaactcgagattttgccaacagctcactcccaggcttggccatctatttcggaatgcccacctggatggaaatcacctggttcctcatcttcggcgcaatggtcggcctcgcagtgctggcactcctgagattccgtaacaccgagccatacttctgggcagcaaccaccaccggtgtactcctgactggcgtattcttcctgtcctcactgggacagatgtactactccatgatgatcttccctatgatcttcaccctgctcggaagccgatccgtattccacaactgggttgcctgggtcgccgcctacttcttactatcccctgacactttcacctcccagcgactacccgatgtagcccgctggatggaatttttcagcgcgaccgttggttggggactattgatagtggttacatttgtctcggcgctaatctggtttattggtgatatccgagccaagggaactccgagctcacccattaccactgatccaacgcacgaccatcttgagaggacagcatgacagacttcaaactcatcagc

SEQ ID NO: 754 - protein, 386 aa, Corynebacterium glutamicum
MLLMAHRFFVLAINGAVTDDFTTVYSALRRFVEGIPVYNEVYHFVDPHYLYNPGATLLLAPLGYITHFTLARWMFIAVNLLAIVLAFGLLTRLSGWALRSMVWPIAIALAMLTETVQNTLIFSNINGILLLMLAIFLWCVVHKKSWLGGLVIGLAILIKPMFLPLLFLPLVKKQWGSLILGILTPVIFNAVAWFLVPGASEYVTRTMPYLGETRDFANSSLPGLAIYFGMPTWMEITWFLIFGAMVGLAVLALLRFRNTEPYFWAATTTGVLLTGVFFLSSLGQMYYSMMIFPMIFTLLGSRSVFHNWVAWVAAYFLLSPDTFTSQRLPDVARWMEFFSATVGWGLLIVVTFVSALIWFIGDIRAKGTPSSPITTDPTHDHLERTA

SEQ ID NO: 755 - DNA, 1281 bp, Corynebacterium glutamicum; identical to SEQ ID NO: 753
  CDS (101)..(1258): FRXA01711

SEQ ID NO: 756 - protein, 386 aa, Corynebacterium glutamicum; identical to SEQ ID NO: 754

SEQ ID NO: 757 - DNA, 1123 bp, Corynebacterium glutamicum
  CDS (101)..(1123): RXN01721
ttcgccaacgccgccccgaaatgatcgggagggggcgtcgaaaagcacttctgcgagcatcaaacatgatgcgtacctgccacccgcagacggcaatcgcgtgcttgtggacagattcggacgcatcgcgcgtgacctgcgggtgtcactgaccgaccgatgcaacctccgctgcacctattgcatgcccgcggagggtttagagtggctgcccaccgagcagacgcttaacgacgccgaggtgctgcgactcatccgcattgcggtggttaagctgggcattcgtcaaattcgattcaccggcggcgagcctttactgcggaaaaatttggaagacatcatcgccggcaccgcagccctgcgcaccgacgaaggcgaaaaagttcacatcgctctcaccaccaacggccttggcctagacaaacgcatcgcaggactgaaagaagctggtcttgaccgggtcaatatttcactcgacaccatcgacgccgaacgctacgtctcgctaaccaagcgtgatcgattgtccggtgtgttggcgtccatcgatgccgctgttgccgctggccttcacccagtgaagatcaacgccgtggtcatgcctggggtcaatgaagtagatatcgtcccccttgcggaatactgcatttccaaaggctcccaactgcgattcatcgaacaaatgccacttggcccgcgcgagcagtggaaacgcggcgatatggtcacagccgaagaaatcctggcgcgcctggaagaaaaattcaccttatcccccgccaaggaaccccgaggagctgcacctgctgcgctgtggaatgtggtagataaatccaaccctgatatcactggacaaatcggcatcatcgcctcggtgacgcacccattttgcggagattgcgatcgctcccgcctcaccaccgacggcaccatccgaaactgccttttctcccgcactgaaactcccctacgtgacgcgcttcgcgacggcgcctccgacgatgagctcgcgcaactgtgggcaggcgccatgtgggagaagaaacccggccatggcatcgacgatgaaggcttcctccaaccagatcgccccatgtctgccatcggggctagcccataccag

SEQ ID NO: 758 - protein, 341 aa, Corynebacterium glutamicum
VLVDRFGRIARDLRVSLTDRCNLRCTYCMPAEGLEWLPTEQTLNDAEVLRLIRIAVVKLGIRQIRFTGGEPLLRKNLEDIIAGTAALRTDEGEKVHIALTTNGLGLDKRIAGLKEAGLDRVNISLDTIDAERYVSLTKRDRLSGVLASIDAAVAAGLHPVKINAVVMPGVNEVDIVPLAEYCISKGSQLRFIEQMPLGPREQWKRGDMVTAEEILARLEEKFTLSPAKEPRGAAPAALWNVVDKSNPDITGQIGIIASVTHPFCGDCDRSRLTTDGTIRNCLFSRTETPLRDALRDGASDDELAQLWAGAMWEKKPGHGIDDEGFLQPDRPMSAIGASPYQ

SEQ ID NO: 759 - DNA, 657 bp, Corynebacterium glutamicum
  CDS (101)..(634): RXN01734
acgatctgccggagaatctcaagaaagtgctcactgcgcagcacaccgtcaccgtccaagacaccggcaccgggcggatttcactcctggatgtgcaaccatgacagatccaattgagcaggcatttgaacgcatccgcgccgaagccatgcgcagaaatggatccgttcccgacctcaataaaaacgatgcttttcgacgcccacctgcgccgaaagggggcgtcgaaaagcgcaaaaaaggccgtgcaagcggcctagacggccgccagaaacgatatgtgcgcggcgcggagtcgctgggatcggtgctgaacaaggaaattcagcgtcgtggctggggcaaagacattgccggcggttgggtgacgtccaactgggaagagcttgttggcgcgaagattgcgcagcatacgcgcgtggaaatgatcaaagataagaagctttttatcacttgtgattccacagcgtgggccaccaatctgcgcatgatgcagcggcaaatcctgcaggtaatcgctgaaaaagtgggtccaaatattattacagagctgcgtatttttgggcctcaggccccaagctggcgcaaggggccgttgcacgtaaaaggacgcggtccgagagacacatacggatagtttggtgataaaaaccgtcg

SEQ ID NO: 760 - protein, 178 aa, Corynebacterium glutamicum
MTDPIEQAFERIRAEAMRRNGSVPDLNKNDAFRRPPAPKGGVEKRKKGRASGLDGRQKRYVRGAESLGSVLNKEIQRRGWGKDIAGGWVTSNWEELVGAKIAQHTRVEMIKDKKLFITCDSTAWATNLRMMQRQILQVIAEKVGPNIITELRIFGPQAPSWRKGPLHVKGRGPRDTYG

SEQ ID NO: 761 - DNA, 657 bp, Corynebacterium glutamicum; identical to SEQ ID NO: 759
  CDS (101)..(634): FRXA01734

SEQ ID NO: 762 - protein, 178 aa, Corynebacterium glutamicum; identical to SEQ ID NO: 760

SEQ ID NO: 763 - DNA, 627 bp, Corynebacterium glutamicum
  CDS (101)..(604): RXN01742
tggctaaagcgatgtgtgtcatctgaaaaatttcccccaaaacttaatcgacacagttacttcatctggccttatttcatcacagttacaatcatctgtcatgcaggaaaagccagagatgccagcgattgaggtcatccgttcagcgaaacgcaccaaaactgttcaagctcgaattgtggacgggcaaatccaggtgcgcatccctgcgaggatgtctaaagcggaggaagaaaaagcggtgggggagatcgtcgcaaagctaaagcgacgcacccaatcggccgtctcaagcgacgctgacctgattgagcgcgcccataagttgaacaagactgtgttggaggggcgggcgcgggtggaaagtattcggtgggtgagtaatcagaaggggcggtgggggtcgtgcacggtggcgactgcggagattcggatttcggatcgtttaaagcacgtgccggattatgtgttggatgcggtgttggtgcatgagctgacgcatacgtttattgcggggcattcggcggagttttgggagtgggcagacaaaacgcccctggcagagagggccaagggctatttggaggcgtatcagcggtggggctgaaggtttagttcttgtcggag

SEQ ID NO: 764 - protein, 168 aa, Corynebacterium glutamicum
MQEKPEMPAIEVIRSAKRTKTVQARIVDGQIQVRIPARMSKAEEEKAVGEIVAKLKRRTQSAVSSDADLIERAHKLNKTVLEGRARVESIRWVSNQKGRWGSCTVATAEIRISDRLKHVPDYVLDAVLVHELTHTFIAGHSAEFWEWADKTPLAERAKGYLEAYQRWG

SEQ ID NO: 765 - DNA, 627 bp, Corynebacterium glutamicum; identical to SEQ ID NO: 763
  CDS (101)..(604): FRXA01742

SEQ ID NO: 766 - protein, 168 aa, Corynebacterium glutamicum; identical to SEQ ID NO: 764

SEQ ID NO: 767 - DNA, 2064 bp, Corynebacterium glutamicum
  CDS (101)..(2041): RXN01754
tgtggctgaagacaagaatgaatagcattcatctcgtcgaatttcatgtagaaatttgtcccccttttttttgatgtgaaagttgaatcggtaagctcctgtgaaaattaaatccgtatttttgagcaccgctttaagcgcttccttactgctcggaatcaccccacccgtgctgggagcaacgatcaaccccagtttgcctctttctgcgttgagctcctcggacgatatcgccgtacccaacttcgccaaagaattaccgttagcttttgatgtaccagcaggcactgttccccaaagcttgagtggaacgctgcagattcctgccgagttttctggcggcgtcgtggagttttatgacggtgaccggctctttcacaccctgcgcctagaagttaatgattcccgagcacacattgaggttccgctgcaaagcgttcctgtcgaagacggccgcgccaccttttggttgcgcgccatgttggatcctgtaaacaaccagtggtgctacgaggagcaggaagtccgcttcttagacggaaacgtcacctttgaaggggcgacgattaacccagctgtggtggctgattacttcccgtcagtgctgcgcgcgttgacaatttacgtcccggaaaacccctctgaggcagtacaagaagccacgttagaggttgcgacctccctggattcggtgtaccgaagatcaggtctggatgtcaacgtagaaacgcttccaaccggcaccgatgctcctcctacacgtcctcaagattttgaacgccagattgtgctggttgacgaggcaacagaaagtaacacgcaaaaaaccgaattggtcaatcccggccaagacaatgcattcttgcgcctgaacggcaacgccgacgagctttacgatcaagcgcgcttgcttaccgacgcaaccctgccacttgccgtagacaccgaagtaacggcctcaggttttggtgatgtgcccaacctttctacagatgtggccaccctccaagaactgggtatcacgcagctcacctctgaatcagttgcgcgcacaagcgtcaccttgggcattgaacgctcccgcctgcggacctactcgcagtccatggacctgcacataacgggaacctacaccccattgccaccccaaaatgcaggacagatcacgttctccattggtgacaccgtgttggactccttgaccaccgatgacactggcatcattgaccgtgagttcaacgttcctggagacttggtcaaccgctacacggcgatcgtcgtggaattcaccagcaccggcgacgttaattgtggggtcacccagcccgtaggcctcaacattgattccgacagccttgtcacctcccaacattcagatgttcctgtactcaacggcttccggtccctaccgcagtccttccaacctcgtgtggacgtggcgtttgctgatcccagcgtgcaggaactctcccgcgctgtcagcgtagtgttgggaattcaatctatgagctcccagcgcatccgcccacacctggttaactgggatgaagccgtagccagcgagcgcccaacaattttcattgatgctgcgggcgcaaagactgatcaagtgccaagctacctcgcccaacaaggccaaaccctagagatcaccagcaagaacgaccaaaatgcggacggcgaacaactcacccgatccctgcaaaccaacgctgcgcttgttgtcggttccattcaggccgtgtgggatgccgataagaagcgcacggtgattgtggcaagttcccaggacaacccccccgatttggatgccttgatttcgtggatgggagaagaccgcgaacgctggagtgatctcaacggcgacctgattgtcaaagtccgagaccgcgaacctgtgcaattgaccaccgtggaagccccagatcagcctggtcgatcggccacagcctttattgcgatcggcgtcagccttgtggtcattgccctgattgtcgcagccgtggtgtcagtgtccaggcgttcgcaaaaaggatacaaatgatttcttctttacccagtaga

SEQ ID NO: 768 - protein, 647 aa, Corynebacterium glutamicum
VKIKSVFLSTALSASLLLGITPPVLGATINPSLPLSALSSSDDIAVPNFAKELPLAFDVPAGTVPQSLSGTLQIPAEFSGGVVEFYDGDRLFHTLRLEVNDSRAHIEVPLQSVPVEDGRATFWLRAMLDPVNNQWCYEEQEVRFLDGNVTFEGATINPAVVADYFPSVLRALTIYVPENPSEAVQEATLEVATSLDSVYRRSGLDVNVETLPTGTDAPPTRPQDFERQIVLVDEATESNTQKTELVNPGQDNAFLRLNGNADELYDQARLLTDATLPLAVDTEVTASGFGDVPNLSTDVATLQELGITQLTSESVARTSVTLGIERSRLRTYSQSMDLHITGTYTPLPPQNAGQITFSIGDTVLDSLTTDDTGIIDREFNVPGDLVNRYTAIVVEFTSTGDVNCGVTQPVGLNIDSDSLVTSQHSDVPVLNGFRSLPQSFQPRVDVAFADPSVQELSRAVSVVLGIQSMSSQRIRPHLVNWDEAVASERPTIFIDAAGAKTDQVPSYLAQQGQTLEITSKNDQNADGEQLTRSLQTNAALVVGSIQAVWDADKKRTVIVASSQDNPPDLDALISWMGEDRERWSDLNGDLIVKVRDREPVQLTTVEAPDQPGRSATAFIAIGVSLVVIALIVAAVVSVSRRSQKGYK

SEQ ID NO: 769 - DNA, 2064 bp, Corynebacterium glutamicum; identical to SEQ ID NO: 767
  CDS (101)..(2041): FRXA01754

SEQ ID NO: 770 - protein, 647 aa, Corynebacterium glutamicum; identical to SEQ ID NO: 768

SEQ ID NO: 771 - DNA, 4587 bp, Corynebacterium glutamicum
  CDS (101)..(4564): RXN01761
ttaaagtttctatattccattctaaaataactttgaattggggattaatgaaactttttaagcaattgtttaaaacgaatattgagggggtggcgggcaagtgactgcgacagttttagaaccgcaacctgtacagcttagtgagcaggacgtagatgctgagattgcgcgcatggagcttaaacacaaccgacacaagacgtggcgacgccgaacgatggctgttgtcatgacgctcttgatctcagtgggtttgagctttggtgcgtttggtaacaaggaacgtgaagctaatgctttcgccagcgctattattgcccaggttgtcggtgctatgggcgaggttgcctttgaagcgatttgtcccagtgatggtgacaccgagatgcttcttaagtgcatcaccgagaacttaggtgaaatgcacattatcgagaagtgtctcgaagcagaagatgtcttgaagtgcttctacgatgcgaaaaacgaagagcaacgtaaagaacagaaccttgataaagcccctgattactccatgtaccgtatggcctctgcgatggcatcgttctatggcaatggtcgggcagctactgccggtgtagaggaaggcggaccgaacgagttcctcgattctgaggacgccggtcttaaggtgtgggagggcattctcagtaaggccgccaacggaggcaatgtccttggttatgctgacgcgaaacacaacgaggactctggttggttctttggtaatggtgttgccaacaacgagaaaacgtactcctatgattctctagctgatcatgcctttcaagggccttatcactttgcattatttggcgcgacactgagtggcttaggctttgatagctcaaaggcggaggattcgcagactgattttgctcagcgtaagggcatggggtacgcgatgatgatcgcgtacatcatctccggaggcattgatctggtttttaacactgtgctgaatatcttgagcaccataaacccatttagactgctcgttggaccagtatctcagaatactaacaagacattcactgagaatatggctggtgggcagaccacagaaggaacaccgtttgaaggaatgactgatttcttcgggttgatctataactggtcagtgactgtgggctggctcatcggtattcctgtctccattggtctgtttatgatgggtgcgttgatgtttcgacgcatggacaagggatcagcgtttaaaaaggttgttatccgcgtcgtgtacggtgtcgttggcctgccactgcttggtgtctcttataccggtgcgctggattccttcctcgacagcggtagttccacaagtgctggatcaaatgcgacaaagattgtgttgtccacctacgtggatttccaatcatgggcagaaaacacccgtatgcgtgttcctgacaaagtaacactggcgtggagtctggaggatcaggcgccaacagggcagtccatgcggatggtacgcaattcggcgttggaaattaatgctcaatcaaatgagagttttactacttttaagaatccaggttccatggatctaggctatagcatggactggatggaaaagatggcggatccagccaattctggcaccgatgggacctcatcaagttcggcgacgactattttccagggaaccatcgcgctactgagtcgttatatcgacaacgacagtatctcctctggcagtttcgaaacctctattcgaagtgcgatggaatctttgacctcgaaagagggaagtggcgaagctgttgccggtggtgatgtaatggcctgggttactggttacaacacagcctctggtcttaatgagatcactgctgctgaattagctgatgcgaacaatccattgcttgaggtcagcgactcagctggtctgcagggacgacctattgaccgcaatgcggtgtcatttaaatctggtgatgcgacagcgtcatgcaacaactcagtcgtgacaggttctcgtgctgtggtcggggactaccgaagtgactgcaatatgtcgcccttgacgatgtacaacttcctcaacacctcattccatccagctgatgcaagtgtcttttctacgtccacttctgcgtcaagctacacccgtgcatcgcatagcgcagtgagtcttatcggttctggtgccatgaactttgtgtactggttctctgcaatgtccctgatgggtagcttcatcgtgatcggtatcggttacgccggtgccatgctgtttaatacgattcgacgcacgctgtcgctcattggtgccgttccttttgctgcgatgggctttattgctggtgttgccaaggtcattgtgtacaccatcgctatgctcgtagaggttatcggaacgatcattttgtaccagctcattacccggttcttgatggctgtaccagcactctttgaacaacctttggctgattccttaagtagtaacgagagtgctgagctggttgccggtgctggtatggggctagtcggtatggcactagctacctcaggcaactgggcgattgccggcatggtgatcacagtggcctcatccatgggggtcatcatcttcacgattattgcgatgaaggtgcgcggatctttggtatcaggtgtcgatgaaaccgtgaccagtgttattaaccgcttcttggatacacaggtctcttctgcaggtgctacctctggtgacggcatgatgcgtcgtgcagccgcaacgggtcttggtattggtgcgacacatatggtactcaaccgtgatggtgacggtggtggatctgattcaggctctggtggatcaggtggcggtagcgattcaggcttgggtgagaaggctgctggtctggcgaaggttgtcacaactgtggctggtgccggattagtcggtaagtatgctacggatgcgctcgataattatgcagatggcgttatcaacggcgacggtgatggtgcgttcgcagcaggtggtgacgctaccgttgatggcgactatgtagcagatggagatgcaattgcttctgctgatgctaacgctgattttgtagacggtgttgttgatggtgctggtcgcgcgtcatttagcaatgctgcgtatagctccgatggaaccactctcgacggtgagggtgcgagcgttgatgcacagggtaacccgcttcatgctgatggcacaccaatgagtgctgctgaagctgaaatgaagatggctggtctgagctcgtcaggaaccatgatggagaaatctggtgtgaaatcgagtggcattaccactgcagcggatgtcatggacgatcagtctctggcaagcagtgtcactgagtctggtctgtccaagattccagacacctatggtgcagatgtctcgggtgctgcgggcacagtcggaactaccggtgctgattacagtgcgaccgattcaagcgcaggtctgaacatgagcgaggctgcattgcagagtggcaccccaatgggcgctctcgctggtggatctgtgtcgagttccgatcaggccatgaatgacgcagctcttcagattgcagcgtctcagggtcttgcaccagcaggttccatagctggtatggagcaacttagtgctcaagccactgaagcacctgctggaaaggccggcaagcagcttggcgatctttctggctcagcgctcaatactcagctggcgtccatgggacagcaggtaggtgacagtgtgaacagcgcttatgctgcaggcggtatgggtggtgttgatgtggctggcaaggtcaccgaggcagcacagcacttgtctcaggttccaggtcagattcagaatgctgtgaccaatgcggatgctggttcctctggcgcaagctttggtcagatggcacagggggcagctggtattgccggtgtcgcaggtgtgatcggtgcagcgggcgcagcaagctctgcagcacaaggcgcaggtactgtccagggtgcgatgggtaatgctgcagctggtgcgggaatgatcaacaacgctgtttccggtggagctactggctcaacaggtgccgcacatgtggtcaatgcatcacatggaccagtggcgcctggtcaggctcactaccaagagtctggtcatgcacaagcatttgtgcagaacaaccaggccaacaccgcgcacacagcaaacacgcgtgcaccgtcatcagctcaaattatgggcgcgaacgttgctggctcactggcatcacaggctgtacgaggaatcggtcagcctggtcagatgggtgctaatgttcgcgacgcgatgggtggcagcggacgctctggtggccgtggtggagcaactcaaggcggtcgaggcgcacagcgcagcggtgtcagtgctaagaacggtatccgtgcacagcgaggtcagaagccttctgtgaccggccaggcgatgaatgcagcaatgcgttcagcagcggtaagcggtcgcatggcaaacatggacggcaacagtgtaggtggcactgaagcagatccacagcaggggagtggcgtaaccgagaagggtgataaaggcgttaaatagcgtgtaaaacacaatgaccg

SEQ ID NO: 772 - protein, 1488 aa, Corynebacterium glutamicum
VTATVLEPQPVQLSEQDVDAEIARMELKHNRHKTWRRRTMAVVMTLLISVGLSFGAFGNKEREANAFASAIIAQVVGAMGEVAFEAICPSDGDTEMLLKCITENLGEMHIIEKCLEAEDVLKCFYDAKNEEQRKEQNLDKAPDYSMYRMASAMASFYGNGRAATAGVEEGGPNEFLDSEDAGLKVWEGILSKAANGGNVLGYADAKHNEDSGWFFGNGVANNEKTYSYDSLADHAFQGPYHFALFGATLSGLGFDSSKAEDSQTDFAQRKGMGYAMMIAYIISGGIDLVFNTVLNILSTINPFRLLVGPVSQNTNKTFTENMAGGQTTEGTPFEGMTDFFGLIYNWSVTVGWLIGIPVSIGLFMMGALMFRRMDKGSAFKKVVIRVVYGVVGLPLLGVSYTGALDSFLDSGSSTSAGSNATKIVLSTYVDFQSWAENTRMRVPDKVTLAWSLEDQAPTGQSMRMVRNSALEINAQSNESFTTFKNPGSMDLGYSMDWMEKMADPANSGTDGTSSSSATTIFQGTIALLSRYIDNDSISSGSFETSIRSAMESLTSKEGSGEAVAGGDVMAWVTGYNTASGLNEITAAELADANNPLLEVSDSAGLQGRPIDRNAVSFKSGDATASCNNSVVTGSRAVVGDYRSDCNMSPLTMYNFLNTSFHPADASVFSTSTSASSYTRASHSAVSLIGSGAMNFVYWFSAMSLMGSFIVIGIGYAGAMLFNTIRRTLSLIGAVPFAAMGFIAGVAKVIVYTIAMLVEVIGTIILYQLITRFLMAVPALFEQPLADSLSSNESAELVAGAGMGLVGMALATSGNWAIAGMVITVASSMGVIIFTIIAMKVRGSLVSGVDETVTSVINRFLDTQVSSAGATSGDGMMRRAAATGLGIGATHMVLNRDGDGGGSDSGSGGSGGGSDSGLGEKAAGLAKVVTTVAGAGLVGKYATDALDNYADGVINGDGDGAFAAGGDATVDGDYVADGDAIASADANADFVDGVVDGAGRASFSNAAYSSDGTTLDGEGASVDAQGNPLHADGTPMSAAEAEMKMAGLSSSGTMMEKSGVKSSGITTAADVMDDQSLASSVTESGLSKIPDTYGADVSGAAGTVGTTGADYSATDSSAGLNMSEAALQSGTPMGALAGGSVSSSDQAMNDAALQIAASQGLAPAGSIAGMEQLSAQATEAPAGKAGKQLGDLSGSALNTQLASMGQQVGDSVNSAYAAGGMGGVDVAGKVTEAAQHLSQVPGQIQNAVTNADAGSSGASFGQMAQGAAGIAGVAGVIGAAGAASSAAQGAGTVQGAMGNAAAGAGMINNAVSGGATGSTGAAHVVNASHGPVAPGQAHYQESGHAQAFVQNNQANTAHTANTRAPSSAQIMGANVAGSLASQAVRGIGQPGQMGANVRDAMGGSGRSGGRGGATQGGRGAQRSGVSAKNGIRAQRGQKPSVTGQAMNAAMRSAAVSGRMANMDGNSVGGTEADPQQGSGVTEKGDKGVK

SEQ ID NO: 773 - DNA, 916 bp, Corynebacterium glutamicum
  CDS (101)..(916): FRXA00739
ttaaagtttctatattccattctaaaataactttgaattggggattaatgaaactttttaagcaattgtttaaaacgaatattgagggggtggcgggcaagtgactgcgacagttttagaaccgcaacctgtacagcttagtgagcaggacgtagatgctgagattgcgcgcatggagcttaaacacaaccgacacaagacgtggcgacgccgaacgatggctgttgtcatgacgctcttgatctcagtgggtttgagctttggtgcgtttggtaacaaggaacgtgaagctaatgctttcgccagcgctattattgcccaggttgtcggtgctatgggcgaggttgcctttgaagcgatttgtcccagtgatggtgacaccgagatgcttcttaagtgcatcaccgagaacttaggtgaaatgcacattatcgagaagtgtctcgaagcagaagatgtcttgaagtgcttctacgatgcgaaaaacgaagagcaacgtaaagaacagaaccttgataaagcccctgattactccatgtaccgtatggcctctgcgatggcatcgttctatggcaatggtcgggcagctactgccggtgtagaggaaggcggaccgaacgagttcctcgattctgaggacgccggtcttaaggtgtgggagggcattctcagtaaggccgccaacggaggcaatgtccttggttatgctgacgcgaaacacaacgaggactctggttggttctttggtaatggtgttgccaacaacgagaaaacgtactcctatgattctctagctgatcatgcctttcaagggccttatcactttgcattatttggcgcgacactgagtggcttaggctttgatagctcaaaggcggaggattcgcagactgattttgctcagcgtaagggcatg

SEQ ID NO: 774 - protein, 272 aa, Corynebacterium glutamicum
VTATVLEPQPVQLSEQDVDAEIARMELKHNRHKTWRRRTMAVVMTLLISVGLSFGAFGNKEREANAFASAIIAQVVGAMGEVAFEAICPSDGDTEMLLKCITENLGEMHIIEKCLEAEDVLKCFYDAKNEEQRKEQNLDKAPDYSMYRMASAMASFYGNGRAATAGVEEGGPNEFLDSEDAGLKVWEGILSKAANGGNVLGYADAKHNEDSGWFFGNGVANNEKTYSYDSLADHAFQGPYHFALFGATLSGLGFDSSKAEDSQTDFAQRKGM

SEQ ID NO: 775 - DNA, 2083 bp, Corynebacterium glutamicum
  CDS (101)..(2083): FRXA01587
catttagactggtcggtggacccgttcttagaatactaacaagacattcactgagaatatggctggtgggcagaccacagaaggaacaccgcttggaggaatgactgatttcttcgggttgatctataactggtcagtgactgtgggctggctcatcggtattcctgtctccattggtctgtttatgatgggtgcgttgatgtttcgacgcatggacaagggatcagcgtttaaaaaggttgttatccgcgtcgtgtacggtgtcgttggcctgccactgcttggtgtctcttataccggtgcgctggattccttcctcgacagcggtagttccacaagtgctggatcaaatgcgacaaagattgtgttgtccacctacgtggatttccaatcatgggcagaaaacacccgtatgcgtgttcctgacaaagtaacactggcgtggagtctggaggatcaggcgccaacagggcagtccatgcggatggtacgcaattcggcgttggaaattaatgctcaatcaaatgagagttttactacttttaagaatccaggttccatggatctaggctatagcatggactggatggaaaagatggcggatccagccaattctggcaccgatgggacctcatcaagttcggcgacgactattttccagggaaccatcgcgctactgagtcgttatatcgacaacgacagtatctcctctggcagtttcgaaacctctattcgaagtgcgatggaatctttgacctcgaaagagggaagtggcgaagctgttgccggtggtgatgtaatggcctgggttactggttacaacacagcctctggtcttaatgagatcactgctgctgaattagctgatgcgaacaatccattgcttgaggtcagcgactcagctggtctgcagggacgacctattgaccgcaatgcggtgtcatttaaatctggtgatgcgacagcgtcatgcaacaactcagtcgtgacaggttctcgtgctgtggtcggggactaccgaagtgactgcaatatgtcgcccttgacgatgtacaacttcctcaacacctcattccatccagctgatgcaagtgtcttttctacgtccacttctgcgtcaagctacacccgtgcatcgcatagcgcagtgagtcttatcggttctggtgccatgaactttgtgtactggttctctgcaatgtccctgatgggtagcttcatcgtgatcggtatcggttacgccggtgccatgctgtttaatacgattcgacgcacgctgtcgctcattggtgccgttccttttgctgcgatgggctttattgctggtgttgccaaggtcattgtgtacaccatcgctatgctcgtagaggttatcggaacgatcattttgtaccagctcattacccggttcttgatggctgtaccagcactctttgaacaacctttggctgattccttaagtagtaacgagagtgctgagctggttgccggtgctggtatggggctagtcggtatggcactagctacctcaggcaactgggcgattgccggcatggtgatcacagtggcctcatccatgggggtcatcatcttcacgattattgcgatgaaggtgcgcggatctttggtatcaggtgtcgatgaaaccgtgaccagtgttattaaccgcttcttggatacacaggtctcttctgcaggtgctacctctggtgacggcatgatgcgtcgtgcagccgcaacgggtcttggtattggtgcgacacatatggtactcaaccgtgatggtgacggtggtggatctgattcaggctctggtggatcaggtggcggtagcgattcaggcttgggtgagaaggctgctggtctggcgaaggttgtcacaactgtggctggtgccggattagtcggtaagtatgctacggatgcgctcgataattatgcagatggcgttatcaacggcgacggtgatggtgcgttcgcagcaggtggtgacgctaccgttgatggcgactatgtagcagatggagatgcaattgcttctgctgatgctaacgctgattttgtagacggggttgctgatggt

SEQ ID NO: 776 - protein, 661 aa, Corynebacterium glutamicum
MTDFFGLIYNWSVTVGWLIGIPVSIGLFMMGALMFRRMDKGSAFKKVVIRVVYGVVGLPLLGVSYTGALDSFLDSGSSTSAGSNATKIVLSTYVDFQSWAENTRMRVPDKVTLAWSLEDQAPTGQSMRMVRNSALEINAQSNESFTTFKNPGSMDLGYSMDWMEKMADPANSGTDGTSSSSATTIFQGTIALLSRYIDNDSISSGSFETSIRSAMESLTSKEGSGEAVAGGDVMAWVTGYNTASGLNEITAAELADANNPLLEVSDSAGLQGRPIDRNAVSFKSGDATASCNNSVVTGSRAVVGDYRSDCNMSPLTMYNFLNTSFHPADASVFSTSTSASSYTRASHSAVSLIGSGAMNFVYWFSAMSLMGSFIVIGIGYAGAMLFNTIRRTLSLIGAVPFAAMGFIAGVAKVIVYTIAMLVEVIGTIILYQLITRFLMAVPALFEQPLADSLSSNESAELVAGAGMGLVGMALATSGNWAIAGMVITVASSMGVIIFTIIAMKVRGSLVSGVDETVTSVINRFLDTQVSSAGATSGDGMMRRAAATGLGIGATHMVLNRDGDGGGSDSGSGGSGGGSDSGLGEKAAGLAKVVTTVAGAGLVGKYATDALDNYADGVINGDGDGAFAAGGDATVDGDYVADGDAIASADANADFVDGVADG

SEQ ID NO: 777 - DNA, 1541 bp, Corynebacterium glutamicum
  CDS (1)..(1518): FRXA01761
gctgatgctaacgctgattttgtagacggtgttgttgatggtgctggtcgcgcgtcatttagcaatgctgcgtatagctccgatggaaccactctcgacggtgagggtgcgagcgttgatgcacagggtaacccgcttcatgctgatggcacaccaatgagtgctgctgaagctgaaatgaagatggctggtctgagctcgtcaggaaccatgatggagaaatctggtgtgaaatcgagtggcattaccactgcagcggatgtcatggacgatcagtctctggcaagcagtgtcactgagtctggtctgtccaagattccagacacctatggtgcagatgtctcgggtgctgcgggcacagtcggaactaccggtgctgattacagtgcgaccgattcaagcgcaggtctgaacatgagcgaggctgcattgcagagtggcaccccaatgggcgctctcgctggtggatctgtgtcgagttccgatcaggccatgaatgacgcagctcttcagattgcagcgtctcagggtcttgcaccagcaggttccatagctggtatggagcaacttagtgctcaagccactgaagcacctgctggaaaggccggcaagcagcttggcgatctttctggctcagcgctcaatactcagctggcgtccatgggacagcaggtaggtgacagtgtgaacagcgcttatgctgcaggcggtatgggtggtgttgatgtggctggcaaggtcaccgaggcagcacagcacttgtctcaggttccaggtcagattcagaatgctgtgaccaatgcggatgctggttcctctggcgcaagctttggtcagatggcacagggggcagctggtattgccggtgtcgcaggtgtgatcggtgcagcgggcgcagcaagctctgcagcacaaggcgcaggtactgtccagggtgcgatgggtaatgctgcagctggtgcgggaatgatcaacaacgctgtttccggtggagctactggctcaacaggtgccgcacatgtggtcaatgcatcacatggaccagtggcgcctggtcaggctcactaccaagagtctggtcatgcacaagcatttgtgcagaacaaccaggccaacaccgcgcacacagcaaacacgcgtgcaccgtcatcagctcaaattatgggcgcgaacgttgctggctcactggcatcacaggctgtacgaggaatcggtcagcctggtcagatgggtgctaatgttcgcgacgcgatgggtggcagcggacgctctggtggccgtggtggagcaactcaaggcggtcgaggcgcacagcgcagcggtgtcagtgctaagaacggtatccgtgcacagcgaggtcagaagccttctgtgaccggccaggcgatgaatgcagcaatgcgttcagcagcggtaagcggtcgcatggcaaacatggacggcaacagtgtaggtggcactgaagcagatccacagcaggggagtggcgtaaccgagaagggtgataaaggcgttaaatagcgtgtaaaacacaatgaccg

SEQ ID NO: 778 - protein, 506 aa, Corynebacterium glutamicum
ADANADFVDGVVDGAGRASFSNAAYSSDGTTLDGEGASVDAQGNPLHADGTPMSAAEAEMKMAGLSSSGTMMEKSGVKSSGITTAADVMDDQSLASSVTESGLSKIPDTYGADVSGAAGTVGTTGADYSATDSSAGLNMSEAALQSGTPMGALAGGSVSSSDQAMNDAALQIAASQGLAPAGSIAGMEQLSAQATEAPAGKAGKQLGDLSGSALNTQLASMGQQVGDSVNSAYAAGGMGGVDVAGKVTEAAQHLSQVPGQIQNAVTNADAGSSGASFGQMAQGAAGIAGVAGVIGAAGAASSAAQGAGTVQGAMGNAAAGAGMINNAVSGGATGSTGAAHVVNASHGPVAPGQAHYQESGHAQAFVQNNQANTAHTANTRAPSSAQIMGANVAGSLASQAVRGIGQPGQMGANVRDAMGGSGRSGGRGGATQGGRGAQRSGVSAKNGIRAQRGQKPSVTGQAMNAAMRSAAVSGRMANMDGNSVGGTEADPQQGSGVTEKGDKGVK

SEQ ID NO: 779 - DNA, 1065 bp, Corynebacterium glutamicum
  CDS (101)..(1042): RXN01765
gcagtccgtcggtgtcgttttccctgaactgccggcagagcttcagccacaaatcccagtcaaggcataacaccgcacaccaagaattttaggaggggtcatgagcaacaacgtagtgaaatatgagtgcgcggtcgacgccgacaacattgtcgcagtcgatatgcatgtgcacttggaagtcgacagctgcggacacaaatcgatgccggcagacatcatggcggcatcctcgaagtactttaagaccgcggaacgaactccctcagcagatgccattgctgatatttatagggaacacaagatggcggcggtggttttcaccatcgatgcgcggacccaaatggggcatctgccgaactcgattgatgatttggtggcaagctgtgcccgcaacaatgacgtgctgatcccttttggcagtgtggatcctcgtaccggcgaggacgcgctggtggaagctcgccgacaggtggaagaactcggggtgcgaggcttcaaattccatccatcggttcaaggattcgacccatccgcgccagagttctacccactgtgggaattgctcgaaagttttggattgccatgcgtgttccataccggacaaaacggcatgggtgcaggtcttccaggtggtcgaggcattaagctgcgcttctccaacccaatgttgcttgatgatgttgcggcggacttcccgaacctgaccatcatcatggcgcacccttctgttccttggcaggatgaggctaactcgattgccacccacaaggccaatgtgttcattgatctttccggctggtcgccgaagtatttcccagagtctttggtcagacagtccaataacgtgctatccaagaaggtgctgtttggcacggacttcccgctgattaccccagagaaatggcttgcggctttcgcgaatctgccactgaaggatgaggttcgtccgggaatcctcaaagacaatgcggtgaaggtacttggcctagccgctagcactgagcgcggatctcaagcagaaaaggtcgtgcaacatgcgtgatcccattcaaggtgctgtta

SEQ ID NO: 780 - protein, 314 aa, Corynebacterium glutamicum
MSNNVVKYECAVDADNIVAVDMHVHLEVDSCGHKSMPADIMAASSKYFKTAERTPSADAIADIYREHKMAAVVFTIDARTQMGHLPNSIDDLVASCARNNDVLIPFGSVDPRTGEDALVEARRQVEELGVRGFKFHPSVQGFDPSAPEFYPLWELLESFGLPCVFHTGQNGMGAGLPGGRGIKLRFSNPMLLDDVAADFPNLTIIMAHPSVPWQDEANSIATHKANVFIDLSGWSPKYFPESLVRQSNNVLSKKVLFGTDFPLITPEKWLAAFANLPLKDEVRPGILKDNAVKVLGLAASTERGSQAEKVVQHA

SEQ ID NO: 781 - DNA, 1065 bp, Corynebacterium glutamicum; identical to SEQ ID NO: 779
  CDS (101)..(1042): FRXA01765

SEQ ID NO: 782 - protein, 314 aa, Corynebacterium glutamicum; identical to SEQ ID NO: 780

SEQ ID NO: 783 - DNA, 588 bp, Corynebacterium glutamicum
  CDS (101)..(565): RXN01767
acaccagccctccacaagagcgtcgaagcaatctacgcttcgacgctctttttttcactacctactcatcccccacataagaaaaaaagacgacaccaccatgattgaccataaactgtggtttaacacagtaaccaacaacgcctctgtccgagaagctgcaggaaaatgcgacatacccatcagaacgctcaacgagcagcttaaccgtcgaatactccctgaaaagaccgtcatcgctctagcacgcgcttatgatctctcacctgttgatgcgctcgttcgcaccggacacctcaccgaagaagaggctggtagtcgtgaagaagatgccagcccagattcagctgacgactaccctacctgggcactgaactcgcaccttgactatggcattctcggagcttttggcgacatcgctgaagaagtaaacagcgaaagagttaaccgcgacaacgccatagagcaaattcgcgcatggctcgacgagcttccaggcagcctattcaacaacctccgcagcactaaaacaggctacatcgaactattcgagacctatctcgattaaacccaaccagcacaacaata

SEQ ID NO: 784 - protein, 155 aa, Corynebacterium glutamicum
MIDHKLWFNTVTNNASVREAAGKCDIPIRTLNEQLNRRILPEKTVIALARAYDLSPVDALVRTGHLTEEEAGSREEDASPDSADDYPTWALNSHLDYGILGAFGDIAEEVNSERVNRDNAIEQIRAWLDELPGSLFNNLRSTKTGYIELFETYLD

SEQ ID NO: 785 - DNA, 436 bp, Corynebacterium glutamicum
  CDS (101)..(436): FRXA01767
acaccagccctccacaagagcgtcgaagcaatctacgcttcgacgctctttttttcactacctactcatcccccacataagaaaaaaagacgacaccaccatgattgaccataaactgtggtttaacacagtaaccaacaacgcctctgtccgagaagctgcaggaaaatgcgacatacccatcagaacgctcaacgagcagcttaaccgtcgaatactccctgaaaagaccgtcatcgctctagcacgcgcttatgatctctcacctgttgatgcgctcgttcgcaccggacacctcaccgaagaagaggctggtagtcgtgaagaagatgccagcccagattcagctgacgactaccctacctgggcactgaactcgcaccttgactatggcattctcggagcttttggcgacatcgctgaagaagtaaacagc

SEQ ID NO: 786 - protein, 112 aa, Corynebacterium glutamicum
MIDHKLWFNTVTNNASVREAAGKCDIPIRTLNEQLNRRILPEKTVIALARAYDLSPVDALVRTGHLTEEEAGSREEDASPDSADDYPTWALNSHLDYGILGAFGDIAEEVNS

SEQ ID NO: 787 - DNA, 564 bp, Corynebacterium glutamicum
  CDS (101)..(541): RXN01769
attttcaacaaccaggactaaaacacctgctgctgttgagcgcttctcacacatcatcctcacaaccccgttgcagcaccagcataaatctatattcgctgtgacggggttgttggggcgcgccccacattcactctttttcccgattggtttctactacacacccatgacctctattactactaccgataccccgctatatacagcactgccccatacccgtatctctgatgcggaattgttgacaccaacaacaactgtgcacgagattctcgtttacggaccggctgagtgcccagggtgtacagcaacgcttgacttctttgcacgcaaaaacatgccggccaccaaagtcactgtagctgccggtgatgtagcacatacctacatcacccaagacttaggttatctccaagcaccgattgtcactgtccgtatcagttcctctgcttctaaccacgacaacgaacacaacacccagatcctgcactggtccggcgttaatcgctacctcatgcaggcactctcccgtactcatttctagaaaggtttttcccgtcatgt

SEQ ID NO: 788 - protein, 147 aa, Corynebacterium glutamicum
VTGLLGRAPHSLFFPIGFYYTPMTSITTTDTPLYTALPHTRISDAELLTPTTTVHEILVYGPAECPGCTATLDFFARKNMPATKVTVAAGDVAHTYITQDLGYLQAPIVTVRISSSASNHDNEHNTQILHWSGVNRYLMQALSRTHF

SEQ ID NO: 789 - DNA, 552 bp, Corynebacterium glutamicum
  CDS (101)..(529): FRXA01769
caggactaaaacacctgctgctgttgagcgcttctcacacatcatcctcacaaccccgttgcagcaccagcataaatctatattcgctgtgacggggttgttggggcgcgccccacattcactctttttcccgattggtttctactacacacccatgacctctattactactaccgataccccgctatatacagcactgccccatacccgtatctctgatgcggaattgttgacaccaacaacaactgtgcacgagattctcgtttacggaccggctgagtgcccagggtgtacagcaacgcttgacttctttgcacgcaaaaacatgccggccaccaaagtcactgtagctgccggtgatgtagcacatacctacatcacccaagacttaggttatctccaagcaccgattgtcactgtccgtatcagttcctctgcttctaaccacgacaacgaacacaacacccagatcctgcactggtccggcgttaatcgctacctcatgcaggcactctcccgtactcatttctagaaaggtttttcccgtcatgt

SEQ ID NO: 790 - protein, 143 aa, Corynebacterium glutamicum
LGRAPHSLFFPIGFYYTPMTSITTTDTPLYTALPHTRISDAELLTPTTTVHEILVYGPAECPGCTATLDFFARKNMPATKVTVAAGDVAHTYITQDLGYLQAPIVTVRISSSASNHDNEHNTQILHWSGVNRYLMQALSRTHF

SEQ ID NO: 791 - DNA, 825 bp, Corynebacterium glutamicum
  CDS (101)..(802): RXN01771
tgccccgctgttggtggttccggagcggcgataatcgctaaacgtttgaggtgattgtatgggtattttcaggtcgcggtcgcaggattttgggtggagcatgcaccaggctggccagctcatcaatgatcccagtcagggtctgtggcgcacttctgccctgcgctcgccggttgctcgggttggacatgccgtgttgcgccagcgtgccggtgagatctcgcgcatgcaaggtcgtgagttttctcgccctggggatcagttccgacaggtagatttgcgcaggcgactgattcaggtccatccccaatcaattcctacagcggatgcgatggccgtaaccatcaccatggcgctcaccgctgccacgattgatccggtgaagttcgtcgcggattcacagaacccggatgaagagatttatttggcagctcagatcgcattgcgggaaatggttatcgctatgcctttggaggatttcatcggggtgcgcattgatctagagcctgttttggtggctgctcaagctgctgcgaagaatgtgggcgtggaagtctcgtcaatcttgctgaaggatctgaatcttccccaggagtactcgggagcgttgcaggaatcgatcgttgcgaaaattcaagccgaaactgatctggaacgtgcacgaaatgaagtgaaaactacccgtgctcgacttgccagcgcgaaagtgttggagcaaaatccgattcttgccaaaattcggatgattgaagcgctcccaccgggatccacaattgaggttcgggagggtgactcaaaggcataaagttgcccatttcggtgccc

SEQ ID NO: 792 - protein, 234 aa, Corynebacterium glutamicum
MHQAGQLINDPSQGLWRTSALRSPVARVGHAVLRQRAGEISRMQGREFSRPGDQFRQVDLRRRLIQVHPQSIPTADAMAVTITMALTAATIDPVKFVADSQNPDEEIYLAAQIALREMVIAMPLEDFIGVRIDLEPVLVAAQAAAKNVGVEVSSILLKDLNLPQEYSGALQESIVAKIQAETDLERARNEVKTTRARLASAKVLEQNPILAKIRMIEALPPGSTIEVREGDSKA

SEQ ID NO: 793 - DNA, 825 bp, Corynebacterium glutamicum; identical to SEQ ID NO: 791
  CDS (101)..(802): FRXA01771

SEQ ID NO: 794 - protein, 234 aa, Corynebacterium glutamicum; identical to SEQ ID NO: 792

SEQ ID NO: 795 - DNA, 849 bp, Corynebacterium glutamicum
  CDS (101)..(826): RXN01774
ctgcgcaagaagagaaaaaacaacgacagcgaagctgcgttcgggcgaatcggcgataatcacacaccactcttcctgagagaatcctgaggtcatcaccatgtcaccgaacttccaagctcgcggtactactgcgcccactgttgctttgtccatgcgccagatcgcgcacatccgtgaagaaattaagaaatcaccactcgctgcttccgttttcatcacacccaccaccaaacaaatggttgtccgagatctagaatcactgttccagcagctctaccacacagatctacctgaaccatccatcaaagacagtggtcttatcagtgctatcggctctagcgccggcaataccaataatccagcactcgccctagaaactcagatggcttaccacctggtgcttgctatgcaccacaccgatgttgctacctggcacaaggtggtgaccaaaaacatcaccgaatctgctgctgcacaagatgctgcggtcgagcacagtgctaaatacgatgctgtgtacgatgccgcacaacttatgggcatcactgttgaggaaggtaatgtcggtagcatcgctattgcctttagcacagcacgtgcagacggtaaatctgattggtgtgtttccggcatcagccgctacatcgaggtcaccgaagccttggatgctgcgcgagctgtcactaaaaatactgatgcgctcaataaaactgctctaccagacgtgcagccggcgccggttgtgcattcagcacagttcatgaacaagtccgcacacgatcatggggttaatactgcggaaaaagatcaaccaaccctgttttaaaagactgtccatttaacaac

SEQ ID NO: 796 - protein, 242 aa, Corynebacterium glutamicum
MSPNFQARGTTAPTVALSMRQIAHIREEIKKSPLAASVFITPTTKQMVVRDLESLFQQLYHTDLPEPSIKDSGLISAIGSSAGNTNNPALALETQMAYHLVLAMHHTDVATWHKVVTKNITESAAAQDAAVEHSAKYDAVYDAAQLMGITVEEGNVGSIAIAFSTARADGKSDWCVSGISRYIEVTEALDAARAVTKNTDALNKTALPDVQPAPVVHSAQFMNKSAHDHGVNTAEKDQPTLF

SEQ ID NO: 797 - DNA, 883 bp, Corynebacterium glutamicum
  CDS (101)..(883): FRXA01774
ctgcgcaagaagagaaaaaacaacgacagcgaagctgcgttcgggcgaatcggcgataatcacacaccactcttcctgagagaatcctgaggtcatcaccatgtcaccgaacttccaagctcgcggtactactgcgcccactgttgctttgtccatgcgccagatcgcgcacatccgtgaagaaattaagaaatcaccactcgctgcttccgttttcatcacacccaccaccaaacaaatggttgtccgagatctagaatcactgttccagcagctctaccacacagatctacctgaaccatccatcaaagacagtggtcttatcagtgctatcggctctagcgccggcaataccaataatccagcactcgccctagaaactcagatggcttaccacctggtgcttgctatgcaccacaccgatgttgctacctggcacaaggtggtgaccaaaaacatcaccgaatctgctgctgcacaagatgctgcggtcgagcacagtgctaaatacgatgctgtgtacgatgccgcacaacttatgggcatcactgttgaggaaggtaatgtcggtagcatcgctattgcctttagcacagcacgtgcagacggtaaatctgattggtgtgtttccggcatcagccgctacatcgaggtcaccgaagccttggatgctgcgcgagctgtcactaaaaatactgatgcgctcaataaaactgctctaccagacgtgcagccggcgccggttgtgcattcagcacagttcatgaacaagtccgcacacgatcatggggttaatactgcggaaaaagatcaaccaacctgtttaaagactgtgcatttacaaccacatcgttacccccgaacaggctttaaggctattcaa

SEQ ID NO: 798 - protein, 261 aa, Corynebacterium glutamicum
MSPNFQARGTTAPTVALSMRQIAHIREEIKKSPLAASVFITPTTKQMVVRDLESLFQQLYHTDLPEPSIKDSGLISAIGSSAGNTNNPALALETQMAYHLVLAMHHTDVATWHKVVTKNITESAAAQDAAVEHSAKYDAVYDAAQLMGITVEEGNVGSIAIAFSTARADGKSDWCVSGISRYIEVTEALDAARAVTKNTDALNKTALPDVQPAPVVHSAQFMNKSAHDHGVNTAEKDQPTCLKTVHLQPHRYPRTGFKAIQ

SEQ ID NO: 799 - DNA, 816 bp, Corynebacterium glutamicum
  CDS (101)..(793): RXN01787
cagaagcacgtattttcttcttaactcgcacctcatctggtgtgggtttttttgcattttttacacaccccactccacacacactcgcaaaggattcatcatgagcaacaatgctcttttagtagcaaacgaagccgacatcggtctctacctccactggaatggtggtcgcgactcgattgaggcgtttctcgcctacgccgcatacgcgcagttaccacccatcaacgaaaataacgattggttgccaccgtttattactgtgctgaagaacttcttcggcaatgatggttctggcgtctacctcgaacctgtcaatcaggattatctcgacggcatcgactatgacaacggtgtttacatgcttgacgattatgagatcactgagcgtattaatccacccgctgttgagcaagactcccacgatctccacgacatgttgatcaaaattgataaagctcaaccacctgtcgatcaactcgggagttttctccatggcctagagacctctgtcgcagatttgggggttggtgatcgcgtatttttgccacgttttagcacctttgataagaaactcggtcgctaccgcatccacactgttctcggattcgctgagaacgatccgtttaaccctatgaccagcagcgagcgatttaaaggtaagccctatgtcgatatgttcgacaatcaagacaacgcctttaacccaaattcctatatcactacagataccgtgcgcatcgttgtcgatcctgtaccggaaactaatcccgacgatgagaaagcaggacgctagccatgtctcgcagctacccc

SEQ ID NO: 800 - protein, 231 aa, Corynebacterium glutamicum
MSNNALLVANEADIGLYLHWNGGRDSIEAFLAYAAYAQLPPINENNDWLPPFITVLKNFFGNDGSGVYLEPVNQDYLDGIDYDNGVYMLDDYEITERINPPAVEQDSHDLHDMLIKIDKAQPPVDQLGSFLHGLETSVADLGVGDRVFLPRFSTFDKKLGRYRIHTVLGFAENDPFNPMTSSERFKGKPYVDMFDNQDNAFNPNSYITTDTVRIVVDPVPETNPDDEKAGR

SEQ ID NO: 801 - DNA, 377 bp, Corynebacterium glutamicum
  CDS (1)..(354): FRXA01787
accgagaaaattgataaagctcaaccacctgtcgatcaactcgggagttttctccatggcctagagacctctgtcgcagatttgggggttggtgatcgcgtatttttgccacgttttagcacctttgataagaaactcggtcgctaccgcatccacactgttctcggattcgctgagaacgatccgtttaaccctatgaccagcagcgagcgatttaaaggtaagccctatgtcgatatgttcgacaatcaagacaacgcctttaacccaaattcctatatcactacagataccgtgcgcatcgttgtcgatcctgtaccggaaactaatcccgacgatgagaaagcaggacgctagccatgtctcgcagctacccc

SEQ ID NO: 802 - protein, 118 aa, Corynebacterium glutamicum
TEKIDKAQPPVDQLGSFLHGLETSVADLGVGDRVFLPRFSTFDKKLGRYRIHTVLGFAENDPFNPMTSSERFKGKPYVDMFDNQDNAFNPNSYITTDTVRIVVDPVPETNPDDEKAGR

SEQ ID NO: 803 - DNA, 897 bp, Corynebacterium glutamicum
  CDS (101)..(874): RXN01796
atgtaactcgatcaggtggaaatgcccgcaaaagtggcggcggtggccgagggatggccgttggtgcggcatcggtggcctgctactagtcgggctcttcttgctccttggcggtaaccctgccgagatcgaccaggttttaggtggcgatcaaacccagatcgagtctggagagtccaccggagccggcgactttgatcactgccaaaccggcgcagatgccaacgccagtgatgattgtcgcctttactacacctcattctccgtcaatgaaatgtggcagactttgcttccagctcaggctggtatcgaatacaccgagccgacattgactcttttcaaaaactccacccaaaccggctgcggtttcgcttctgcgtccactgggccgttttactgtccgtcagaccaagatgcttattttgacttgactttcttcgatcagatgcgtcagttcggtgcagaaaacgccccgcttgcccagatgtacatcgtggcgcacgagtacggccaccacgtccaaaacctcgagggcacactcggactgtccaattacaacgatccgggcgctgattccaacgccgtcaagatcgagttgcaggccgattgctacgcaggcatttgggctaatcactccagcgaaggcccggatccgctactccaacccatcaccgaatctgagctagattccgctctccttgctgcaagcgccgtgggcgacgacaatatccagcaacgatccggtggcgatgtcaatcctgaaagctggactcacggctcatcgcagcagcgcaaagacgcgttcctcgccggctacaacaccggccagatgagcgcctgcgacttcctcggccggggcgtctacaacgacgcttaaagcattgcttttcgacgtct

SEQ ID NO: 804 - protein, 258 aa, Corynebacterium glutamicum
LLLGGNPAEIDQVLGGDQTQIESGESTGAGDFDHCQTGADANASDDCRLYYTSFSVNEMWQTLLPAQAGIEYTEPTLTLFKNSTQTGCGFASASTGPFYCPSDQDAYFDLTFFDQMRQFGAENAPLAQMYIVAHEYGHHVQNLEGTLGLSNYNDPGADSNAVKIELQADCYAGIWANHSSEGPDPLLQPITESELDSALLAASAVGDDNIQQRSGGDVNPESWTHGSSQQRKDAFLAGYNTGQMSACDFLGRGVYNDA

SEQ ID NO: 805 - DNA, 506 bp, Corynebacterium glutamicum
  CDS (1)..(483): FRXA01796
ttttactgtccgtcagaccaagatgcttatgttgacttgactttgttcgatcagatgcgtcagttcggtgcagaaaacgccccgcttgcccagatgtacatcgtggcgcacgagtacggccaccacgtccaaaacctcgagggcacactcggactgtccaattacaacgatccgggcgctgattccaacgccgtcaagatcgagttgcaggccgattgctacgcaggcatttgggctaatcactccagcgaaggcccggatccgctactccaacccatcaccgaatctgagctagattccgctctccttgctgcaagcgccgtgggcgacgacaatatccagcaacgatccggtggcgatgtcaatcctgaaagctggactcacggctcatcgcagcagcgcaaagacgcgttcctcgccggctacaacaccggccagatgagcgcctgcgacttcctcggccggggcgtctacaacgacgcttaaagcattgcttttcgacgtct

SEQ ID NO: 806 - protein, 161 aa, Corynebacterium glutamicum
FYCPSDQDAYVDLTLFDQMRQFGAENAPLAQMYIVAHEYGHHVQNLEGTLGLSNYNDPGADSNAVKIELQADCYAGIWANHSSEGPDPLLQPITESELDSALLAASAVGDDNIQQRSGGDVNPESWTHGSSQQRKDAFLAGYNTGQMSACDFLGRGVYNDA

SEQ ID NO: 807 - DNA, 1083 bp, Corynebacterium glutamicum
  CDS (101)..(1060): RXN01803
ctagcggaaaggctttagcgacaaggctttttgcatgttttaatgcagggaatattaactttttgttaatctctgaccattgaccttgtacgcttaaaacatgcgaaagaaaaaagacggtcaaaatctcccagacttccggaaaaatccgccaaagctggataaaaaggcttatgaaaaagaactaaaaagacttcaagccgaactcgtcgatttgcaacaatgggttgtggaaaccggtgcgcgcgtggtcatcgtcatggaaggccgcgacgccgctggtaaaggttctgcgatcaagcgcattacgcagtacctcaacccccggtccgcaaggatcgaagcgctgcccaccccaaactctcgggaaaaagggcagtggtatttccagcgctacatcgaaaaattgccgactgctggtgagatcgttatctttgaccgctcctggtacaaccgtgcaggagtcgagcgcgtcatgggattttgcacctcccaggagtaccgccgattccttcaccaggcaccaatctttgaacgcctgttggtggaagatggcattcacctgcgtaaatactggttctctgtatctgatgaagagcagattgagcgtttcgaagaccgcctgagcgatccgctgcgccggtggaagttgtcgccaatggatttacaatcgatcacccgctgggaagattactcacgcgcaaaagatgagatgttcatccacacggacatcccgtcagcaccgtggtacacggtggaatctgaggacaagaagcgttcccgcatcaacgtcatttcgcatctgctctcgacgattccttatgagaagatcgatcgtccattgccggaaatccctcatcgcccagattctgaatctgattatgtacgtccccctcgcgatgagttccgttatgttccagatgtggcagcacacttggaagaagagcgcatcaagaaagaagaaaaagccaagaaggcaaagaagccagctaaggctgcaggaaagaactcggataagcagaagtcttccggaggaaaaggcaagaagaagtccaagaaatagaacgccttttaaggggttga

SEQ ID NO: 808 - protein, 320 aa, Corynebacterium glutamicum
MRKKKDGQNLPDFRKNPPKLDKKAYEKELKRLQAELVDLQQWVVETGARVVIVMEGRDAAGKGSAIKRITQYLNPRSARIEALPTPNSREKGQWYFQRYIEKLPTAGEIVIFDRSWYNRAGVERVMGFCTSQEYRRFLHQAPIFERLLVEDGIHLRKYWFSVSDEEQIERFEDRLSDPLRRWKLSPMDLQSITRWEDYSRAKDEMFIHTDIPSAPWYTVESEDKKRSRINVISHLLSTIPYEKIDRPLPEIPHRPDSESDYVRPPRDEFRYVPDVAAHLEEERIKKEEKAKKAKKPAKAAGKNSDKQKSSGGKGKKKSKK

SEQ ID NO: 809 - DNA, 1083 bp, Corynebacterium glutamicum; identical to SEQ ID NO: 807
  CDS (101)..(1060): FRXA01803

SEQ ID NO: 810 - protein, 320 aa, Corynebacterium glutamicum; identical to SEQ ID NO: 808

SEQ ID NO: 811 - DNA, 1299 bp, Corynebacterium glutamicum
  CDS (101)..(1276): RXN01809
acaacacgacagttgtaactagtggtttcaacaccattatcggtatgactcgtggcgactcgtatctctctgatgatctcgatgacctgggttaaacccgatgaacgagcaggaacgagaagccttagaggatgctgcccttgaggaagctgccttagccgatgaattagctgcattagaggctgaagctggcgtacaagggtcagtcgagccttatgactatgcagcagaccttgatgatgaggacgagtttgatgaggacccttttgctcaggatgaaccccgtgacgctggtccgctaggtgagttgagcagtgataaccatgtctctgaggctgttgctgaagacactgggacaagtacagaagagtctgcacaagagggcagtcacgaagagtcggtagacaatccccgtgatttcaccggcactgcgacagcggtgcgatcttttcgacccagacttcccgtacccaatgcactgcgaccaggaccacccatccgaacacaaccggcagtgaacaccgacatagatgatggcgggcaagagaatacagctggcgcgactgccgcagatgtgggggcgggagtgttttttggtacgcattttgagctggcttttgggcaggttgatgttcaccgccacataaggcatgagcaggctatgcgagatggacaccaggatctcagcgtctttgtcggtgctgatggggcgatcatgctggaagaacttaaaaatcgttaccagcgcccaccggagaacgagccccatgatgatgatgtcaccgaaatgataaagaccaccgaggaaacagagaaggagaacgtagagatggatcaggatatagctgtagtagacaacgttgatgaacaggttgtggtgacacctgctcatgacgctgacagcgtagcggttgttgctgaacaggtcgttgcgtcagaaccaacgccagagccggtacccaaggttgagcacgtagagatgagtgtcgatctagcgggtgagactattacaccgattgatcaggcaattcggtcttttatgcagctcaacggtattgagcacagcgtggtgttgcgacgcttggggctgatgactcaggtggcacataataaggaacttgatgaggtctacgctaaggcacttgccgagggtgaatcccatgctcagcagcagcatgaattagaagcagaaaatgaacggcttaaaaaagaagttgatgcgctcgctgcagagcttagtgctgcgttgatgggcgagggtggtggtgatcatgactaaggccgtgacaccaattgtgg

SEQ ID NO: 812 - protein, 392 aa, Corynebacterium glutamicum
MNEQEREALEDAALEEAALADELAALEAEAGVQGSVEPYDYAADLDDEDEFDEDPFAQDEPRDAGPLGELSSDNHVSEAVAEDTGTSTEESAQEGSHEESVDNPRDFTGTATAVRSFRPRLPVPNALRPGPPIRTQPAVNTDIDDGGQENTAGATAADVGAGVFFGTHFELAFGQVDVHRHIRHEQAMRDGHQDLSVFVGADGAIMLEELKNRYQRPPENEPHDDDVTEMIKTTEETEKENVEMDQDIAVVDNVDEQVVVTPAHDADSVAVVAEQVVASEPTPEPVPKVEHVEMSVDLAGETITPIDQAIRSFMQLNGIEHSVVLRRLGLMTQVAHNKELDEVYAKALAEGESHAQQQHELEAENERLKKEVDALAAELSAALMGEGGGDHD

SEQ ID NO: 813 - DNA, 586 bp, Corynebacterium glutamicum
  CDS (101)..(586): FRXA01062
acaacacgacagttgtaactagtggtttcaacaccattatcggtatgactcgtggcgactcgtatctctctgatgatctcgatgacctgggttaaacccgatgaacgagcaggaacgagaagccttagaggatgctgcccttgaggaagctgccttagccgatgaattagctgcattagaggctgaagctggcgtacaagggtcagtcgagccttatgactatgcagcagaccttgatgatgaggacgagtttgatgaggacccttttgctcaggatgaaccccgtgacgctggtccgctaggtgagttgagcagtgataaccatgtctctgaggctgttgctgaagacactgggacaagtacagaagagtctgcacaagagggcagtcacgaagagtcggtagacaatccccgtgatttcaccggcactgcgacagcggtgcgatcttttcgacccagacttcccgtacccaatgcactgcgaccaggaccacccatccgaacacaaccggcagtgaacaccgacatatatgatggcgggcaagagaatacagctggcgcgactgccgcagatgtgggggcggga

SEQ ID NO: 814 - protein, 162 aa, Corynebacterium glutamicum
MNEQEREALEDAALEEAALADELAALEAEAGVQGSVEPYDYAADLDDEDEFDEDPFAQDEPRDAGPLGELSSDNHVSEAVAEDTGTSTEESAQEGSHEESVDNPRDFTGTATAVRSFRPRLPVPNALRPGPPIRTQPAVNTDIYDGGQENTAGATAADVGAG

SEQ ID NO: 815 - DNA, 659 bp, Corynebacterium glutamicum
  CDS (1)..(636): FRXA01809
cacataaggcatgagcaggctatgcgagatggacaccaggatctcagcgtctttgtcggtgctgatggggcgatcatgctggaagaacttaaaaatcgttaccagcgcccaccggagaacgagccccatgatgatgatgtcaccgaaatgataaagaccaccgaggaaacagagaaggagaacgtagagatggatcaggatatagctgtagtagacaacgttgatgaacaggttgtggtgacacctgctcatgacgctgacagcgtagcggttgttgctgaacaggtcgttgcgtcagaaccaacgccagagccggtacccaaggttgagcacgtagagatgagtgtcgatctagcgggtgagactattacaccgattgatcaggcaattcggtcttttatgcagctcaacggtattgagcacagcgtggtgttgcgacgcttggggctgatgactcaggtggcacataataaggaacttgatgaggtctacgctaaggcacttgccgagggtgaatcccatgctcagcagcagcatgaattagaagcagaaaatgaacggcttaaaaaagaagttgatgcgctcgctgcagagcttagtgctgcgttgatgggcgagggtggtggtgatcatgactaaggccgtgacaccaattgtgg

SEQ ID NO: 816 - protein, 212 aa, Corynebacterium glutamicum
HIRHEQAMRDGHQDLSVFVGADGAIMLEELKNRYQRPPENEPHDDDVTEMIKTTEETEKENVEMDQDIAVVDNVDEQVVVTPAHDADSVAVVAEQVVASEPTPEPVPKVEHVEMSVDLAGETITPIDQAIRSFMQLNGIEHSVVLRRLGLMTQVAHNKELDEVYAKALAEGESHAQQQHELEAENERLKKEVDALAAELSAALMGEGGGDHD

SEQ ID NO: 817 - DNA, 804 bp, Corynebacterium glutamicum
  CDS (101)..(781): RXN01811
gaaggagaagagacattgtctcaagaagagctgacattagtcgcattgaattcttatgaaaaaggagagttgccaaagaagaatatcattatttgaaaacgtgtttgaatttgatgataccttggcaaaagatatacaagtagaccgtacgtccatgcaagtattcgaagcttcagaaaccgtcaaagaagcgataaaagcttcgattgaacaaggacatactcgctatccggttatcttagaatcaaaagacaatgttttaggttatgtcaccttgccagatttgatcaagcaatcttataaagatgaccagctgacagtagaacagttgattgaagagccgatcgtaacaactgaaacgatccctataaaaaaattattgacgatcatgcgaaaaaagggaaagcatattgctatcttaaaagatgaatacggagggacaagcggcttagtgacgattgaagatattttagaagaaatcgtcggggaaatccgagatgagacagatttggacgaagcattgatagcggaacagtcagatggctcttatatcatctccggcaaactaacattagatgatttccagcgttattttcatgtagagattccagagtttgaagaaacgaattttactacacttgcgggctttgcttctagccgatataaagaaataaaagcaggaacaatcattgagattgcatcattccgtttcacggtattagaataccagcatgcacatatcgattatttcaaagtagagtccacggaaagaaaaacagaataaaagaaaaaaggctgtgacat

SEQ ID NO: 818 - protein, 227 aa, Corynebacterium glutamicum
VFEFDDTLAKDIQVDRTSMQVFEASETVKEAIKASIEQGHTRYPVILESKDNVLGYVTLPDLIKQSYKDDQLTVEQLIEEPIVTTETIPIKKLLTIMRKKGKHIAILKDEYGGTSGLVTIEDILEEIVGEIRDETDLDEALIAEQSDGSYIISGKLTLDDFQRYFHVEIPEFEETNFTTLAGFASSRYKEIKAGTIIEIASFRFTVLEYQHAHIDYFKVESTERKTE

SEQ ID NO: 819 - DNA, 789 bp, Corynebacterium glutamicum
  CDS (101)..(766): RXN01813
gcgagaattcaagaaaacaaaacagatcaaagtaaggcaacaagtgagcaacaaagttcagaatccgaaccaaggtggaagcaagaacttcctctgggcaatggtggcgatcgtcgtcgttgcaatcgtcgtcgtcggcttcatcgtcatccaaggccagggctcaaaagcagccaagcttggtgaccgcgactacgaagacacctctttggcaatggaagtaggctccgactccatcacgctgacctccgcaaacacctccgccgacgcaaagtccgtgcagctttttgaagacttctcctgctctcactgctccgagctctccctcgccaccgacgctgacatgaagactcagatcgaagacggcaacctggtcgtcgaaatcaagccactgaacttccttgaccgcgaaaacatcgacggccactccacccacgcattggcagcagcccttgcagtggcagactccaacgacgcaaccctctactggaacttccgcgcattcctcatggaagatcagtccgagatctacaaccagtggtccgatgatgacttcgcagacggcgttgaagcccttggcgcagactcctccgtagtagacgcaatccgaaacggcgacaacatccagcgcgcatacgacctggcaaccgcaaacggtgaagaactcactgaagaaaccggcagcctgtcctcaccacgcgtcctccaggacggcaaggatgttgaaggcaacatctccgactggatcaccactgttctagcttcttaaagaactgatctagaaggaaa

SEQ ID NO: 820 - protein, 222 aa, Corynebacterium glutamicum
MVAIVVVAIVVVGFIVIQGQGSKAAKLGDRDYEDTSLAMEVGSDSITLTSANTSADAKSVQLFEDFSCSHCSELSLATDADMKTQIEDGNLVVEIKPLNFLDRENIDGHSTHALAAALAVADSNDATLYWNFRAFLMEDQSEIYNQWSDDDFADGVEALGADSSVVDAIRNGDNIQRAYDLATANGEELTEETGSLSSPRVLQDGKDVEGNISDWITTVLAS

SEQ ID NO: 821 - DNA, 730 bp, Corynebacterium glutamicum
  CDS (101)..(730): FRXA01813
gcgagaattcaagaaaacaaaacagatcaaagtaaggcaacaagtgagcaacaaagttcagaatccgaaccaaggtggaagcaagaacttcctctgggcaatggtggcgatcgtcgtcgttgcaatcgtcgtcgtcggcttcatcgtcatccaaggccagggctcaaaagcagccaagcttggtgaccgcgactacgaagacacctctttggcaatggaagtaggctccgactccatcacgctgacctccgcaaacacctccgccgacgcaaagtccgtgcagctttttgaagacttctcctgctctcactgctccgagctctccctcgccaccgacgctgacatgaagactcagatcgaagacggcaacctggtcgtcgaaatcaagccactgaacttccttgaccgcgaaaacatcgacggccactccacccacgcattggcagcagcccttgcagtggcagactccaacgacgcaaccctctactggaacttccgcgcattcctcatggaagatcagtccgagatctacaaccagtggtccgatgatgacttcgcagacggcgttgaagcccttggcgcagactcctccgtagtagacgcaatccgaacggcgacaacatccagcgcgcatacgacctggcaaccgcaaacggtgaagaactcactgaagaaaccggcagcctgttcttaccacgcgttcttcaagacggcaaggatgttgaaggca

SEQ ID NO: 822 - protein, 210 aa, Corynebacterium glutamicum
MVAIVVVAIVVVGFIVIQGQGSKAAKLGDRDYEDTSLAMEVGSDSITLTSANTSADAKSVQLFEDFSCSHCSELSLATDADMKTQIEDGNLVVEIKPLNFLDRENIDGHSTHALAAALAVADSNDATLYWNFRAFLMEDQSEIYNQWSDDDFADGVEALGADSSVVDAIRTATTSSAHTTWQPQTVKNSLKKPAACSYHAFFKTARMLKA

SEQ ID NO: 823 - DNA, 915 bp, Corynebacterium glutamicum
  CDS (101)..(892): RXN01815
gaatgaaaagaagtggtggccgatgcttggctatctcagcctgacttttacacttggatattctgctgtttttctcgggatgcggctctagaattgtagaatgaatcgttcaacaatttccccagttgaagcccgccagcaattccgcgcaggccttatccaacccacctccggctggtccgcgggttttgcccaagccaacctcatttccatgccccaggatctggcttatgatttcctgctttttgctcaacgcaaccccaagccctgccccatcttggaagtattaaatgctggcgaaaccttcggcggaattttcggctcaaacgccaccgaagcagacatccgcaccgacgcgccccaataccgcatttacgcacacggcgaacttatcgattcccccgccagcgccgtcgattattggcgcgacgacctcgtcagtttcatcatcggctgctcctttacttttgaacatcccatggtccaagcaggcgttcccgtccgccacctcgaggccggccgcaacgtccccatgtatgaaacctcacttgcctgccgaccagccggttccctatcaggaaacctcgtggtgtcactgcgcatgatccccgcatcccaagtcgcggatgccgtccgcattacctcccgctaccccgcggttcacggagcaccagtccacatcggcgatccttcactgatcggaatcgatgacatcaacaaccctgatttcggcgatgccccgctgtccgaaccaagcgacgtccccgtgttttgggcctgcggagttacccctcaagcaatggtcatgtcctccaagccaccgctggcgatcactcacgcacccggacacatgctgatcaccgacgccccagatctgggattccaggttccttaaacctggatccaccgatgtga

SEQ ID NO: 824 - protein, 264 aa, Corynebacterium glutamicum
MNRSTISPVEARQQFRAGLIQPTSGWSAGFAQANLISMPQDLAYDFLLFAQRNPKPCPILEVLNAGETFGGIFGSNATEADIRTDAPQYRIYAHGELIDSPASAVDYWRDDLVSFIIGCSFTFEHPMVQAGVPVRHLEAGRNVPMYETSLACRPAGSLSGNLVVSLRMIPASQVADAVRITSRYPAVHGAPVHIGDPSLIGIDDINNPDFGDAPLSEPSDVPVFWACGVTPQAMVMSSKPPLAITHAPGHMLITDAPDLGFQVP

SEQ ID NO: 825 - DNA, 915 bp, Corynebacterium glutamicum; identical to SEQ ID NO: 823
  CDS (101)..(892): FRXA01815

SEQ ID NO: 826 - protein, 264 aa, Corynebacterium glutamicum; identical to SEQ ID NO: 824

SEQ ID NO: 827 - DNA, 393 bp, Corynebacterium glutamicum
  CDS (101)..(370): RXN01825
gtcaaggtagctggcccggcaactgatacgttaagctcaaacaagataagtaccagttgctggggtttttccaagacaataaattatgaaggtgtgaacaatgccaaaggcaagagtaactaaaaacgagaccgcaccggtttcaagcaacccaagcgcaaaccgcaccccggttaagatcaattccgccggaaccccaatgtggtacaaggtcatcatgtttgccttcatgatcgtcggcctagcctggttgatcattaactacctcgtgggcccacagatcccattcatggctgatcttggtgcatggaactatggcatcggcttcggtctgatgatcatcggcctactcatgaccatgggttggcgttaatccttcaaaaaagtgactgc

SEQ ID NO: 828 - protein, 90 aa, Corynebacterium glutamicum
MPKARVTKNETAPVSSNPSANRTPVKINSAGTPMWYKVIMFAFMIVGLAWLIINYLVGPQIPFMADLGAWNYGIGFGLMIIGLLMTMGWR

SEQ ID NO: 829 - DNA, 393 bp, Corynebacterium glutamicum; identical to SEQ ID NO: 827
  CDS (101)..(370): FRXA01825

SEQ ID NO: 830 - protein, 90 aa, Corynebacterium glutamicum; identical to SEQ ID NO: 828

SEQ ID NO: 831 - DNA, 585 bp, Corynebacterium glutamicum
  CDS (101)..(562): RXN01831
cctgtggataattggttgttggctgatggtgatgtcattacggtgggtcattccaatatcgaagttcgtattgttagtccctagagggagaggttgatcaatggattctctggtccttcttgggcttcgcatcgctttgcttgtggtgttgtggtttttcgtcttgatggcgctgcgcgctatgagggcagatttgaaagtgacgggtcaagcgtcgacaagcagctcctccgtcgcggcaccgcagggccttgcccgggcttttaatcgctccagcccgcctcgtcttttgacggtggtcgagggcccgttggcgggctcctcgattgaggtgtcggaggatatgacgatgggccgtagccctgagtgcacgtttgtggtgggcgatgattacgcctccggcatgcatgcgcgggtgtttaagcgtggttcggagtggtttgtggaggatctggattcgcgcaacggcacttttgtcggtggtacgcgcattgatcagcctgagcagattgcggtgggcacggatatccgtattggtcgtacagcagtgaggcttgttccctgatgttgaaacttaaatatgcg

SEQ ID NO: 832 - protein, 154 aa, Corynebacterium glutamicum
MDSLVLLGLRIALLVVLWFFVLMALRAMRADLKVTGQASTSSSSVAAPQGLARAFNRSSPPRLLTVVEGPLAGSSIEVSEDMTMGRSPECTFVVGDDYASGMHARVFKRGSEWFVEDLDSRNGTFVGGTRIDQPEQIAVGTDIRIGRTAVRLVP

SEQ ID NO: 833 - DNA, 585 bp, Corynebacterium glutamicum; identical to SEQ ID NO: 831
  CDS (101)..(562): FRXA01831

SEQ ID NO: 834 - protein, 154 aa, Corynebacterium glutamicum; identical to SEQ ID NO: 832

SEQ ID NO: 835 - DNA, 825 bp, Corynebacterium glutamicum
  CDS (101)..(802): RXN01834
actaagaacgtgagcttggtttcataataccccccagggtattgttagccaggtgattctagcccttcttggcggcctaataataggcctacttcttggcatgctcggtggtggcggtgccatccttgccattccgctgcttatttatggattttcttttagcgccacgcaagctactgcagcttcattaatcatcatcggacttggcgccctcattggactgatcagccaatacgctgccgggcacgtccgccttaaagagggtctaagctttggccttttagggttggtcggctcatttgtgggcagtcaccttgctagcaatatccccgattccctactcctgagcggctttgccatcctcacgctcgtggtggcgttgaccatgatttctaaattaagaagcacccgagaatacataaccagaaggccaagcatccttgccattgctcttagtgccaccggcgtgggatttttgacgggattttttggtgtgggtggcggttttgccattgtgccagccttgatttttgcgctcggtttttccatgcggcaggctagcgccacttccctagtggtgatcgccgttaacagcgctattgccatgggatttagatattccgatttggcaagtattgactggtcagtgatctcgccaattatcatcaccaccgtattgggcgcttttagtggcgtaaaactagccaaaaaggtcaaagcatcatcactgcaactaggttttgctggcttcttgatcttcatttcgatctatatgggatttcagaatttcccggaccttttttaaaacttcaaaatatacccccc

SEQ ID NO: 836 - protein, 234 aa, Corynebacterium glutamicum
MLGGGGAILAIPLLIYGFSFSATQATAASLIIIGLGALIGLISQYAAGHVRLKEGLSFGLLGLVGSFVGSHLASNIPDSLLLSGFAILTLVVALTMISKLRSTREYITRRPSILAIALSATGVGFLTGFFGVGGGFAIVPALIFALGFSMRQASATSLVVIAVNSAIAMGFRYSDLASIDWSVISPIIITTVLGAFSGVKLAKKVKASSLQLGFAGFLIFISIYMGFQNFPDLF

SEQ ID NO: 837 - DNA, 825 bp, Corynebacterium glutamicum; identical to SEQ ID NO: 835
  CDS (101)..(802): FRXA01834

SEQ ID NO: 838 - protein, 234 aa, Corynebacterium glutamicum; identical to SEQ ID NO: 836

SEQ ID NO: 839 - DNA, 382 bp, Corynebacterium glutamicum
  CDS (101)..(382): RXN01846
gtatttaggaattgaaacccactaaaaaacagactaagttactaggtgataacaaaagttgtttattacttatgggaatagtgtggaaagtagggtgaatatgtcaattcctggaaatgttagttatgttgcacagggtggcaccggttgggatggtgctgatcagtacaccacgggtgagagttgggatctacagtcgttccttgaaaactcgactgactacctcatgattattggtggttcgctgctggcacttgttggtggtgctgctgtgatttggggctttgtcaacgtgatgcgcaagctcttcggtggtcagagtggtcagcagattcagtggttcaccactattttgctcatcattgtcggtggtgcgttgcct

SEQ ID NO: 840 - protein, 94 aa, Corynebacterium glutamicum
MSIPGNVSYVAQGGTGWDGADQYTTGESWDLQSFLENSTDYLMIIGGSLLALVGGAAVIWGFVNVMRKLFGGQSGQQIQWFTTILLIIVGGALP

SEQ ID NO: 841 - DNA, 358 bp, Corynebacterium glutamicum
  CDS (101)..(358): FRXA01846
gtatttaggaattgaaacccactaaaaaacagactaagttactaggtgataacaaaagttgtttattacttatgggaatagtgtggaaagtagggtgaatatgtcaattcctggaaatgttagttatgttgcacagggtggcaccggttgggatggtgctgatcagtacaccacgggtgagagttgggatctacagtcgttccttgaaaactcgactgactacctcatgattattggtggttcgctgctggcacttgttggtggtgctgctgtgatttggggctttgtcaacgtgatgcgcaagctcttcggtggtcagagtggtcagcagattcagtggttcaccactattttgctc

SEQ ID NO: 842 - protein, 86 aa, Corynebacterium glutamicum
MSIPGNVSYVAQGGTGWDGADQYTTGESWDLQSFLENSTDYLMIIGGSLLALVGGAAVIWGFVNVMRKLFGGQSGQQIQWFTTILL

SEQ ID NO: 843 - DNA, 858 bp, Corynebacterium glutamicum
  CDS (101)..(835): RXN01847
gacgtgtgatcataggtgacaaatataccctctcaacttggcttcgactgccctgccccctcgatttaagaggcaaggcttttacagtatcctctcatgcatgcttattgtgttgcctccctcagaaactaagacccacggcggttcaggaaaacctctggattttcaccatttgagtttcccgtcgctcaccaaggcacgccaaacaatactcgctgacctgcaagctttggaggtagatgaggcgctgaaagttttgggcatttctgaaaagctccgccctgaggccgaatccaatcgcgcgctggagaccagccctacgatgcctgcgatttttcggtattccggagtgctttatgatgcgctcgacgctgcaacgctgccggagaaagcactggaacgcctcgccatcggctcggcacttttcggcgtcatccacgccaccgatccgatcccgcattaccgcctgtccggcggcacaaaactgcccaccaaaagcggcgagctgcccaccatgaaggcgcgttggggcacaagcatcagcgaagcgcttatcgacgtcaaccagctggtgattgatcttcgcagcgggacctaccaacagttgggtcgcgtaaaagacgccgtcacggtacgcgtggaatcagtcatggaggatggctcccgcaaagtagtcagccactttaacaaacactacaaaggtgaactcgcccgcgtgctcgcgctctctgaaaaagaagcacacaccgcagaggacgtaatgagcattgcgcaggctgcgggccttgtggtggaggaaaaccccaaccacaaggaaaccctcactctggttgtctaggcgttaatcaccattttgat

SEQ ID NO: 844 - protein, 245 aa, Corynebacterium glutamicum
MLIVLPPSETKTHGGSGKPLDFHHLSFPSLTKARQTILADLQALEVDEALKVLGISEKLRPEAESNRALETSPTMPAIFRYSGVLYDALDAATLPEKALERLAIGSALFGVIHATDPIPHYRLSGGTKLPTKSGELPTMKARWGTSISEALIDVNQLVIDLRSGTYQQLGRVKDAVTVRVESVMEDGSRKVVSHFNKHYKGELARVLALSEKEAHTAEDVMSIAQAAGLVVEENPNHKETLTLVV

SEQ ID NO: 845 - DNA, 809 bp, Corynebacterium glutamicum
  CDS (52)..(786): FRXA01847
gccctgccccctcgatttaagaggcaaggcttttacagtatcctctcatgcatgcttattgtgttgcctccctcagaaactaagacccacggcggttcaggaaaacctctggattttcaccatttgagtttcccgtcgctcaccaaggcacgccaaacaatactcgctgacctgcaagctttggaggtagatgaggcgctgaaagttttgggcatttctgaaaagctccgccctgaggccgaatccaatcgcgcgctggagaccagccctacgatgcctgcgatttttcggtattccggagtgctttatgatgcgctcgacgctgcaacgctgccggagaaagcactggaacgcctcgccatcggctcggcacttttcggcgtcatccacgccaccgatccgatcccgcattaccgcctgtccggcggcacaaaactgcccaccaaaagcggcgagctgcccaccatgaaggcgcgttggggcacaagcatcagcgaagcgcttatcgacgtcaaccagctggtgattgatcttcgcagcgggacctaccaacagttgggtcgcgtaaaagacgccgtcacggtacgcgtggaatcagtcatggaggatggctcccgcaaagtagtcagccactttaacaaacactacaaaggtgaactcgcccgcgtgctcgcgctctctgaaaaagaagcacacaccgcagaggacgtaatgagcattgcgcaggctgcgggccttgtggtggaggaaaaccccaaccacaaggaaaccctcactctggttgtctaggcgttaatcaccattttgat

SEQ ID NO: 846 - protein, 245 aa, Corynebacterium glutamicum; identical to SEQ ID NO: 844

SEQ ID NO: 847 - DNA, 448 bp, Corynebacterium glutamicum
  CDS (101)..(448): RXN01874
agtgtcggcgcgacgattgtgggcggtgctttggcgtggcacgcagcagtttggcatcacagttccggagcgcaaaacgcggtcagcctttcgcgtcgcagtgatcgcgtatgttgccagcgcgtgctgcctgccgtttggcgcatttgccggagcgttgttgtccaaggagctgtcgggacatctccaggaacgagtccttctcacccacacggtgattaattttctaggtttcgtgggatttgctgcgctcggttcgctgtcggtgctgttcgccgcgatttggcgcaccaaaattcgccacaatttcaccccgtggtctgtggggatcatggcggtgagcctgccgatcatcgtcacgggcatcctgctcaacaacggctatgtcgccgccacaggcctggccgcgtacgtggcagcatggttgctggccatggtggggtggggg

SEQ ID NO: 848 - protein, 116 aa, Corynebacterium glutamicum
VIAYVASACCLPFGAFAGALLSKELSGHLQERVLLTHTVINFLGFVGFAALGSLSVLFAAIWRTKIRHNFTPWSVGIMAVSLPIIVTGILLNNGYVAATGLAAYVAAWLLAMVGWG

SEQ ID NO: 849 - DNA, 448 bp, Corynebacterium glutamicum
  CDS (101)..(448): FRXA01874
agtgtcggcgcgacgattgtgggcggtgctttggcgtggcacgcagcagtttggcatcacagttccggagcgcaaaacgcggtcagcctttcgcgtcgcagtgatcgcgtatgttgccagcgcgtgctgcctgccgtttggcgcatttgccggagcgttgttgtccaaggagctgtcgggacatctccaggaacgagtccttctcacccacacggtgattaattttctaggtttcgtgggatttgctgcgctcggttcgctgtcggtgctgttcgccgcgatttggcgcaccaaaattcgccacaatttcaccccgtggtctgtggggatcatggcggtgagcctgccgatcatcgtcacgggcatcctgctcaacaacggctatgtcgccgcacaggcctggccgcgtacgtggcagcatggttgctggccatggtggggtggggga

SEQ ID NO: 850 - protein, 116 aa, Corynebacterium glutamicum
VIAYVASACCLPFGAFAGALLSKELSGHLQERVLLTHTVINFLGFVGFAALGSLSVLFAAIWRTKIRHNFTPWSVGIMAVSLPIIVTGILLNNGYVAAQAWPRTWQHGCWPWWGGG

SEQ ID NO: 851 - DNA, 969 bp, Corynebacterium glutamicum
  CDS (101)..(946): RXN01875
aatcctatccctaaaaagtttctaacaaaagtattgcacttactttttgatagtgctatcttcagttgtgtacttgaaacacacacgaatggagcaagaaatgcgtattgcagtaactggagcaacgggatctttgggtggacatgttgtggatagtcttctaaacaagggcgtcgcagcatcagacatcgttgccattgttcgaaatgaagaaaaggcagcagacctcaaagcccgtggaatcgctcttggtgtggctacttttgaagacgaagcggcactgactgcagctcttgaaggtgtggatcgccttgtgtttatctctggcagcgaagtggggcagcgcgttgcgcagcacaccaatgtcatcaatgccgctaaagcagctggcgtgacattcattgcatacaccagcttgctcaaccttggtacctcaaagcttgcacttgctccagagcacattgcaacggaaaagctcctggcagaaagcggcattgaccacgcgctgctgcgcaatggttggtactgggagaactacgaatcttcaattggcgcagcgaaggccaccgggaaggtattcggcgcagctgaaggcgcacgcgtttccgcagccgcacgtaaggactacgcagaggcagctgctgttgtcatcaccagcgacaaccaggcaggcaaggtctatgagctcgcaggcgcaccagctttgacctacccagagatcgcagctggcattggtgaggtcattggttctgaggcagaatacgtcaacctctccgtggaggagtaccaaaatgcgctggagcaggctggcgttccagctgaatttgcagcacttctcgcaggcatggatcccatcattgcagagggcgcgctgtactccgacagcaccgacctacaggatctcatcggacgcccgagcacctcaatcgttgaggccctgagctcataacctgctactcacctaaaatg

SEQ ID NO: 852 - protein, 282 aa, Corynebacterium glutamicum
MRIAVTGATGSLGGHVVDSLLNKGVAASDIVAIVRNEEKAADLKARGIALGVATFEDEAALTAALEGVDRLVFISGSEVGQRVAQHTNVINAAKAAGVTFIAYTSLLNLGTSKLALAPEHIATEKLLAESGIDHALLRNGWYWENYESSIGAAKATGKVFGAAEGARVSAAARKDYAEAAAVVITSDNQAGKVYELAGAPALTYPEIAAGIGEVIGSEAEYVNLSVEEYQNALEQAGVPAEFAALLAGMDPIIAEGALYSDSTDLQDLIGRPSTSIVEALSS

SEQ ID NO: 853 - DNA, 921 bp, Corynebacterium glutamicum
  CDS (101)..(898): FRXA01875
ctwkcktsrswtgtgtrsywgawwmmcwywcscagcatsrwgcwrgwwwyrmgkwktscasyaaacwggrgtcartcscggatctttgggtggacatgttgtggatagtcttctaaacaagggcgtcgcagcatcagacatcgttgccattgttcgaaatgaagaaaaggcagcagacctcaaagcccgtggaatcgctcttggtgtggctacttttgaagacgaagcggcactgactgcagctcttgaaggtgtggatcgccttgtgtttatctctggcagcgaagtggggcagcgcgttgcgcagcacaccaatgtcatcaatgccgctaaagcagctggcgtgacattcattgcatacaccagcttgctcaaccttggtacctcaaagcttgcacttgctccagagcacattgcaacggaaaagctcctggcagaaagcggcattgaccacgcgctgctgcgcaatggttggtactgggagaactacgaatcttcaattggcgcagcgaaggccaccgggaaggtattcggcgcagctgaaggcgcacgcgtttccgcagccgcacgtaaggactacgcagaggcagctgctgttgtcatcaccagcgacaaccaggcaggcaaggtctatgagctcgcaggcgcaccagctttgacctacccagagatcgcagctggcattggtgaggtcattggttctgaggcagaatacgtcaacctctccgtggaggagtaccaaaatgcgctggagcaggctggcgttccagctgaatttgcagcacttctcgcaggcatggatcccatcattgcagagggcgcgctgtactccgacagcaccgacctacaggatctcatcggacgcccgagcacctcaatcgttgaggccctgagctcataacctgctactcacctaaaatg

SEQ ID NO: 854 - protein, 266 aa, Corynebacterium glutamicum
VDSLLNKGVAASDIVAIVRNEEKAADLKARGIALGVATFEDEAALTAALEGVDRLVFISGSEVGQRVAQHTNVINAAKAAGVTFIAYTSLLNLGTSKLALAPEHIATEKLLAESGIDHALLRNGWYWENYESSIGAAKATGKVFGAAEGARVSAAARKDYAEAAAVVITSDNQAGKVYELAGAPALTYPEIAAGIGEVIGSEAEYVNLSVEEYQNALEQAGVPAEFAALLAGMDPIIAEGALYSDSTDLQDLIGRPSTSIVEALSS

SEQ ID NO: 855 - DNA, 484 bp, Corynebacterium glutamicum
  CDS (101)..(484): FRXA02734
aatcctatccctaaaaagtttctaacaaaagtattgcacttactttttgatagtgctatcttcagttgtgtacttgaaacacacacgaatggagcaagaaatgcgtattgcagtaactggagcaacgggatctttgggtggacatgttgtggatagtcttctaaacaagggcgtcgcagcatcagacatcgttgccattgttcgaaatgaagaaaaggcagcagacctcaaagcccgtggaatcgctcttggtgtggctacttttgaagacgaaacggcactgactgcagctcttgaaggtgtggatcgccttgtgtttatctctggcagcgaagtggggcagcgcgttgcgcaacacaccaatgtcatcaatgccgctaaagcaactggcgtgacattcattgcatacaccagcttgctcaaccttggtcctcaaagcttgcacttgctccagagcacattgcaaccggaaaagctcctggca

SEQ ID NO: 856 - protein, 128 aa, Corynebacterium glutamicum
MRIAVTGATGSLGGHVVDSLLNKGVAASDIVAIVRNEEKAADLKARGIALGVATFEDETALTAALEGVDRLVFISGSEVGQRVAQHTNVINAAKATGVTFIAYTSLLNLGPQSLHLLQSTLQPEKLLA

SEQ ID NO: 857 - DNA, 1194 bp, Corynebacterium glutamicum
  CDS (101)..(1171): RXN01877
gtacccgtattgtactaattgtaattccccggagagggaagaagtttacatggcgccccatcagaagtcagggatcaaccggatcaacagcacccgctcggtgccgttgcgtttggctaccggtggcgtgctcgccaccttgcttatcggcggagtcaccgctgcagctaccaaaaaggacatcattgttgatgtcaacggcgagcagatgtccctagtgactatgtccggcactgttgaaggtgtgctggcgcaagctggtgtggaacttggtgaccaggacattgtttccccttcactggattcatccatcagtgatgaagacactgtgactgttcgtactgccaagcaggtggcgctcgtggtggaaggtcaaatccaaaacgtgaccaccactgcggtttccgtggaggacctcctgcaggaagtcggtggcattaccggtgctgatgcggtggacgctgatctttcagagaccatcccagaatctggtttgaaggtgagtgttaccaagccgaagattatttccatcaatgatggtggcaaggtcacttacgtttctttggcagctcagaacgtacaggaagccctagagctgcgggatattgagctgggtgctcaggaccgcattaatgtgcctctggatcagcagctgaagaacaacgctgcgatccagatcgaccgcgttgacaacaccgaaatcactgaaactgtgtctttcgatgctgagccaacctacgtggatgatccagaagctccagctggcgatgaaactgtggtcgaagaaggcgctcctggaaccaaggaagttactcgcaccgtaacaaccgttaatggtcaggaagaatcttccacggtgatcaatgaagttgaaatcaccgcagcaaagccagcaaccattagccgtggcaccaaaactgtcgctgcaaactccgtgtgggatcagctggcacagtgtgaatccggcggaaactgggcaatcaacacaggtaatggcttctccggcggcctacagttccacccacagacctggctcgcatacggtggtggagctttctccggtgacgcttccggtgcaagccgtgaacagcaaatctccatcgcagaaaaggttcaggctgcacaaggttggggagcatggcctgcttgcaccgcaagcttgggcatccgatagtagaaatctggcatccaata

SEQ ID NO: 858 - protein, 357 aa, Corynebacterium glutamicum
VPLRLATGGVLATLLIGGVTAAATKKDIIVDVNGEQMSLVTMSGTVEGVLAQAGVELGDQDIVSPSLDSSISDEDTVTVRTAKQVALVVEGQIQNVTTTAVSVEDLLQEVGGITGADAVDADLSETIPESGLKVSVTKPKIISINDGGKVTYVSLAAQNVQEALELRDIELGAQDRINVPLDQQLKNNAAIQIDRVDNTEITETVSFDAEPTYVDDPEAPAGDETVVEEGAPGTKEVTRTVTTVNGQEESSTVINEVEITAAKPATISRGTKTVAANSVWDQLAQCESGGNWAINTGNGFSGGLQFHPQTWLAYGGGAFSGDASGASREQQISIAEKVQAAQGWGAWPACTASLGIR

SEQ ID NO: 859 - DNA, 1188 bp, Corynebacterium glutamicum
  CDS (101)..(1165): FRXA01877
gtattgtactaattgtaattccccggagagggaagaagtttacatggcgccccatcagaagtcagggatcaaccggatcaacagcacccgctcggtgccgttgcgtttggctaccggtggcgtgctcgccaccttgcttatcggcggagtcaccgctgcagctaccaaaaaggacatcattgttgatgtcaacggcgagcagatgtccctagtgactatgtccggcactgttgaaggtgtgctggcgcaagctggtgtggaacttggtgaccaggacattgtttccccttcactggattcatccatcagtgatgaagacactgtgactgttcgtactgccaagcaggtggcgctcgtggtggaaggtcaaatccaaaacgtgaccaccactgcggtttccgtggaggacctcctgcaggaagtcggtggcattaccggtgctgatgcggtggacgctgatctttcagagaccatcccagaatctggtttgaaggtgagtgttaccaagccgaagattatttccatcaatgatggtggcaaggtcacttacgtttctttggcagctcagaacgtacaggaagccctagagctgcgggatattgagctgggtgctcaggaccgcattaatgtgcctctggatcagcagctgaagaacaacgctgcgatccagatcgaccgcgttgacaacaccgaaatcactgaaactgtgtctttcgatgctgagccaacctacgtggatgatccagaagctccagctggcgatgaaactgtggtcgaagaaggcgctcctggaaccaaggaagttactcgcaccgtaacaaccgttaatggtcaggaagaatcttccacggtgatcaatgaagttgaaatcaccgcagcaaagccagcaaccattagccgtggcaccaaaactgtcgctgcaaactccgtgtgggatcagctggcacagtgtgaatccggcggaaactgggcaatcaacacaggtaatggcttctccggcggcctacagttccacccacagacctggctcgcatacggtggtggagctttctccggtgacgcttccggtgcaagccgtgaacagcaaatctccatcgcagaaaaggttcaggctgcacaaggttggggagcatggcctgcttgcaccgcaagcttgggcatccgatagtagaaatctggcatccaata

SEQ ID NO: 860 - protein, 355 aa, Corynebacterium glutamicum
LRLATGGVLATLLIGGVTAAATKKDIIVDVNGEQMSLVTMSGTVEGVLAQAGVELGDQDIVSPSLDSSISDEDTVTVRTAKQVALVVEGQIQNVTTTAVSVEDLLQEVGGITGADAVDADLSETIPESGLKVSVTKPKIISINDGGKVTYVSLAAQNVQEALELRDIELGAQDRINVPLDQQLKNNAAIQIDRVDNTEITETVSFDAEPTYVDDPEAPAGDETVVEEGAPGTKEVTRTVTTVNGQEESSTVINEVEITAAKPATISRGTKTVAANSVWDQLAQCESGGNWAINTGNGFSGGLQFHPQTWLAYGGGAFSGDASGASREQQISIAEKVQAAQGWGAWPACTASLGIR

SEQ ID NO: 861 - DNA, 1056 bp, Corynebacterium glutamicum
  CDS (101)..(1033): RXN01879
ctttgcgggccgctgatattgatccaacgcttcgtggcgaaaagcttgatgtcactgactatgtgcgcctagctggggtgttgcagcaaaaggatgagaagtgaaaattaccgctaaggcgtgggcgaaaaccaacctgcatttaggtgtgggaccggctcacgacgatggatttcacgagctcatgacggtgtttcaaaccattgatctgtttgacaccgtcaccttaaccaccctcgatgaggagttggtggaggaggggagcgtcgtcaagcaattatctgtgaccggtgcccgtggcgtgcctgaggacgccagcaatcttgcgtggcgcgctgtggatgcgttggttaagcggcgcgcggaaaagacgccgctgtctgcagtttcgctgcatatttccaaggggattccggtggctggcggcatggctggcggctctgcggatgcggctgcgacactgcgcgcagtggatgcctggattgggcctttcggcgaggacacattgctggaggttgccgcggagctcggctcagatgtgccgttttgcctgcttggtggcaccatgcgcggtaccggtcgcggcgagcagctggtagatatgttgacgcgcggcaagctacattgggtggtggccgcgatggcgcatggcctgtccacgcctgaggtattcaaaaagcatgatgagctgaatccggaatcgcatatggatatcagcgacctcagcgccgcacttctcaccggcaacaccgccgaggtggggcagtggctgcacaatgatctgaccagcgccgcactcagtttgcgccctgaactgcgcagcgtcctccaagaaggcatccgctccggcgcgcatgcaggaattgtctccggctccggcccgaccacggtattcttgtgcgaatcggagcacaaagcgcaagacgttaaagaggcgctaatcgacgccggccaggtgtacgctgcttacaccgccaccggccctgcggcctcaaccgccgaccagcgcggcgcacacattttgactgtttcataataaagacaaacttaagtatc

SEQ ID NO: 862 - protein, 311 aa, Corynebacterium glutamicum
VKITAKAWAKTNLHLGVGPAHDDGFHELMTVFQTIDLFDTVTLTTLDEELVEEGSVVKQLSVTGARGVPEDASNLAWRAVDALVKRRAEKTPLSAVSLHISKGIPVAGGMAGGSADAAATLRAVDAWIGPFGEDTLLEVAAELGSDVPFCLLGGTMRGTGRGEQLVDMLTRGKLHWVVAAMAHGLSTPEVFKKHDELNPESHMDISDLSAALLTGNTAEVGQWLHNDLTSAALSLRPELRSVLQEGIRSGAHAGIVSGSGPTTVFLCESEHKAQDVKEALIDAGQVYAAYTATGPAASTADQRGAHILTVS

SEQ ID NO: 863 - DNA, 711 bp, Corynebacterium glutamicum
  CDS (101)..(688): FRXA01879
ctttgcgggccgctgatattgatccaacgcttcgtggcgaaaagcttgatgtcactgactatgtgcgcctagctggggtgttgcagcaaaaggatgagaagtgaaaattaccgctaaggcgtgggcgaaaaccaacctgcatttaggtgtgggaccggctcacgacgatggatttcacgagctcatgacggtgtttcaaaccattgatctgtttgacaccgtcaccttaaccaccctcgatgaggagttggtggaggaggggagcgtcgtcaagcaattatctgtgaccggtgcccgtggcgtgcctgaggacgccagcaatcttgcgtggcgcgctgtggatgcgttggttaagcggcgcgcggaaaagacgccgctgtctgcagtttcgctgcatatttccaaggggattccggtggctggcggcatggctggcggctctgcggatgcggctgcgacactgcgcgcagtggatgcctggattgggcctttcggcgaggacacattgctggaggttgccgcggagctcggctcagatgtgccgttttgcctgcttggtggcaccatgcgcggtaccggtcgcggcgagcagctggtagatatgttgacgcgcggcaagctacattgggtggtggccgcgatggcgcatggcctgtccaccctgaggtattcaaaaagcatgatgagctgaatccggaatcgcatatggat

SEQ ID NO: 864 - protein, 196 aa, Corynebacterium glutamicum
VKITAKAWAKTNLHLGVGPAHDDGFHELMTVFQTIDLFDTVTLTTLDEELVEEGSVVKQLSVTGARGVPEDASNLAWRAVDALVKRRAEKTPLSAVSLHISKGIPVAGGMAGGSADAAATLRAVDAWIGPFGEDTLLEVAAELGSDVPFCLLGGTMRGTGRGEQLVDMLTRGKLHWVVAAMAHGLSTLRYSKSMMS

SEQ ID NO: 865 - DNA, 531 bp, Corynebacterium glutamicum
  CDS (101)..(508): FRXA01880
agctcggctcagatgtgccgttttgcctgcttggtggcaccatgcgcggtaccggtcgcggcgagcagctggtagatatgttgacgcgcggcaagctacattgggtggtggccgcgatggcgcatggcctgtccaccctgaggtattcaaaaagcatgatgagctgaatccggaatcgcatatggatatcagcgacctcagcgccgcacttctcaccggcaacaccgccgaggtggggcagtggctgcacaatgatctgaccagcgccgcactcagtttgcgccctgaactgcgcagcgtcctccaagaaggcatccgctccggcgcgcatgcaggaattgtctccggctccggcccgaccacggtattcttgtgcgaatcggagcacaaagcgcaagacgttaaagaggcgctaatcgacgccggccaggtgtacgctgcttacaccgccaccggccctgcggcctcaaccgccgaccagcgcggcgcacacattttgactgtttcataataaagacaaacttaagtatc

SEQ ID NO: 866 - protein, 136 aa, Corynebacterium glutamicum
LGGGRDGAWPVHPEVFKKHDELNPESHMDISDLSAALLTGNTAEVGQWLHNDLTSAALSLRPELRSVLQEGIRSGAHAGIVSGSGPTTVFLCESEHKAQDVKEALIDAGQVYAAYTATGPAASTADQRGAHILTVS

SEQ ID NO: 867 - DNA, 759 bp, Corynebacterium glutamicum
  CDS (101)..(736): RXN01896
ttattgggcagctcttttggaccgcgaagtcacccccgagctgcgccacagcattgcttattggatccgcgcgaaccacatcaaacgctagagtgattccatgacgcatgcgatcctctttgacctcgacggcaccctcgttgatcacgcttccgccgcccgcgccgccctgcacgcctggtcgccgaccgtgggcgtcgacacggatgttgagcgctggattgagctggataagtggggttttgcccgttttgagcgcggcgaaaccacgcatttaggtcagcggcgcgaccgcatcagggcgtacctcaacagagagcttgacgacgccacctgcgatgatatttactccggctaccttaaagcatatgagcaaaactggactgcctaccccgatgccaagggcgttctcgatcgcgcggtagccaccggtgcccctgtgggaatcctgaccaatggcgcagcccccatgcagcaagacaagcttgatcgcaccggccttggcctgccagaactcgtcatgttggcggcgtccactctggattctgcgaagcctcgccccgaaatgtatgcccgagcgctcacccatttgggtgcccgaaccgcaacaattatcggcgatgattggaccaacgatgtcgcagctccccgcgaacttggctggaatgctctctatttagatcgttccggaaccgatccacgcgccgatatccactccctggatgaactctttcactaggctggcctttattgtttccg

SEQ ID NO: 868 - protein, 212 aa, Corynebacterium glutamicum
MTHAILFDLDGTLVDHASAARAALHAWSPTVGVDTDVERWIELDKWGFARFERGETTHLGQRRDRIRAYLNRELDDATCDDIYSGYLKAYEQNWTAYPDAKGVLDRAVATGAPVGILTNGAAPMQQDKLDRTGLGLPELVMLAASTLDSAKPRPEMYARALTHLGARTATIIGDDWTNDVAAPRELGWNALYLDRSGTDPRADIHSLDELFH

SEQ ID NO: 869 - DNA, 602 bp, Corynebacterium glutamicum
  CDS (1)..(579): FRXA01896
gcccgcgccgccctgcacgcctggtcgccgaccgtgggcgtcgacacggatgttgagcgctggattgagctggataagtggggttttgcccgttttgagcgcggcgaaaccacgcatttaggtcagcggcgcgaccgcatcagggcgtacctcaacagagagcttgacgacgccacctgcgatgatatttactccggctaccttaaagcatatgagcaaaactggactgcctaccccgatgccaagggcgttctcgatcgcgcggtagccaccggtgcccctgtgggaatcctgaccaatggcgcagcccccatgcagcaagacaagcttgatcgcaccggccttggcctgccagaactcgtcatgttggcggcgtccactctggattctgcgaagcctcgccccgaaatgtatgcccgagcgctcacccatttgggtgcccgaaccgcaacaattatcggcgatgattggaccaacgatgtcgcagctccccgcgaacttggctggaatgctctctatttagatcgttccggaaccgatccacgcgccgatatccactccctggatgaactctttcactaggctggcctttattgtttccg

SEQ ID NO: 870 - protein, 193 aa, Corynebacterium glutamicum
ARAALHAWSPTVGVDTDVERWIELDKWGFARFERGETTHLGQRRDRIRAYLNRELDDATCDDIYSGYLKAYEQNWTAYPDAKGVLDRAVATGAPVGILTNGAAPMQQDKLDRTGLGLPELVMLAASTLDSAKPRPEMYARALTHLGARTATIIGDDWTNDVAAPRELGWNALYLDRSGTDPRADIHSLDELFH

SEQ ID NO: 871 - DNA, 909 bp, Corynebacterium glutamicum
  CDS (101)..(886): RXN01899
cctcgcagcacttcgcgcaggcgaatccacagtggccgcaaccttgatcaaagaacacatcgaaggctactacgaagaaaccgctgccgccgaggcctaaatgtcccgcactctgtgggcggtttcagatctacacgtcaccttcgcccaaaaccaaaacaccgttgatgccctcatgccgcaggaccccggcgactggctgatcgtcgctggcgatgtagcagagaaaatccccgatgtggtacgtaccttatccgcgctggtcaaacgctttgacaccgtgatttgggtgccgggcaaccacgaactcttcaaccggaaaacagaccgcgtcaacggcaaagcccgctaccgagcattagtcggacaactccgagccatcggcgtgatcacccccgaagatccctatccgatctttggtggcgtcaccatctgcccacttttcacactttacgattactctttccgtcccctcggcctcaccgcgaaacaagccctcgcccaagcaaaaataaagctagacgacgaactagccatcgccccctacgtagacatccccgcctggtgcgccgaacgagtcacctacacagaagaccgcctaaaagccaccaaaggcccaaaagtcctggtcaatcactggccgctggtcattgagcccacccaccggctcttccaaaaagacatcgcgctgtggtgtggaaccaccgccaccagggattgggccgtacgattcaacgctctcatggccattcacggtcacctacatattcctgccgaaacccgcgttgatggggtaagccacgtggaggtttctttgggttacccctttgaaaaacacccacctcacatgaagcgtccgtggccgtttccggtcatgcagattaactaactctgttgcttaaatggggg

SEQ ID NO: 872 - protein, 262 aa, Corynebacterium glutamicum
MSRTLWAVSDLHVTFAQNQNTVDALMPQDPGDWLIVAGDVAEKIPDVVRTLSALVKRFDTVIWVPGNHELFNRKTDRVNGKARYRALVGQLRAIGVITPEDPYPIFGGVTICPLFTLYDYSFRPLGLTAKQALAQAKIKLDDELAIAPYVDIPAWCAERVTYTEDRLKATKGPKVLVNHWPLVIEPTHRLFQKDIALWCGTTATRDWAVRFNALMAIHGHLHIPAETRVDGVSHVEVSLGYPFEKHPPHMKRPWPFPVMQIN

SEQ ID NO: 873 - DNA, 909 bp, Corynebacterium glutamicum; identical to SEQ ID NO: 871
  CDS (101)..(886): FRXA01899

SEQ ID NO: 874 - protein, 262 aa, Corynebacterium glutamicum; identical to SEQ ID NO: 872

SEQ ID NO: 875 - DNA, 1182 bp, Corynebacterium glutamicum
  CDS (101)..(1159): RXN01902
ggctggtccgaagtgcaaaccttcaacaccggcacctacggtgacaactggaacttcctcttcttcggcgacacccagctgtacaacacccactccaaccgtgcagaagaagtccagaactgggcaaacaacctggaacggcggcccaccaatcgaaaacccaggaacctccttcatcctctccgcgggtgatcaggcaaaccactccagctgggacgagcactccgcatacatctccccagaaaccctgcgcaactaccgtctggccgtgaacaatggaaaccacgaccagtacaactacgacgcctacaacgcgatgtacccacgccctaaccaggtcgatgagaactacttcttcgagtacaacaatgcactcttcctgtccctggactccaacgactacttggacatcgacgacgacatcgcattccttcgcgacaccgtcgcagcacacggtgacgacaaggactggatcgtcctgacctaccaccattccactttctcccaggcctaccacatggatgacgctcgcattaagtaccagcgcgaacgcctcaccccagtgatctctgaactgaacgttgacttggttctcggtggacacgaccacatctacacccgctcccacctgatgaacggcttcaccccagtcgatgcaggccgcgaagcagttgtcggtgaaactctgaaccctaaggccggcgaagttgtttaccttgcaaccaactcttcctcaggctccaagttctacgacttctacgacttccagctcggccagcgttacgacaccggactggatttccaggaaaccgtcgatcagaagaagatccgcacctacaccgcagtctggaaccaggaccaggttcaggactacaccaacgttgaactgaccccagaaggcctgactgtgaccactaaggacgcagtctccggcgagctggttgaccagttcaccctgagcaagcaggaccgcgacgaagaatctgaagtcccagttgaagatgacaaggacggagacaacgcgaccggctcctccaaccttggtctagctgctatcttggctccagttctggccatcttcggtttcgtcggtggactctttgttggcggcggctccctcgctgagttctttgccaacctcggcgtgaagatgcctttctaatactgtctgagattcaagca

SEQ ID NO: 876 - protein, 353 aa, Corynebacterium glutamicum
VQKKSRTGQTTWNGGPPIENPGTSFILSAGDQANHSSWDEHSAYISPETLRNYRLAVNNGNHDQYNYDAYNAMYPRPNQVDENYFFEYNNALFLSLDSNDYLDIDDDIAFLRDTVAAHGDDKDWIVLTYHHSTFSQAYHMDDARIKYQRERLTPVISELNVDLVLGGHDHIYTRSHLMNGFTPVDAGREAVVGETLNPKAGEVVYLATNSSSGSKFYDFYDFQLGQRYDTGLDFQETVDQKKIRTYTAVWNQDQVQDYTNVELTPEGLTVTTKDAVSGELVDQFTLSKQDRDEESEVPVEDDKDGDNATGSSNLGLAAILAPVLAIFGFVGGLFVGGGSLAEFFANLGVKMPF

SEQ ID NO: 877 - DNA, 887 bp, Corynebacterium glutamicum
  CDS (1)..(864): FRXA01902
aactacgacgcctacaacgcgatgtacccacgccctaaccaggtcgatgagaactacttcttcgagtacaacaatgcactcttcctgtccctggactccaacgactacttggacatcgacgacgacatcgcattccttcgcgacaccgtcgcagcacacggtgacgacaaggactggatcgtcctgacctaccaccattccactttctcccaggcctaccacatggatgacgctcgcattaagtaccagcgcgaacgcctcaccccagtgatctctgaactgaacgttgacttggttctcggtggacacgaccacatctacacccgctcccacctgatgaacggcttcaccccagtcgatgcaggccgcgaagcagttgtcggtgaaactctgaaccctaaggccggcgaagttgtttaccttgcaaccaactcttcctcaggctccaagttctacgacttctacgacttccagctcggccagcgttacgacaccggactggatttccaggaaaccgtcgatcagaagaagatccgcacctacaccgcagtctggaaccaggaccaggttcaggactacaccaacgttgaactgaccccagaaggcctgactgtgaccactaaggacgcagtctccggcgagctggttgaccagttcaccctgagcaagcaggaccgcgacgaagaatctgaagtcccagttgaagatgacaaggacggagacaacgcgaccggctcctccaaccttggtctagctgctatcttggctccagttctggccatcttcggtttcgtcggtggactctttgttggcggcggctccctcgctgagttctttgccaacctcggcgtgaagatgcctttctaatactgtctgagattcaagca

SEQ ID NO: 878 - protein, 288 aa, Corynebacterium glutamicum
NYDAYNAMYPRPNQVDENYFFEYNNALFLSLDSNDYLDIDDDIAFLRDTVAAHGDDKDWIVLTYHHSTFSQAYHMDDARIKYQRERLTPVISELNVDLVLGGHDHIYTRSHLMNGFTPVDAGREAVVGETLNPKAGEVVYLATNSSSGSKFYDFYDFQLGQRYDTGLDFQETVDQKKIRTYTAVWNQDQVQDYTNVELTPEGLTVTTKDAVSGELVDQFTLSKQDRDEESEVPVEDDKDGDNATGSSNLGLAAILAPVLAIFGFVGGLFVGGGSLAEFFANLGVKMPF

SEQ ID NO: 879 - DNA, 969 bp, Corynebacterium glutamicum
  CDS (101)..(946): RXN01908
tccacgacatctgacacagaaagaagattcaccatgtctaagaacaacgcagctcacccgcagtctgtcttccatatttcatatcccagcacataccactatgcactctgaccgctttgagcacccagacaacggctatggctacaccattcgtcaggacactgatgcagagaacccgatgacccatcacgatacgaaagatgcagctctctgggttcacaaccgaccacgacgcggagataccgtcgccgataagccagaaggcaatgagattctcgacatctttgccaagttcatctgcggccagcacgataatgatgacaacccgttcgaagtctggtccgacggtgactcggatgcatcactcatccgcaccaaggcgtatgttgccgagcaccaccccgaacttatattcgacatctctgcgaaaaccatcacgggttattcccaaggcgattggctcgatgtggtctgtgttactactgccgccacttgcgacgaacttatccctgctgacagtcttattgacatctaccgccagtgggcttttggtgatgtgtggacagtgattcctgattctcagccaggtctcgcaggtatttatgctgacgatccagctgacgcccttgcgtactatcaagagaatttcgaagatgaacccatctgggatctcttaagccgccacgacgctgacaaagacgccgcagcactggcagctgcctctgctgcagaaaaccacgcactagcgcgaggtactaccccagtcgttatccgtacccaagacatcatcactaacgcgcgatacctcatgtctgatagtgctgatgacaatccagaatacgatcgcgccttggtcgaacttagtgcttatctcttaagtatcgacctcgatgatcgcgttgctgcagagatgaccattttaggtcgccctgtgcctaaagaaggataaccaccacaccagaaaagaag

SEQ ID NO: 880 - protein, 282 aa, Corynebacterium glutamicum
MHSDRFEHPDNGYGYTIRQDTDAENPMTHHDTKDAALWVHNRPRRGDTVADKPEGNEILDIFAKFICGQHDNDDNPFEVWSDGDSDASLIRTKAYVAEHHPELIFDISAKTITGYSQGDWLDVVCVTTAATCDELIPADSLIDIYRQWAFGDVWTVIPDSQPGLAGIYADDPADALAYYQENFEDEPIWDLLSRHDADKDAAALAAASAAENHALARGTTPVVIRTQDIITNARYLMSDSADDNPEYDRALVELSAYLLSIDLDDRVAAEMTILGRPVPKEG

SEQ ID NO: 881 - DNA, 583 bp, Corynebacterium glutamicum
  CDS (101)..(583): FRXA01908
tccacgacatctgacacagaaagaagattcaccatgtctaagaacaacgcagctcacccgcagtctgtcttccatatttcatatcccagcacataccactatgcactctgaccgctttgagcacccagacaacggctatggctacaccattcgtcaggacactgatgcagagaacccgatgacccatcacgatacgaaagatgcagctctctgggttcacaaccgaccacgacgcggagataccgtcgccgataagccagaaggcaatgagattctcgacatctttgccaagttcatctgcggccagcacgataatgatgacaacccgttcgaagtctggtccgacggtgactcggatgcatcactcatccgcaccaaggcgtatgttgccgagcaccaccccgaacttatattcgacatctctgcgaaaaccatcacgggttattcccaaggcgattggctcgatgtggtctgtgttactactgccgccacttgcgacgaacttatccctgctgacagtcttattgacatctaccgccagtgggcttttggtgatgtgtggacagtgattcctgattctcag

SEQ ID NO: 882 - protein, 161 aa, Corynebacterium glutamicum
MHSDRFEHPDNGYGYTIRQDTDAENPMTHHDTKDAALWVHNRPRRGDTVADKPEGNEILDIFAKFICGQHDNDDNPFEVWSDGDSDASLIRTKAYVAEHHPELIFDISAKTITGYSQGDWLDVVCVTTAATCDELIPADSLIDIYRQWAFGDVWTVIPDSQ

SEQ ID NO: 883 - DNA, 970 bp, Corynebacterium glutamicum
  CDS (69)..(947): RXN01909
ttaataagaattgttctgggaagtaatataaaaagtcccgaacaaattagtgtgaaagggtttgtatcatggctaattttcgaagcaaggataaagatggcaatgtcatcaatccgaacgcgtctactaaaggtgtagatcttgttgtcaacgtctacgacagcgccaagcatgtgaccgaaaagggtaacactgtccactttgtggatgttcaggtagcgcaaattccgattgacgctgacggcactcgtgcgaatgcgaatcttgcaccacagactatgcctcatctgcatcttgacactaaggacggtcagcgcaacacaggtgttgcgtattctgatgcgcagattcaagcgatgcagacggtggcagcacaggggcgcaaccatatgaccccgctcttgagcaaagacggtgagacagttggttactccatgttggtcaaggctgatgtcatgttcccgaagaccaaggacggcaagtctctccctgcggtcatgaacactaagtctctgcagccatctggggttcctatttcggacgcgatgaatattcagcagcagcagtttatggctgtggcaatgaatcgccaagcagcagaagcgcagaaggctgcacaagcccaagcgacccaggctcaagcaccacaggtggcaccgcagccagttatgcagaatcagcaattccaggcaccagtgccacagggccagcagccagcatatgcaggagcccctgtctatgcagacgcggtagctcatgcaaccgcgcagcagcaggcagcagcagctcaggcaccgcaggcacctgctgggaatccgtttaaccagccgccagcagtagcagcagctctggcaccgcagacgcagccgccagcagtagcagcagctctggcaccgcagacgcagcagccggcagcacaacctcagatggataacgagccaccgttttaaaggcgcaatacaccacaccc

SEQ ID NO: 884 - protein, 293 aa, Corynebacterium glutamicum
MANFRSKDKDGNVINPNASTKGVDLVVNVYDSAKHVTEKGNTVHFVDVQVAQIPIDADGTRANANLAPQTMPHLHLDTKDGQRNTGVAYSDAQIQAMQTVAAQGRNHMTPLLSKDGETVGYSMLVKADVMFPKTKDGKSLPAVMNTKSLQPSGVPISDAMNIQQQQFMAVAMNRQAAEAQKAAQAQATQAQAPQVAPQPVMQNQQFQAPVPQGQQPAYAGAPVYADAVAHATAQQQAAAAQAPQAPAGNPFNQPPAVAAALAPQTQPPAVAAALAPQTQQPAAQPQMDNEPPF

SEQ ID NO: 885 - DNA, 960 bp, Corynebacterium glutamicum
  CDS (59)..(937): FRXA01909
ttgttctgggaagtaatataaaaagtcccgaacaaattagtgtgaaagggtttgtatcatggctaattttcgaagcaaggataaagatggcaatgtcatcaatccgaacgcgtctactaaaggtgtagatcttgttgtcaacgtctacgacagcgccaagcatgtgaccgaaaagggtaacactgtccactttgtggatgttcaggtagcgcaaattccgattgacgctgacggcactcgtgcgaatgcgaatcttgcaccacagactatgcctcatctgcatcttgacactaaggacggtcagcgcaacacaggtgttgcgtattctgatgcgcagattcaagcgatgcagacggtggcagcacaggggcgcaaccatatgaccccgctcttgagcaaagacggtgagacagttggttactccatgttggtcaaggctgatgtcatgttcccgaagaccaaggacggcaagtctctccctgcggtcatgaacactaagtctctgcagccatctggggttcctatttcggacgcgatgaatattcagcagcagcagtttatggctgtggcaatgaatcgccaagcagcagaagcgcagaaggctgcacaagcccaagcgacccaggctcaagcaccacaggtggcaccgcagccagttatgcagaatcagcaattccaggcaccagtgccacagggccagcagccagcatatgcaggagcccctgtctatgcagacgcggtagctcatgcaaccgcgcagcagcaggcagcagcagctcaggcaccgcaggcacctgctgggaatccgtttaaccagccgccagcagtagcagcagctctggcaccgcagacgcagccgccagcagtagcagcagctctggcaccgcagacgcagcagccggcagcacaacctcagatggataacgagccaccgttttaaaggcgcaatacaccacaccc

SEQ ID NO: 886 - protein, 293 aa, Corynebacterium glutamicum; identical to SEQ ID NO: 884

SEQ ID NO: 887 - DNA, 969 bp, Corynebacterium glutamicum
  CDS (101)..(946): RXN01910
caccgttttaaaggcgcaatacaccacaccccaacaaactttttgattgttggggtgtttgtctcagatcatgaacagcacaatgtaggagaagattgatatggcatttccgcttctagcggttgctggcacagttgcccccgttgcagcaggatgggcaaaagataagtttctcagcaactctcagaataatcagcaggcccagaatcagcagatgagttttggacaggtcaacaacagcgcacagaattctggatcagaaaacagcggtttcatgggtcaatacggcaatctgggtgcaggtttggcaggtgctgctacaggcgcagggcttgcgtatagcgattttgaagatggtcaaagtttgtcctcgaaggcccgcaacatggtcggcaaagggctcgctggtgccggagctggtgtgttcaccaagcttgccaatgatgcaattcaggccgagggtggctcgatgaaggctagtgcttattctgccattgcaggcggcttgggatcgtatctcaaagacggcggtccgggtgtgattaaatccgcgatggccagcggtgcagccggttttggtgcggataaagtgcacgataaattagctgagtctggtcatgaggggttggctgattccttgtcgggcgctattcaaggaggtggtcttggttactccacgcttggcggtgtcactggtgctggtattggcggtgcgacgggcggtctcgcaggactagcacaaaactactttggtggtggcgatgactacagcaacgctggggcatctgcatcggggtttagtgccaaccaggttaatagtgagatcagcaccgagattccgcagtttgcgaatcttggtcaaccacagcgatccgagcttgaacaattagcgctacctcaagaatcacggtctgtagataagagctacgaccaaggctacgaagcgtaagcgctttataacaaccccgt

SEQ ID NO: 888 - protein, 282 aa, Corynebacterium glutamicum
MAFPLLAVAGTVAPVAAGWAKDKFLSNSQNNQQAQNQQMSFGQVNNSAQNSGSENSGFMGQYGNLGAGLAGAATGAGLAYSDFEDGQSLSSKARNMVGKGLAGAGAGVFTKLANDAIQAEGGSMKASAYSAIAGGLGSYLKDGGPGVIKSAMASGAAGFGADKVHDKLAESGHEGLADSLSGAIQGGGLGYSTLGGVTGAGIGGATGGLAGLAQNYFGGGDDYSNAGASASGFSANQVNSEISTEIPQFANLGQPQRSELEQLALPQESRSVDKSYDQGYEA

SEQ ID NO: 889 - DNA, 969 bp, Corynebacterium glutamicum
  CDS (101)..(946): FRXA01910
caccgttttaaaggcgcaatacaccacaccccaacaaactttttgattgttggggtgtttgtctcagatcatgaacagcacaatgtaggagaagattgatatggcatttccgcttctagcggttgctggcacagttgcccccgttgcagcaggatgggcaaaagataagtttctcagcaactctcagaataatcagcaggcccagaatcagcagatgagttttggacaggtcaacaacagcgcacagaattctggatcagaaaacagcggtttcatgggtcaatacggcaatctgggtgcaggtttggcaggtgctgctacaggcgcagggcttgcgtatagcgattttgaagatggtcaaagtttgtcctcgaaggcccgcaacatggtcggcaaagggctcgctggtgccggagctggtgtgttcaccaagcttgccaatgatgcaattcaggccgagggtggctcgatgaaggctagtgcttattctgccattgcaagcggcttgggatcgtatctcaaaaacggcggtccgggtgtgattaaatccgcgatggccagcggtgcagccggttttggtgcggataaagtgcacgataaattagctgagtctggtcatgaggggttggctgattccttgtcgggcgctattcaaggaggtggtcttggttactccacgcttggcggtgtcactggtgctggtattggcggtgcgacgggcggtctcgcaggactagcacaaaactactttggtggtggcgatgactacagcaacgctggggcatctgcatcggggtttagtgccaaccaggttaatagtgagatcagcaccgagattccgcagtttgcgaatcttggtcaaccacagcgatccgagcttgaacaattagcgctacctcaagaatcacggtctgtagataagagctacgaccaaggctacgaagcgtaagcgctttataacaaccccgt

SEQ ID NO: 890 - protein, 282 aa, Corynebacterium glutamicum
MAFPLLAVAGTVAPVAAGWAKDKFLSNSQNNQQAQNQQMSFGQVNNSAQNSGSENSGFMGQYGNLGAGLAGAATGAGLAYSDFEDGQSLSSKARNMVGKGLAGAGAGVFTKLANDAIQAEGGSMKASAYSAIASGLGSYLKNGGPGVIKSAMASGAAGFGADKVHDKLAESGHEGLADSLSGAIQGGGLGYSTLGGVTGAGIGGATGGLAGLAQNYFGGGDDYSNAGASASGFSANQVNSEISTEIPQFANLGQPQRSELEQLALPQESRSVDKSYDQGYEA

SEQ ID NO: 891 - DNA, 1062 bp, Corynebacterium glutamicum
  CDS (101)..(1039): RXN01911
agatgccgcagatcaccgagtgagcgttactgagatcactgagtctcgatgggtaatccatataattgtgagcgggattcttagtgcgctcgcggttctggtgtttattattggcgccggcttgccactgttgtacgtgccgatttttgtgactgtcatcgtcatggtggtgtatgcgctattgcgctatgagcagcgcatgtcaggcacagtctacgaggaagcagatcctgtcgaaatggattcagtgatctgggagggcatcaagtgcgatattgcctcggatattgcagcccgagcagaagcgaaaaaagcgaaaaagccagttgcgtcagatgctgttgctgttggtaactatatcgcgtccttgcgtcagcatatgttggtagaaacccagcgacgttatcaccacaagcttggtcgtgagctgcataatgatccagcgcaactagaggattatggctctggtctgcgtgactgtgagtgtcgggcatgtgtggtggctcagaaattgggtgtcacggtgcacgctcatggtgtggtgcaggcgagcgcacgtaaaaaagatcgcgtcattattgggcgagccgatggtattgatgtggccggctggtggaaccaccgccaagaagctcgacgtaaaacgagcgcggctaagcagttggagcgcgatgcacaacgcaagcgaacccaagctgagcgcgataaagagattgagcgtaagcgtaaggctcaagaatttgtagcggagcagtcagggaaagctgctgcagcacaacggcgggccgagaaaaaggctgcgaagcaagcgcgtgtagatgaactggtggcgcagaaacaggctgctcaggagcagaaaactcactgtaagcgggacaagcagcgtgcgaagaaagcacaagggcgcaaagttggtgccgttgataattccgctgtggacgatgtgttggcgtatgcggagaaaacccgcagtatagctggctgtagagatgacgacagcgttgtgcacgttgatatggcagcgggtgtccgcgatgtctaaatcgcaggatgatcgaaaaa

SEQ ID NO: 892 - protein, 313 aa, Corynebacterium glutamicum
VFIIGAGLPLLYVPIFVTVIVMVVYALLRYEQRMSGTVYEEADPVEMDSVIWEGIKCDIASDIAARAEAKKAKKPVASDAVAVGNYIASLRQHMLVETQRRYHHKLGRELHNDPAQLEDYGSGLRDCECRACVVAQKLGVTVHAHGVVQASARKKDRVIIGRADGIDVAGWWNHRQEARRKTSAAKQLERDAQRKRTQAERDKEIERKRKAQEFVAEQSGKAAAAQRRAEKKAAKQARVDELVAQKQAAQEQKTHCKRDKQRAKKAQGRKVGAVDNSAVDDVLAYAEKTRSIAGCRDDDSVVHVDMAAGVRDV

SEQ ID NO: 893 - DNA, 946 bp, Corynebacterium glutamicum
  CDS (101)..(946): FRXA01911
agatgccgcagatcaccgagtgagcgttactgagatcactgagtctcgatgggtaatccatataattgtgagcgggattcttagtgcgctcgcggttctggtgtttattattggcgccggcttgccactgttgtacgtgccgatttttgtgactgtcatcgtcatggtggtgtatgcgctattgcgctatgagcagcgcatgtcaggcacagtctacgaggaagcagatcctgtcgaaatggattcagtgatctgggagggcatcaagtgcgatattgcctcggatattgcagcccgagcagaagcgaaaaaagcgaaaaagccagttgcgtcagatgctgttgctgttggtaactatatcgcgtccttgcgtcagcatatgttggtagaaacccagcgacgttatcaccacaagcttggtcgtgagctgcataatgatccagcgcaactagaggattatggctctggtctgcgtgactgtgagtgtcgggcatgtgtggtggctcagaaattgggtgtcacggtgcacgctcatggtgtggtgcaggcgagcgcacgtaaaaaagatcgcgtcattattgggcgagccgatggtattgatgtggccggctggtggaaccaccgccaagaagctcgacgtaaaacgagcgcggctaagcagttggagcgcgatgcacaacgcaagcgaacccaagctgagcgcgataaagagattgagcgtaagcgtaaggctcaagaatttgtagcggagcagtcagggaaagctgctgcagcacaacggcgggccgagaaaaaggctgcgaagcaagcgcgtgtagatgaactggtggcgcagaaacaggctgctcaggagcagaaaactcactgtaagcgggacaagcagcgtgcgaagaaagcacaagggcgcaaagttggtgccgttgataattccgctgtggacgatgtg

SEQ ID NO: 894 - protein, 282 aa, Corynebacterium glutamicum
VFIIGAGLPLLYVPIFVTVIVMVVYALLRYEQRMSGTVYEEADPVEMDSVIWEGIKCDIASDIAARAEAKKAKKPVASDAVAVGNYIASLRQHMLVETQRRYHHKLGRELHNDPAQLEDYGSGLRDCECRACVVAQKLGVTVHAHGVVQASARKKDRVIIGRADGIDVAGWWNHRQEARRKTSAAKQLERDAQRKRTQAERDKEIERKRKAQEFVAEQSGKAAAAQRRAEKKAAKQARVDELVAQKQAAQEQKTHCKRDKQRAKKAQGRKVGAVDNSAVDDV

SEQ ID NO: 895 - DNA, 1074 bp, Corynebacterium glutamicum
  CDS (101)..(1051): RXN01930
cgaaagaagccataatttagagaggacaattctctactattggtcaaggctcccacccggtgtcattcgacattattaccgctcactcacaatcgatgaagtgatttcaacaaatgagattgaaaatattcactcaactcgtcgggatattgaaatagcgcttgatgaatcttccactagtgagccaaagagattttcggaaatttcacacctttacctcgcacttgccgaaggtaaaatatcctttccggaaagcccaagtgaacttcgagaactctatgaccatttaatgcacggcgagctaggtaaagaaaatgaattagatggtgagattttccgccaaggacccgtggaaatccgcgatagtcggcaaaaagtgattcattcaggtttttctccagaatcacagatcatcgaaggaatcaacgcaattattaagctggcgcactcagaagaggaatccaaccttgttggcatcatgatgtcacacttcatgtttgaatcaattcacccgttttatgatggaaacggaagaactgggcgctaccttctcgggatacaattaagcaaaattctctcccctgctacagcactgacaatgtcttcggcaattaatcaatttcgaaacaagtactacaaagcgtttcatgccgtagaacaccgattaaatcgcggagacggaacaccgtttgttatttccatgcttgagctgttaattgcagcgcaagaaggtctcattgagaatataaaacaaagaatcgactttttggcaagccttgaggacgccattaaaacgcttcggggtaccaattcctttaagaaccatcagatcaatctgttgtacattctcggccagattcagcttttcggtaaggacgaaacactttcacttgaatcggcagcaaagtttcttaaagtttctaaggcaactgcaacgaggtattttagaactctccgagaaatggaattagttcacgaggtcagcaaacgccctttgcggtttgcgctcacggataaaggtcgtgagatagtaggtcttgaggtaaaaatttgactccataacgagaacttaat

SEQ ID NO: 896 - protein, 317 aa, Corynebacterium glutamicum
VISTNEIENIHSTRRDIEIALDESSTSEPKRFSEISHLYLALAEGKISFPESPSELRELYDHLMHGELGKENELDGEIFRQGPVEIRDSRQKVIHSGFSPESQIIEGINAIIKLAHSEEESNLVGIMMSHFMFESIHPFYDGNGRTGRYLLGIQLSKILSPATALTMSSAINQFRNKYYKAFHAVEHRLNRGDGTPFVISMLELLIAAQEGLIENIKQRIDFLASLEDAIKTLRGTNSFKNHQINLLYILGQIQLFGKDETLSLESAAKFLKVSKATATRYFRTLREMELVHEVSKRPLRFALTDKGREIVGLEVKI

SEQ ID NO: 897 - DNA, 1074 bp, Corynebacterium glutamicum; identical to SEQ ID NO: 895
  CDS (101)..(1051): FRXA01930

SEQ ID NO: 898 - protein, 317 aa, Corynebacterium glutamicum; identical to SEQ ID NO: 896

SEQ ID NO: 899 - DNA, 1095 bp, Corynebacterium glutamicum
  CDS (101)..(1072): RXN01944
gctgattcttctgtaccactcatcacagataataccgcaaccagtatcaaccctgcggagccgtttaccttcgccttcaaatatcaccgatgatgtccaggtgcgcacggcaacactgcatgttacttccagtgctggcgaagccgcgacaaccatcaacctcaccgaggatgacggctctttcaattgggctctgcctgcagcggatctcaccggaaaatcctggttcgaatacaccgtaaccgccaccgacggattcaacagcgttaccaccgagccggtacgcgtcaccgtcgacggcgccaacaccgacccgctgcgcctcaacctggaagaaaaccaatgggtcagtggcaccaccgatgttatcggtgcttcagatgtcttcggcgacaagcttgaattgcttatcgacgacgcgcctgcagtcaccaactccagcctgtctgcggccccgacgtttgcgatggaagtaacccaaactgatgtgttcttccgcaacggcatccttgccggtggggaagaactccgcattttcgatcaaggaacttacgccaacaccgaaaccatctccacaccagtcccgctgtatcacatcaatgaggacggtaccctcacagtcagtgtgtatgcgggaactaaagcagcaccagaaattgacctcaacgagaacaatgacgatttccagatcagaaaccttcgactaattctgcctgatggccggaccctcacccctgccggaatttccgattctaatgcgtggctcaacatgggagacagcgctggaaaactcgatttcttcgatgccaccttcgccctccctgaggatgctttcaccggtgtggcacacgcatgggataccacccaaagcacagatggagaacaccacatcaccatttcccgcgaagacggcggggaaatcagccgcaccatccgggttgataatactgccccagaactcaccgtttctggagttgaagaaggacaagaactgcgcggcaccgtagaaattgatgcccaggcaaccgatgcgggtgcgggcgtgaagagcgtcgagacgcttctcgacggctaacgcgtgcaacttccactaac

SEQ ID NO: 900 - protein, 324 aa, Corynebacterium glutamicum
VRTATLHVTSSAGEAATTINLTEDDGSFNWALPAADLTGKSWFEYTVTATDGFNSVTTEPVRVTVDGANTDPLRLNLEENQWVSGTTDVIGASDVFGDKLELLIDDAPAVTNSSLSAAPTFAMEVTQTDVFFRNGILAGGEELRIFDQGTYANTETISTPVPLYHINEDGTLTVSVYAGTKAAPEIDLNENNDDFQIRNLRLILPDGRTLTPAGISDSNAWLNMGDSAGKLDFFDATFALPEDAFTGVAHAWDTTQSTDGEHHITISREDGGEISRTIRVDNTAPELTVSGVEEGQELRGTVEIDAQATDAGAGVKSVETLLDG

SEQ ID NO: 901 - DNA, 407 bp, Corynebacterium glutamicum
  CDS (1)..(384): FRXA01944
atcagaaaccttcgactaattctgcctgatggccggaccctcacccctgccggaatttccgattctaatgcgtggctcaacatgggagacagcgctggaaaactcgatttcttcgatgccaccttcgccctccctgaggatgctttcaccggtgtggcacacgcatgggataccacccaaagcacagatggagaacaccacatcaccatttcccgcgaagacggcggggaaatcagccgcaccatccgggttgataatactgccccagaactcaccgtttctggagttgaagaaggacaagaactgcgcggcaccgtagaaattgatgcccaggcaaccgatgcgggtgcgggcgtgaagagcgtcgagacgcttctcgacggctaacgcgtgcaacttccactaac

SEQ ID NO: 902 - protein, 128 aa, Corynebacterium glutamicum
IRNLRLILPDGRTLTPAGISDSNAWLNMGDSAGKLDFFDATFALPEDAFTGVAHAWDTTQSTDGEHHITISREDGGEISRTIRVDNTAPELTVSGVEEGQELRGTVEIDAQATDAGAGVKSVETLLDG

SEQ ID NO: 903 - DNA, 673 bp, Corynebacterium glutamicum
  CDS (101)..(673): FRXA01636
gctgattcttctgtaccactcatcacagataataccgcaaccagtatcaaccctgcggagccgtttaccttcgccttcaaatatcaccgatgatgtccaggtgcgcacggcaacactgcatgttacttccagtgctggcgaagccgcgacaaccatcaacctcaccgaggatgacggctctttcaattgggctctgcctgcagcggatctcaccggaaaatcctggttcgaatacaccgtaaccgccaccgacggattcaacagcgttaccaccgagccggtacgcgtcaccgtcgacggcgccaacaccgacccgctgcgcctcaacctggaagaaaaccaatgggtcagtggcaccaccgatgttatcggtgcttcagatgtcttcggcgacaagcttgaattgcttatcgacgacgcgcctgcagtcaccaactccagcctgtctgcggccccgacgtttgcgatggaagtaacccaaactgatgtgttcttccgcaacggcatccttgccggtggggaagaactccgcattttcgatcaaggaacttacgccaacaccgaaaccatctccacaccagtcccgctgtatcacatcaatgaggacggtaccctcacagtcagtgtgtatgcgggaactaaagcagcaccagaaattgacctcaacgagaac

SEQ ID NO: 904 - protein, 191 aa, Corynebacterium glutamicum
VRTATLHVTSSAGEAATTINLTEDDGSFNWALPAADLTGKSWFEYTVTATDGFNSVTTEPVRVTVDGANTDPLRLNLEENQWVSGTTDVIGASDVFGDKLELLIDDAPAVTNSSLSAAPTFAMEVTQTDVFFRNGILAGGEELRIFDQGTYANTETISTPVPLYHINEDGTLTVSVYAGTKAAPEIDLNEN

SEQ ID NO: 905 - DNA, 2115 bp, Corynebacterium glutamicum
  CDS (101)..(2092): RXN01945
agaaggacaagaactgcgcggcaccgtagaaattgatgcccaggcaaccgatgcgggtgcgggcgtgaagagcgtcgagacgcttctcgacggctaacgcgtgcaacttccactaaccaccggttccatcgctttggataaaggtgaacacaccttggttatccgtgcagaagatgaagtaggaaaccgcaccgagaaaaccatcacgtttagcactccggatgaaaaccccatcagtggtgactacgctccaagcaatggggccaccgtgggcgtcggtgacgttaagttatctgcacgagcaagtgatccaagtggcgatactgtcaagatgacgttcctggaagccgattcaccaaaattagatagtggtcgcgtccgaatgtcatcaggaacggtagaagatgccggaagtgtctcgcgcgccgaggcgaaaatgttggagaggggagacgtcgagaagctatccagcctggatgggctgggcatggaagttacctccgacgccgcactgccgtaccagctttttgaagtcgatgcggcggatgcactcgcggccgacactgaagtgcgcctgaattgggcgggatccgccgatggtcgcgcgcaggtgatcatgtatgttttcgatggcgaggcgtgggttgaggtggatcgtcacttgaccggcgatgagctggaagagtttacgctgcagggcgtcgtcaatgcggaaaaatttgcaatcggcggcactgtcaccgtattgattcagcactccgaaggcttcgccggtgcggatcattcaactagaaattccgacgtgaccgcagcgcacccggatgatgtggctcgctctgagtacgatttcaccctcgcgtgggaatctgacacccagtactacaacgaggaattccacgagcaccaaaccaacatccatgactacgtgctcgccgaacgggagaacaagaatattcagttcatgttccacactggcgatgttgtcgacgactgggatcagcccgcgcagtgggccacagccaaccccgaataccagcgcctcgacgacgccggcctgccatattctgtccttgccggaaaccacgatgttggccacaccagcaatgactacaccgaattcagccgacacttcggcgaacagcgctacgtagacaacccgtggtacggcgaatcctaccaagacaaccgagggcactacgatctattttctgccggcggaattgacttcattaacgtagcgatgggctggggtccagacgacgaagaaatcgcgtggatgaacgaggtcctggccaagcatcccgagcgtgtggcgatcctcaacctccacgaattcatgctcaccaccggcggacttggcccgatcccgcagcgcattctcgacgaggtcgcagccaccaacccaaatgtcagcatgatcatgtccggccactaccacgacgcattccaacgcaccgactcctttgacgacgatggtgatggagtagatgaccgcaccgtcacctctatgcttttcgattaccaaggcctaccggagggcggacaggggtacctccgacttctccactttgataaccaaggccaaaagatgatggtgcgcacctattcaccatccctgaaggattacaactctgatgaaccctcactgttggggcctgcagaagaccccaacatgtatcaagaattcgaagtgtcctacgagcagctcggcatcaaaccagagggccgcaccctgatcggcgattccttcagcgccgatttcttgacctccaatgaaattggaatagttgatgaggttccttctggaacgatcgctttcacgaactggaaggacgtaaccgaaggtcgccacagttggtatgttcgctccgaggatcctttcggcggcgtcgagatttcacccgtgcagtccttcattgccggggaagaggctggcgggaacgcgcccggcactggaagctccaatggcggttcatcccacggattatggggtgcgcttgcggaattctttgccggagcggcagccctggctggagctgcgatcgcatttgtccccggaatttgggactatgtgaccaacgcattcaagcgataattatggataggtaaacgctc

SEQ ID NO: 906 - protein, 664 aa, Corynebacterium glutamicum
VQLPLTTGSIALDKGEHTLVIRAEDEVGNRTEKTITFSTPDENPISGDYAPSNGATVGVGDVKLSARASDPSGDTVKMTFLEADSPKLDSGRVRMSSGTVEDAGSVSRAEAKMLERGDVEKLSSLDGLGMEVTSDAALPYQLFEVDAADALAADTEVRLNWAGSADGRAQVIMYVFDGEAWVEVDRHLTGDELEEFTLQGVVNAEKFAIGGTVTVLIQHSEGFAGADHSTRNSDVTAAHPDDVARSEYDFTLAWESDTQYYNEEFHEHQTNIHDYVLAERENKNIQFMFHTGDVVDDWDQPAQWATANPEYQRLDDAGLPYSVLAGNHDVGHTSNDYTEFSRHFGEQRYVDNPWYGESYQDNRGHYDLFSAGGIDFINVAMGWGPDDEEIAWMNEVLAKHPERVAILNLHEFMLTTGGLGPIPQRILDEVAATNPNVSMIMSGHYHDAFQRTDSFDDDGDGVDDRTVTSMLFDYQGLPEGGQGYLRLLHFDNQGQKMMVRTYSPSLKDYNSDEPSLLGPAEDPNMYQEFEVSYEQLGIKPEGRTLIGDSFSADFLTSNEIGIVDEVPSGTIAFTNWKDVTEGRHSWYVRSEDPFGGVEISPVQSFIAGEEAGGNAPGTGSSNGGSSHGLWGALAEFFAGAAALAGAAIAFVPGIWDYVTNAFKR

SEQ ID NO: 907 - DNA, 1342 bp, Corynebacterium glutamicum
  CDS (101)..(1342): FRXA01945
agaaggacaagaactgcgcggcaccgtagaaattgatgcccaggcaaccgatgcgggtgcgggcgtgaagagcgtcgagacgcttctcgacggctaacgcgtgcaacttccactaaccaccggttccatcgctttggataaaggtgaacacaccttggttatccgtgcagaagatgaagtaggaaaccgcaccgagaaaaccatcacgtttagcactccggatgaaaaccccatcagtggtgactacgctccaagcaatggggccaccgtgggcgtcggtgacgttaagttatctgcacgagcaagtgatccaagtggcgatactgtcaagatgacgttcctggaagccgattcaccaaaattagatagtggtcgcgtccgaatgtcatcaggaacggtagaagatgccggaagtgtctcgcgcgccgaggcgaaaatgttggagaggggagacgtcgagaagctatccagcctggatgggctgggcatggaagttacctccgacgccgcactgccgtaccagctttttgaagtcgatgcggcggatgcactcgcggccgacactgaagtgcgcctgaattgggcgggatccgccgatggtcgcgcgcaggtgatcatgtatgttttcgatggcgaggcgtgggttgaggtggatcgtcacttgaccggcgatgagctggaagagtttacgctgcagggcgtcgtcaatgcggaaaaatttgcaatcggcggcactgtcaccgtattgattcagcactccgaaggcttcgccggtgcggatcattcaactagaaattccgacgtgaccgcagcgcacccggatgatgtggctcgctctgagtacgatttcaccctcgcgtgggaatctgacacccagtactacaacgaggaattccacgagcaccaaaccaacatccatgactacgtgctcgccgaacgggagaacaagaatattcagttcatgttccacactggcgatgttgtcgacgactgggatcagcccgcgcagtgggccacagccaaccccgaataccagcgcctcgacgacgccggcctgccatattctgtccttgccggaaaccacgatgttggccacaccagcaatgactacaccgaattcagccgacacttcggcgaacagcgctacgtagacaacccgtggtacggcgaatcctaccaagacaaccgagggcactacgatctattttctgccggcggaattgacttcattaacgtagcgatgggctggggtccagacgacgaagaaatcgcgtggatgaacgaggtcctggccaagcatcccgagcgtgtggcgatcctcaacctccacgaattcatgctc

SEQ ID NO: 908 - protein, 414 aa, Corynebacterium glutamicum
VQLPLTTGSIALDKGEHTLVIRAEDEVGNRTEKTITFSTPDENPISGDYAPSNGATVGVGDVKLSARASDPSGDTVKMTFLEADSPKLDSGRVRMSSGTVEDAGSVSRAEAKMLERGDVEKLSSLDGLGMEVTSDAALPYQLFEVDAADALAADTEVRLNWAGSADGRAQVIMYVFDGEAWVEVDRHLTGDELEEFTLQGVVNAEKFAIGGTVTVLIQHSEGFAGADHSTRNSDVTAAHPDDVARSEYDFTLAWESDTQYYNEEFHEHQTNIHDYVLAERENKNIQFMFHTGDVVDDWDQPAQWATANPEYQRLDDAGLPYSVLAGNHDVGHTSNDYTEFSRHFGEQRYVDNPWYGESYQDNRGHYDLFSAGGIDFINVAMGWGPDDEEIAWMNEVLAKHPERVAILNLHEFML

SEQ ID NO: 909 - DNA, 518 bp, Corynebacterium glutamicum
  CDS (1)..(495): FRXA01627
cgcacctattcaccatccctgaaggattacaactctgatgaaccctcactgttggggcctgcagaagaccccaacatgtatcaagaattcgaagtgtcctacgagcagctcggcatcaaaccagagggccgcaccctgatcggcgattccttcagcgccgatttcttgacctccaatgaaattggaatagttgatgaggttccttctggaacgatcgctttcacgaactggaaggacgtaaccgaaggtcgccacagttggtatgttcgctccgaggatcctttcggcggcgtcgagatttcacccgtgcagtccttcattgccggggaagaggctggcgggaacgcgcccggcactggaagctccaatggcggttcatcccacggattatggggtgcgcttgcggaattctttgccggagcggcagccctggctggagctgcgatcgcatttgtccccggaatttgggactatgtgaccaacgcattcaagcgataattatggataggtaaacgctc

SEQ ID NO: 910 - protein, 165 aa, Corynebacterium glutamicum
RTYSPSLKDYNSDEPSLLGPAEDPNMYQEFEVSYEQLGIKPEGRTLIGDSFSADFLTSNEIGIVDEVPSGTIAFTNWKDVTEGRHSWYVRSEDPFGGVEISPVQSFIAGEEAGGNAPGTGSSNGGSSHGLWGALAEFFAGAAALAGAAIAFVPGIWDYVTNAFKR

SEQ ID NO: 911 - DNA, 441 bp, Corynebacterium glutamicum
  CDS (101)..(418): RXN01960
tccagattgatcgtgccaacaaagactaagccactctagctaaaccaacttaccccaccccaacaccccatgaggcatctgcttcatggggtgttttgctatgccgcaacacttttctcaagaaaactacagaaaggcccccgtcattatgtctgcaccgctcaccattcatgatctgctgtccaccaattcgaagcttaacctcaagtggctgacctgcactgtcttgaacagcccaaatctcaccgaaccctgcatcacggtttctgtgaaccacaccgaaggcatgtccctggtctctttcgaaggtggtcacgggctcaccgagattgccaacacccagctagtgcctgtgcttgagctaccaaagttcaatccttttgaggcacttgctatccaccttgaagccgccaacaactaagaaagcatccttcatgactg

SEQ ID NO: 912 - protein, 106 aa, Corynebacterium glutamicum
MPQHFSQENYRKAPVIMSAPLTIHDLLSTNSKLNLKWLTCTVLNSPNLTEPCITVSVNHTEGMSLVSFEGGHGLTEIANTQLVPVLELPKFNPFEALAIHLEAANN

SEQ ID NO: 913 - DNA, 441 bp, Corynebacterium glutamicum
  CDS (101)..(418): FRXA01960
tccagattgatcgtgccaacaaagactaagccactctagctaaaccaacttaccccaccccaacaccccatgaggcatctgcttcatggggtgttttgctatgccgcaacacttttctcaagaaaactacagaaaggcccccgtcattatgtctgcaccgctcaccattcatgatctgctgtccaccaattcgaagcttaacctcaagtggctgacctgcactgtcttgaacagcccaaatctccccgaaccctgcatcacggtttctgtgaaccacaccgaaggcatgtccctggtctctttcgaaggtggtcacgggctcaccgagattgccaacacccagctagtgcctgtgcttgagctaccaaagttcaatccttttgaggcacttgctatccaccttgaagccgccaacaactaagaaagcatccttcatgactg

SEQ ID NO: 914 - protein, 106 aa, Corynebacterium glutamicum
MPQHFSQENYRKAPVIMSAPLTIHDLLSTNSKLNLKWLTCTVLNSPNLPEPCITVSVNHTEGMSLVSFEGGHGLTEIANTQLVPVLELPKFNPFEALAIHLEAANN

SEQ ID NO: 915 - DNA, 1173 bp, Corynebacterium glutamicum
  CDS (101)..(1150): RXN01985
gacgtgagacatttcctccaatacctctccagtgatattctgtcgggcagcctaacctaagttattccgttgttgttcgagaaagagagagaaacttttcatgcgtacgtctcgcgttctagccggcattcttgccgcaaccctcacggtgtccctcgcggcctgctcccaggattcttcagaaacgtcctccaattcgtcttcagcagcatcccaaagctctgacgtttccaacgaggcgttccctgtcaccattgagcacgctttcggcgagaccaccattgagtccaagccagaacgcatcgcaactgttggctggtccaaccatgaagtccctctcgcattgggtgtgactcctgtcggctttgagaaggtcacgtggggcgacgatgacaacaacggcatcttgccatgggtggaagaaaccttgagcaagctcggctccgatgagcctgtgcttttcgatgccaccgattccattccttttgaggagatcgccaacactgctccggatgtcattttggcgtcctactctggcatcacccaggaagactacgatcagctgtcccagatcgcacctgtggttgcctacccagaaatcgcatggggcacctccctggatgaaatgattgagatgaactctaaggcgattggcttggagcaagaaggcaaggatctcatcgcagatctggatgcagaggttgcttccgccatcgatgccaacccagagttgaaggatgcgaagcctgtattcgcgttcttcgatgagagcgatttctcgcagattggtgtgtacaccagcattgatcctcgcatgagcttcttgcttgatgcgggtgtccaggaagcttcagtcctcaaggagcactccagcccagatagcttctacgagcaggtttctgcagaaaaccctgaaaccttcgacgatgttgatgtgatcatcacctacggcaccgaagatgatgctgcaaacgctgagctgttgtccaagatgcaggctgatccactgctgtctcgaatcccagctatcgccgagggcaaggttgtgttcttgggtgctaacccactggctgcttcagcgaatgaatccccactatctattccttggggtatcaacgattactttgcaaaactcgccgaacctctgaagtaaaactgcttgatgtcaacaac

SEQ ID NO: 916 - protein, 350 aa, Corynebacterium glutamicum
MRTSRVLAGILAATLTVSLAACSQDSSETSSNSSSAASQSSDVSNEAFPVTIEHAFGETTIESKPERIATVGWSNHEVPLALGVTPVGFEKVTWGDDDNNGILPWVEETLSKLGSDEPVLFDATDSIPFEEIANTAPDVILASYSGITQEDYDQLSQIAPVVAYPEIAWGTSLDEMIEMNSKAIGLEQEGKDLIADLDAEVASAIDANPELKDAKPVFAFFDESDFSQIGVYTSIDPRMSFLLDAGVQEASVLKEHSSPDSFYEQVSAENPETFDDVDVIITYGTEDDAANAELLSKMQADPLLSRIPAIAEGKVVFLGANPLAASANESPLSIPWGINDYFAKLAEPLK

SEQ ID NO: 917 - DNA, 336 bp, Corynebacterium glutamicum
  CDS (101)..(313): RXN01987
gggttaggagaggggaaatccccgatgtgctctaggttcttattggcgatgattgaagaagaaagaaaaactcaatcagccataaaggagcttgatcccgatgactttcccagcacaatctcgacgactcgcccgaagcaccaccgacaaatggatcggcggcgtcgctggtggcctcgcagagacctacggttggaatccggcctatgtgcgtctcgcgttcgtggcgtcggttctgtttccactgccaggttcacagatcctgttctacgccctagcgtggctgatcatcccatcccgagaaaatcgcttctaacgtgcgttgcataacgcaga

SEQ ID NO: 918 - protein, 71 aa, Corynebacterium glutamicum
MTFPAQSRRLARSTTDKWIGGVAGGLAETYGWNPAYVRLAFVASVLFPLPGSQILFYALAWLIIPSRENRF

SEQ ID NO: 919 - DNA, 336 bp, Corynebacterium glutamicum; identical to SEQ ID NO: 917
  CDS (101)..(313): FRXA01987

SEQ ID NO: 920 - protein, 71 aa, Corynebacterium glutamicum; identical to SEQ ID NO: 918

SEQ ID NO: 921 - DNA, 549 bp, Corynebacterium glutamicum
  CDS (101)..(526): RXN01988
ttaagaattggattcgagtcggtaccgcttgaaagtactttgcgtaagttcccaccgactgcccctagttgttgcgaatatttatagattgttgagaaagatgaacatgaagacgcacccggcttccgccaagcagaccaccgagcttcgactcctgacagccaccgtgtacttcaaagcactcaatgaagtccacaacgtcatgcagatgatcgacccactaactccagtcgttcccatcaccacgggcacctcagttgccgagctttatgctgacgcccgcgagcacctcgacaatggtgcaacccaggtgatgatccccgtcatttcaccttccaacctgaccttgtcagtagttgccctgggcaatgaagaggttgacgcactgggccattccgaaggacaagcagttcactcccttctggaaattcataccccgaagcgcagctggcctctttccgagctttatattgatgacaatgagggtttggctcaggtgtcgcgctgcttcgcccgccttgttggctagtcccaccccaccaattgcat

SEQ ID NO: 922 - protein, 142 aa, Corynebacterium glutamicum
MNMKTHPASAKQTTELRLLTATVYFKALNEVHNVMQMIDPLTPVVPITTGTSVAELYADAREHLDNGATQVMIPVISPSNLTLSVVALGNEEVDALGHSEGQAVHSLLEIHTPKRSWPLSELYIDDNEGLAQVSRCFARLVG

SEQ ID NO: 923 - DNA, 341 bp, Corynebacterium glutamicum
  CDS (1)..(318): FRXA01988
atgatcgacccactaactccagtcgttcccatcaccacgggcacctcagttgccgagctttatgctgacgcccgcgagcacctcgacaatggtgcaacccaggtgatgatccccgtcatttcaccttccaacctgaccttgtcagtagttgccctgggcaatcaagaggttgacgcactgggccattccgaaggacaagcagttcactcccttctggaaattcataccccgaagcgcagctggcctctttccgagctttatattgatgacaatgagggtttggctcaggtgtcgcgctgcttcgcccgccttgttggctagtcccaccccaccaattgcat

SEQ ID NO: 924 - protein, 106 aa, Corynebacterium glutamicum
MIDPLTPVVPITTGTSVAELYADAREHLDNGATQVMIPVISPSNLTLSVVALGNQEVDALGHSEGQAVHSLLEIHTPKRSWPLSELYIDDNEGLAQVSRCFARLVG

SEQ ID NO: 925 - DNA, 996 bp, Corynebacterium glutamicum
  CDS (101)..(973): RXN01991
tccggaggtggatttgaggatttcgacgttttctcggaagttcctcgggtagaggaaacatcgacgaggatcagctattcttacaaaaattcatttgaatatgacgaatttgttgccgcatttcccgagtaccgacgtagctgcgtgggaaccaaccgttgtgtattcagcggataagaccacagcaacagcgacgtttaagaatattccttcggatatttcctttagttggactggtattgaagcactagagccatttagccctggtaaaaccttcgaacataaggtgcaaggttctgttggtgaaccagcgggggcgttcactagggataactatttcactgagggtgagctctacaaacatcgccacgcagacgatctgctttccggtgatggcttgtttggccccaacatcaccgatggcgatggcaacctcccctctgttgatgacggcaaggacggtgacgatgggtctgatggctcagacggccgagacggtgttgtcgccattgatgttgttgacaatgctgacggcacggtgactgtcaccttgtccgatggcactacgtttactcttgatgctggtcaagacggcaaagatggtcttgacgggcttgatggtactggcctaacgctggaatctgctacccctgatgaggacggcaacatcacctatgttctttctgacggtactgagttcactgtgcgcaacggtgttgatgggtcagacggtaaggacggcaaagatggagtcaatggcacagatggcgtagacgggtcagacggtaaaggtctggtagaggtgtcccgagttaccaacgacaacggctcagtgaccattacctacgaggacggttcacagatcaccacgaagccaacgccgacaaactggctgtccaagctgcttgatttgcttctcccgctgtttaatctgttcggtcttggtggcggctccgtcattagttccagtaagtagttttttcactccctgttttg

SEQ ID NO: 926 - protein, 291 aa, Corynebacterium glutamicum
MTNLLPHFPSTDVAAWEPTVVYSADKTTATATFKNIPSDISFSWTGIEALEPFSPGKTFEHKVQGSVGEPAGAFTRDNYFTEGELYKHRHADDLLSGDGLFGPNITDGDGNLPSVDDGKDGDDGSDGSDGRDGVVAIDVVDNADGTVTVTLSDGTTFTLDAGQDGKDGLDGLDGTGLTLESATPDEDGNITYVLSDGTEFTVRNGVDGSDGKDGKDGVNGTDGVDGSDGKGLVEVSRVTNDNGSVTITYEDGSQITTKPTPTNWLSKLLDLLLPLFNLFGLGGGSVISSSK

SEQ ID NO: 927 - DNA, 895 bp, Corynebacterium glutamicum
  CDS (101)..(895): FRXA01991
tccggaggtggatttgaggatttcgacgttttctcggaagttcctcgggtagaggaaacatcgacgaggatcagctattcttacaaaaattcatttgaatatgacgaatttgttgccgcatttcccgagtaccgacgtagctgcgtgggaaccaaccgttgtgtattcagcggataagaccacagcaacagcgacgtttaagaatattccttcggatatttcctttagttggactggtattgaagcactagagccatttagccctggtaaaaccttcgaacataaggtgcaaggttctgttggtgaaccagcgggggcgttcactagggataactatttcactgagggtgagctctacaaacatcgccacgcagacgatctgctttccggtgatggcttgtttggccccaacatcaccgatggcgatggcaacctcccctctgttgatgacggcaaggacggtgacgatgggtctgatggctcagacggccgagacggtgttgtcgccattgatgttgttgacaatgctgacggcacggtgactgtcaccttgtccgatggcactacgtttactcttgatgctggtcaagacggcaaagatggtcttgacgggcttgatggtactggcctaacgctggaatctgctacccctgatgaggacggcaacatcacctatgttctttctgacggtactgagttcactgtgcgcaacggtgttgatgggtcagacggtaaggacggcaaagatggagtcaatggcacagatggcgtagacgggtcagacggtaaaggtctggtagaggtgtcccgagttaccaacgacaacggctcagtgaccattacctacgaggacggttcacagatcaccacgaagccaacgccgacaaactggctg

SEQ ID NO: 928 - protein, 265 aa, Corynebacterium glutamicum
MTNLLPHFPSTDVAAWEPTVVYSADKTTATATFKNIPSDISFSWTGIEALEPFSPGKTFEHKVQGSVGEPAGAFTRDNYFTEGELYKHRHADDLLSGDGLFGPNITDGDGNLPSVDDGKDGDDGSDGSDGRDGVVAIDVVDNADGTVTVTLSDGTTFTLDAGQDGKDGLDGLDGTGLTLESATPDEDGNITYVLSDGTEFTVRNGVDGSDGKDGKDGVNGTDGVDGSDGKGLVEVSRVTNDNGSVTITYEDGSQITTKPTPTNWL

SEQ ID NO: 929 - DNA, 660 bp, Corynebacterium glutamicum
  CDS (101)..(637): RXN01996
ctagtatagaacggaacacggcagcgacacaaactgcacagatgcaagagtgtcggtaccgttaaaaacgaaacacactttcaccgaaaaggacttcccaatgagcaagttgactggcacctggaccctcgaccctgcacacaccgaaatcaagttcgtggctcgccacgcaatggttaccaaggttcgcggtgaattcaccgagtacaccgactccattgtcgtagatgctgaaaacccagagaactcctctgcaaaggttgttatcaagaccgcttccgttaccaccggcaacgcagaccgcgatgcacacgttaagggcgacgacttcttcgcagtagacaagttccctgaaatgactttcgaagctacttcctttgttatcaagaacgaaaacgaaggcaccgttaccggcgacctcacaattcgtgacaccaccaagtccgtcaccctggacgttgaggttggtggcgttgctgaggatccattcggcaacacccgccttggcttcgaagcctccaccgaaatcaaccgcaaggacttcggcgtagatttccaggctccactctccaccggtggcgttctggtttctgagaagatcaagatcgagatcgacggctccgcaatcaaggctgcttaagcgcccacaaacaaaaagcc

SEQ ID NO: 930 - protein, 179 aa, Corynebacterium glutamicum
MSKLTGTWTLDPAHTEIKFVARHAMVTKVRGEFTEYTDSIVVDAENPENSSAKVVIKTASVTTGNADRDAHVKGDDFFAVDKFPEMTFEATSFVIKNENEGTVTGDLTIRDTTKSVTLDVEVGGVAEDPFGNTRLGFEASTEINRKDFGVDFQAPLSTGGVLVSEKIKIEIDGSAIKAA

SEQ ID NO: 931 - DNA, 647 bp, Corynebacterium glutamicum
  CDS (88)..(624): FRXA01996
gaacacggcagcgacacaaactgcacagatgcaagagtgtcggtaccgttaaaaacgaaacacactttcaccgaaaaggacttcccaatgagcaagttgactggcacctggaccctcgaccctgcacacaccgaaatcaagttcgtggctcgccacgcaatggttaccaaggttcgcggtgaattcaccgagtacaccgactccattgtcgtagatgctgaaaacccagagaactcctctgcaaaggttgttatcaagaccgcttccgttaccaccggcaacgcagaccgcgatgcacacgttaagggcgacgacttcttcgcagtagacaagttccctgaaatgactttcgaagctacttcctttgttatcaagaacgaaaacgaaggcaccgttaccggcgacctcacaattcgtgacaccaccaagtccgtcaccctggacgttgaggttggtggcgttgctgaggatccattcggcaacacccgccttggcttcgaagcctccaccgaaatcaaccgcaaggacttcggcgtagatttccaggctccactctccaccggtggcgttctggtttctgagaagatcaagatcgagatcgacggctccgcaatcaaggctgcttaagcgcccacaaacaaaaagcc

SEQ ID NO: 932 - protein, 179 aa, Corynebacterium glutamicum; identical to SEQ ID NO: 930

SEQ ID NO: 933 - DNA, 756 bp, Corynebacterium glutamicum
  CDS (101)..(733): RXN02007
tggaagccccagccgcggtccaagagacagttgcgccgacgtccaccccttaggacgctgattacagacgtgtcccatttctttactactattggaaattatgagttcagacgcagaaaaggcatccgtggagctttccgaaaaatttcacccagaacgcacccatattttgggcgccgttgtttttggcctgatctcattattagtcatcggcgcagcccctcagtacctgttttggctgctcgcgctccctgtcatcttcggttactgggttctaaaatcatccacgatcgttgatgaacagggcatcaccgcaaactacgccttcaagggcaaaaaggttgtggcctgggaagacctcgcaggaatcggattcaagggtgcccgcactttcgctcgcaccacctccgatgcagaagtcaccctcccgggcgtcaccttcaactcccttccccgccttgaagctgcttcccacggccgcatccccgatgcgatcaccgcaagcaaggaagcagccgacggcaaggttgtagtcgttcaagaagacggctactccgtgatgatgtccaaggaagagtacttggagcgccaaaaggcactgggcaagccagttcagttgaacttcgatgacgacaccgatgggaatacaacacaaacagaaagcgttgaatcccaagagaccggacaagccgcgtctgaaacctcacatcgtgataaccctgcgtcacagcactagagtgtaataagccgtccgaa

SEQ ID NO: 934 - protein, 211 aa, Corynebacterium glutamicum
MSSDAEKASVELSEKFHPERTHILGAVVFGLISLLVIGAAPQYLFWLLALPVIFGYWVLKSSTIVDEQGITANYAFKGKKVVAWEDLAGIGFKGARTFARTTSDAEVTLPGVTFNSLPRLEAASHGRIPDAITASKEAADGKVVVVQEDGYSVMMSKEEYLERQKALGKPVQLNFDDDTDGNTTQTESVESQETGQAASETSHRDNPASQH

SEQ ID NO: 935 - DNA, 452 bp, Corynebacterium glutamicum
  CDS (1)..(429): FRXA02007
ggcatcaccgcaaactacgccttcaagggcaaaaaggttgtggcttggaaagacctcgcaggaatcggattcaagggtgcccgcactttcgctcgccccacctccgatgcagaagtcaccctcccgggcgtcaccttcaactcccttccccgccttgaagctgcttcccacggccgcatccccgatgcgatcaccgcaagcaaggaagcagccgacggcaaggttgtagtcgttcaagaagacggctactccgtgatgatgtccaaggaagagtacttggagcgccaaaaggcactgggcaagccagttcagttgaacttcgatgacgacaccgatgggaatacaacacaaacagaaagcgttgaatcccaagagaccggacaagccgcgtctgaaacctcacatcgtgataaccctgcgtcacagcactagagtgtaataagccgtccgaa

SEQ ID NO: 936 - protein, 143 aa, Corynebacterium glutamicum
GITANYAFKGKKVVAWKDLAGIGFKGARTFARPTSDAEVTLPGVTFNSLPRLEAASHGRIPDAITASKEAADGKVVVVQEDGYSVMMSKEEYLERQKALGKPVQLNFDDDTDGNTTQTESVESQETGQAASETSHRDNPASQH

SEQ ID NO: 937 - DNA, 630 bp, Corynebacterium glutamicum
  CDS (101)..(607): RXN02014
agaggacaacaacatgagagcagacgcactaaaacgccgcgaacacatcataaccacaacctgcaatctctaccgcacacaccatcacgattcgctcaccatggaaaacattgcagaacaggcaggagtgggtgttgcaactttataccgaaacttccccgatcgcttcacactggacatggcatgcgcccaataccttttcaacgtggtgatctccctccaactccaagccatcagcaccttccccaccgacccagaaggcgtgtggacctccttcaaccaactacttttcgaccgcggcctaggctccctcgtcccagcacttgccccagaatccttagacgacctccccgacgaggtctccgccctgcgtcgcaccacagagaaaaacaccacaacactcatcaacctagccaagcagcacggactcgtacaccacgacatcgcgccgggcacctacatcgtcggtttgatcaccatttcccgcccacctatcaccgcgctggcgacaatttcagaaaactcccacaaagcactgcttggcctttatttgtccggtcttaaacacggcatgatggctaacatcggagaacatgacggaaagtcctgatctagcagtttcctttttag

SEQ ID NO: 938 - protein, 169 aa, Corynebacterium glutamicum
MENIAEQAGVGVATLYRNFPDRFTLDMACAQYLFNVVISLQLQAISTFPTDPEGVWTSFNQLLFDRGLGSLVPALAPESLDDLPDEVSALRRTTEKNTTTLINLAKQHGLVHHDIAPGTYIVGLITISRPPITALATISENSHKALLGLYLSGLKHGMMANIGEHDGKS

SEQ ID NO: 939 - DNA, 419 bp, Corynebacterium glutamicum
  CDS (1)..(396): FRXA02014
atctccctccaactccaagccatcagcaccttccccaccgacccagaaggcgtgtggacctccttcaaccaactacttttcgaccgcggcctaggctccctcgtcccagcacttgccccagaatccttagacgacctccccgacgaggtctccgccctgcgtcgcaccacagagaaaaacaccacaacactcatcaacctagccaagcagcacggactcgtacaccacgacatcgcgccgggcacctacatcgtcggtttgatcaccatttcccgcccacctatcaccgcgctggcgacaatttcagaaaactcccacaaagcactgcttggcctttatttgtccggtcttaaacacggcatgatggctaacatcggagaacatgacggaaagtcctgatctagcagtttcctttttag

SEQ ID NO: 940 - protein, 132 aa, Corynebacterium glutamicum
ISLQLQAISTFPTDPEGVWTSFNQLLFDRGLGSLVPALAPESLDDLPDEVSALRRTTEKNTTTLINLAKQHGLVHHDIAPGTYIVGLITISRPPITALATISENSHKALLGLYLSGLKHGMMANIGEHDGKS

SEQ ID NO: 941 - DNA, 524 bp, Corynebacterium glutamicum
  CDS (1)..(501): RXN02019
gaaattcctgctggcaccaaggttgaggcctctgaccttggacttcaggcaatccctacttccctactgcccagcacctcctacgattcgattgacgatgtagttgggctcgttgcggcctccacattaagttccggggaaatagccacaaagcctcgattcgtgggcaccgaattgataaactccattgcgacaaacgtcactgatagctctttggtggaagaaattaacatggttccactcagtttggctgaaccttccgtcatccccctactgcagcatggggacaccatttcggttgtttcccaagacccagacaccggtctcccagagaacattgctgcaggtggaacagtaattctggcgggtggtacagacccctcaaccatcttgattgcgcttccacaatcaatcgctgaaaaggttgcagcacaatcgctcaatacccctctggcggtagtcctgaccggagacagagcagataattacacaaccgaagaatagttccctattcaaaaaaaagg

SEQ ID NO: 942 - protein, 167 aa, Corynebacterium glutamicum
EIPAGTKVEASDLGLQAIPTSLLPSTSYDSIDDVVGLVAASTLSSGEIATKPRFVGTELINSIATNVTDSSLVEEINMVPLSLAEPSVIPLLQHGDTISVVSQDPDTGLPENIAAGGTVILAGGTDPSTILIALPQSIAEKVAAQSLNTPLAVVLTGDRADNYTTEE

SEQ ID NO: 943 - DNA, 515 bp, Corynebacterium glutamicum
  CDS (1)..(492): FRXA02019
gctggcaccaaggttgaggcctctgaccttggacttcaggcaatccctacttccctactgcccagcacctcctacgattcgattgacgatgtagttgggctcgttgcggcctccacattaagttccggggaaatagccacaaagcctcgattcgtgggcaccgaattgataaactccattgcgacaaacgtcactgatagctctttggtggaagaaattaacatggttccactcagtttggctgaaccttccgtcatccccctactgcagcatggggacaccatttcggttgtttcccaagacccagacaccggtctcccagagaacattgctgcaggtggaacagtaattctggcgggtggtacagacccctcaaccatcttgattgcgcttccacaatcaatcgctgaaaaggttgcagcacaatcgctcaatacccctctggcggtagtcctgaccggagacagagcaaataattacacaaccgaagaatagttccctattcaaaaaaaagg

SEQ ID NO: 944 - protein, 164 aa, Corynebacterium glutamicum
AGTKVEASDLGLQAIPTSLLPSTSYDSIDDVVGLVAASTLSSGEIATKPRFVGTELINSIATNVTDSSLVEEINMVPLSLAEPSVIPLLQHGDTISVVSQDPDTGLPENIAAGGTVILAGGTDPSTILIALPQSIAEKVAAQSLNTPLAVVLTGDRANNYTTEE

SEQ ID NO: 945 - DNA, 891 bp, Corynebacterium glutamicum
  CDS (101)..(868): RXN02023
gatgtggcagcaattttgaagcagtacctgagcgagtaaccgcattcggggttatcgtgggacttccgaaatgtaactagagactagaggaggaaacacgatggctcctaaacaaactcccagcccagagaagaatcgaaacctggtgggaccagttctgcaacgtcggcagacagagggtacttttgatcaacgcttgctagaaatgcgcgctgatcacaattggaagcacgccgatccatggcgtgtactgcgtattcagtctgagtttgtggcgggttttgatgccctccacgagatgccaaaggccgtaaccgtctttggttccgcacgcattaaagaggatcacccgtactacaaggcgggtgtagaacttggtgaaaagctcgttgcagcggactacgcagttgtcaccggtggcggtccaggtctgatggaagcccccaataagggggcaagcgaggccaatggtttatcagttggtctgggcattgagttgccacatgaacagcatctgaacccttatgtggatttgggtctgaacttccggtacttcttcgcacgcaagaccatgttcctgaaatactcccaggcttttgtgtgtctgcctggtggtttcggcacgctcgatgagcttttcgaggtcctctgcatggtacaaaccggcaaggtacccaactttcccatcgtgctgatcggcactgagttctgggcaggtttggtggattggatccgtcaccgcctggtagaggaaggcatgatcgatgagaaggatgttgaccggatgttggtcactgatgacctggatcaggccgtcaaattcatcgtcgatgcacacgctggattggacgtagcgcgtctccacaattaagcagtggctacattaggtgt

SEQ ID NO: 946 - protein, 256 aa, Corynebacterium glutamicum
MAPKQTPSPEKNRNLVGPVLQRRQTEGTFDQRLLEMRADHNWKHADPWRVLRIQSEFVAGFDALHEMPKAVTVFGSARIKEDHPYYKAGVELGEKLVAADYAVVTGGGPGLMEAPNKGASEANGLSVGLGIELPHEQHLNPYVDLGLNFRYFFARKTMFLKYSQAFVCLPGGFGTLDELFEVLCMVQTGKVPNFPIVLIGTEFWAGLVDWIRHRLVEEGMIDEKDVDRMLVTDDLDQAVKFIVDAHAGLDVARLHN

SEQ ID NO: 947 - DNA, 891 bp, Corynebacterium glutamicum
  CDS (101)..(868): FRXA02023
gatgtggcagcaattttgaagcagtacctgagcgagtaaccgcattcggggttatcgtgggacttccgaaatgtaactagagactagaggaggaaacacgatggctcctaaacaaactcccagcccagagaagaatcgaaacctggtgggaccagttctgcaacgtcggcagacagagggtacttttgatcaacgcttgctagaaatgcgcgctgatcacaattggaagcacgccgatccatggcgtgtactgcgtattcagtctgagtttgtggcgggttttgatgccctccacgagatgccaaaggccgtaaccgtctttggttccgcacgcattaaagaggatcacccgtactacaaggcgggtgtagaacttggtgaaaagctcgttgctgctgactacgcagttgtcaccggtggcggtccaggtctgatggaagcccccaataagggggcaagcgaggccaatggtttatcagttggtctgggcattgagttgccacatgaacagcacctgaacccttatgtggatttgggtctgaacttccggtacttcttcgcacgcaagaccatgttcctgaaatactcccaggcttttgtgtgtctgcctggcggtttcggcacgctcgatgagcttttcgaggtcctctgcatggtacaaaccggcaaggtaaccaactttcccatcgtgctgatcggcactgagttctgggcaggtttggtggattggatccgtcaccgcctggtagaggaaggcatgatcgatgagaaggatgttgaccggatgttggtcactgatgacctggatcaggccgtcaaattcatcgtcgatgcacacgctggattggacgtagcgcgtctccacaattaagcagtggctacattaggtgt

SEQ ID NO: 948 - protein, 256 aa, Corynebacterium glutamicum
MAPKQTPSPEKNRNLVGPVLQRRQTEGTFDQRLLEMRADHNWKHADPWRVLRIQSEFVAGFDALHEMPKAVTVFGSARIKEDHPYYKAGVELGEKLVAADYAVVTGGGPGLMEAPNKGASEANGLSVGLGIELPHEQHLNPYVDLGLNFRYFFARKTMFLKYSQAFVCLPGGFGTLDELFEVLCMVQTGKVTNFPIVLIGTEFWAGLVDWIRHRLVEEGMIDEKDVDRMLVTDDLDQAVKFIVDAHAGLDVARLHN

SEQ ID NO: 949 - DNA, 693 bp, Corynebacterium glutamicum
  CDS (101)..(670): RXN02032
cttaaaaaggggctttatcggttcaggcgagcgagaccttcggcgttcacacttcgccggggtctattttttatgcccaggcacggctcataggagaaccatgccctttctacaaatctctctgctttccatcggtgtcgccgccgatgcgtttgcttgttccgttgtccgcggcaccgccattcaagtcaaccttttcaaacgcgcacttgttctcgcgggcatctttggtgtcttccaagcggcaatgcctttaatcggctggttcattggccgtttctttgctggaatcaccttcatcgctgaaattgatcactggatcgcttttgcactattgggtattgtcggcaccaaaatgatctgggatgccttccaacctgaagatgatgaaaccattgtcgatgacggccgcgttcaatttagaccagcaattatcctggggctagccaccagcattgacgcattagccgtaggcatgggcctggcattcgtggaagtttccatcctcaaagtggcactgtccatgggcagcatcaccttcgcactttcgcttgctggcgcctggatcggacaccatggtggaggaaagtttggcaagtgggctacgattcttggcggaataatcttgatcggaatcggcgcaaacatcgtctacgaacacctcagcgcgtaaccctcggcgcattatcctca

SEQ ID NO: 950 - protein, 190 aa, Corynebacterium glutamicum
MPFLQISLLSIGVAADAFACSVVRGTAIQVNLFKRALVLAGIFGVFQAAMPLIGWFIGRFFAGITFIAEIDHWIAFALLGIVGTKMIWDAFQPEDDETIVDDGRVQFRPAIILGLATSIDALAVGMGLAFVEVSILKVALSMGSITFALSLAGAWIGHHGGGKFGKWATILGGIILIGIGANIVYEHLSA

SEQ ID NO: 951 - DNA, 693 bp, Corynebacterium glutamicum; identical to SEQ ID NO: 949
  CDS (101)..(670): FRXA02032

SEQ ID NO: 952 - protein, 190 aa, Corynebacterium glutamicum; identical to SEQ ID NO: 950

SEQ ID NO: 953 - DNA, 863 bp, Corynebacterium glutamicum
  CDS (1)..(840): RXN02039
aaggcgtcgataagcaatttaagcttttggacgtccacctccaccaccgcacccctttggctcgtgggcacgcttgtgtggctggcggtgcaggcggtgatgcatgacggcgagctttaccatgtggaagttcccacgattgcgctggtcatcggctttggcgcgcagcttctgatcggtgtgatgagttatctactgccgtcgacgatgggtggcggcgcgagcgcggtgcggactggaacgcacattttaaacactgcggggctgtttaggtggacgctgatcaacggtggcctggcgatttggctgctcaccgacaattcgtggctgcgcgtcgtggtgtctctgctgagtatcggagcgttggcagtttttgtcattctgctgcccaaggctgtgcgggcgcagcgcggagtgatcaccaaaaagcgcgaaccaattactccgccggaggagcctcgactcaatcaaattaccgcgggaatctctgtgcttgccctgattttggcagcattcggtgggctcaaccccggtgttgcgccggtggcaagctcaaatgaagacgtctatgctgtgaccattaccgcaggtgacatggtgtttatccctgatgtgattgaagtgcctgctggtaaatcactcgaagtcacgatgctcaacgaagacgacatggtgcacgatctgaaatttgccaacggtgtgcaaaccggacgtgtggcgccaggtgatgaaattacggtgaccgtcggcgatatttccgaagacatggacggctggtgcaccatcgctgggcaccgcgcgcaaggaatggatctggaagtaaaggttgcggctccgaattaaccaagggctgctgaaaaact

SEQ ID NO: 954 - protein, 280 aa, Corynebacterium glutamicum
KASISNLSFWTSTSTTAPLWLVGTLVWLAVQAVMHDGELYHVEVPTIALVIGFGAQLLIGVMSYLLPSTMGGGASAVRTGTHILNTAGLFRWTLINGGLAIWLLTDNSWLRVVVSLLSIGALAVFVILLPKAVRAQRGVITKKREPITPPEEPRLNQITAGISVLALILAAFGGLNPGVAPVASSNEDVYAVTITAGDMVFIPDVIEVPAGKSLEVTMLNEDDMVHDLKFANGVQTGRVAPGDEITVTVGDISEDMDGWCTIAGHRAQGMDLEVKVAAPN

SEQ ID NO: 955 - DNA, 833 bp, Corynebacterium glutamicum
  CDS (1)..(810): FRXA02039
acgtccacctccaccaccgcacccctttggctcgtgggcacgcttgtgtggctggcggtgcaggcggtgatgcatgacggcgagctttaccatgtggaagttcccacgattgcgctggtcatcggctttggcgcgcagcttctgatcggtgtgatgagttatctactgccgtcgacgatgggtggcggcgcgagcgcggtgcggactggaacgcacattttaaacactgcggggctgtttaggtggacgctgatcaacggtggcctggcgatttggctgctcaccgacaattcgtggctgcgcgtcgtggtgtctctgctgagtatcggagcgttggcagtttttgtcattctgctgcccaaggctgtgcgggcgcagcgcggagtgatcaccaaaaagcgcgaaccaattactccgccggaggagcctcgactcaatcaaattaccgcgggaatctctgtgcttgccctgattttggcagcattcggtgggctcaaccccggtgttgcgccggtggcaagctcaaatgaagacgtctatgctgtgaccattaccgcaggtgacatggtgtttatccctgatgtgattgaagtgcctgctggtaaatcactcgaagtcacgatgctcaacgaagacgacatggtgcacgatctgaaatttgccaacggtgtgcaaaccggacgtgtggcgccaggtgatgaaattacggtgaccgtcggcgatatttccgaagacatggacggctggtgcaccatcgctgggcaccgcgcgcaaggaatggatctggaagtaaaggttgcggctccgaattaaccaagggctgctgaaaaact

SEQ ID NO: 956 - protein, 270 aa, Corynebacterium glutamicum
TSTSTTAPLWLVGTLVWLAVQAVMHDGELYHVEVPTIALVIGFGAQLLIGVMSYLLPSTMGGGASAVRTGTHILNTAGLFRWTLINGGLAIWLLTDNSWLRVVVSLLSIGALAVFVILLPKAVRAQRGVITKKREPITPPEEPRLNQITAGISVLALILAAFGGLNPGVAPVASSNEDVYAVTITAGDMVFIPDVIEVPAGKSLEVTMLNEDDMVHDLKFANGVQTGRVAPGDEITVTVGDISEDMDGWCTIAGHRAQGMDLEVKVAAPN

SEQ ID NO: 957 - DNA, 1506 bp, Corynebacterium glutamicum
  CDS (101)..(1483): RXN02044
ttactttcttaagtaatttaacgaatttggtctcgaaactgacctaaaaccccatgttgctagttggtgcaaaccaataatagctatagccccaatacaaatggtcaccccaatcatggggaattcgaactctatcctgggcatttaccgtcagaaaatccaaaatcgacatttggtttctacgctttttagggcatacttcccaatcgtgaccgagctgattattttattgattgttatcgtgacggcgctcgccttcgatttcacaaacggattccacgacaccggcaatgcgatggccacatccattgccacaggcgctctaaaacctaaagtcgccgtggcactatccgcctcactgaaccttgttggcgcattcctctctgtagaagttgcgacaactgttgccaaaggcgttgttgacctcgaccaattcgacctaagcaatgcctgggattcccaccagctcctgcttgtcgtcttcgccggcctcattggcgccatcgtctggaaccttctgacctggctgctaggcattccttccagctcctctcacgcacttttcggtggcctcattggcgccgcaattgcttcactcggtttcggcggagtggtgtgggaaggtgtcttgtccaagatgatcatcccagcattggctgcaccagttgttgcaggtctcgtggccgccatcggcactttcgccgtgtacagcatcacaaaggcagttggagacaacgagaagaaccgttacttccgctggggtcagatcggctccgcttccttggtttccctggcacacggcaccaacgatgcccagaagaccatgggcgttatcttcctttccctggttgccaccggtcacctgggaactgacgctgacatcccattctgggtcaaggctacatgtgcattggcaatcgcaatcggtacctacttgggtggttggcgcgttatccgcacactgggcaaaggcttggttgagattgattcccctcagggcatggcagcagaaacttcttctgcagcaatcattttgacttcttcccacttcggtatggcactgtccaccactcacgttgctactggctccatcatgggtaccggcattggacgtaaaggggcgaaggttcgttggtccgtcgcaggacgcatggcaatggcctgggttatcaccctccctgcctccgcgatcgttggcgttttctgctggtgggtagctcacggaattggtcttatcagctcagacctcctcggagtcctcgttgcattcgccattctggtcattctgtctggctacatttacgcccgttcccgtcgcgtgcctgttgatccaagcaacgtcaacgctgactggaatgaagaatcaaacagcgtggaacctgcaacaccttccgccccggctgcttctgagattacagaagctcctgccgctccagccgctcaagccgttcaagatctcaacaacgagaatgaggtaaccaagtaatgaacttcgctactattttc

SEQ ID NO: 958 - protein, 461 aa, Corynebacterium glutamicum
MVTPIMGNSNSILGIYRQKIQNRHLVSTLFRAYFPIVTELIILLIVIVTALAFDFTNGFHDTGNAMATSIATGALKPKVAVALSASLNLVGAFLSVEVATTVAKGVVDLDQFDLSNAWDSHQLLLVVFAGLIGAIVWNLLTWLLGIPSSSSHALFGGLIGAAIASLGFGGVVWEGVLSKMIIPALAAPVVAGLVAAIGTFAVYSITKAVGDNEKNRYFRWGQIGSASLVSLAHGTNDAQKTMGVIFLSLVATGHLGTDADIPFWVKATCALAIAIGTYLGGWRVIRTLGKGLVEIDSPQGMAAETSSAAIILTSSHFGMALSTTHVATGSIMGTGIGRKGAKVRWSVAGRMAMAWVITLPASAIVGVFCWWVAHGIGLISSDLLGVLVAFAILVILSGYIYARSRRVPVDPSNVNADWNEESNSVEPATPSAPAASEITEAPAAPAAQAVQDLNNENEVTK

SEQ ID NO: 959 - DNA, 384 bp, Corynebacterium glutamicum
  CDS (101)..(361): RXN02045
caccttccgccccggctgcttctgagattacagaagctcctgccgctccagccgctcaagccgttcaagatctcaacaacgagaatgaggtaaccaagtaatgaacttcgctactattttcggaagcatctttgaggtcaccctcgtgggcattttgctcggcgcaggccttccagccctttttgcattaggaatccgctttgctcacagcccttcttccaacggcaccaacgctcttggaaaaattgcttcaaccatctgctttgccatcattgcggttgctatcatcgctggcattctctgggtcaccaaagcaacgatctaccagtactctggtttcgacattttcggcactgaaggctaaaagcaccagctgcgaataac

SEQ ID NO: 960 - protein, 87 aa, Corynebacterium glutamicum
MNFATIFGSIFEVTLVGILLGAGLPALFALGIRFAHSPSSNGTNALGKIASTICFAIIAVAIIAGILWVTKATIYQYSGFDIFGTEG

SEQ ID NO: 961 - DNA, 384 bp, Corynebacterium glutamicum; identical to SEQ ID NO: 959
  CDS (101)..(361): FRXA02045

SEQ ID NO: 962 - protein, 87 aa, Corynebacterium glutamicum; identical to SEQ ID NO: 960

SEQ ID NO: 963 - DNA, 732 bp, Corynebacterium glutamicum
  CDS (101)..(709): RXN02049
tctacgcagtctccacagaccacgcagctttagatgcagtgtggcagtcctggcttcgcgatctggagttgccggagtttccttctggtggtttggactagtgcgctatctgacgctggccacaatcatcgcaggtctctccgggttcgtcgtcatcatcatcgctgcctgggcccttggtgattccagccaactttccgaagaattcaccgcctactggggtctgttctttgcaggaaccggagtgctgactgggttgacgcaggagacgacccgcgcggtgacggccggttctcgtggtggttctcgtggtgggcgtgctggttctgttgttggatttaggccgtttttgtttagcttcgtggttgcggcgatagtgctcgtggtgcttggcgcttcggcgccgctgtggatcggccagcttttaagtaatttgcaaggtgttggtgttgggctacttgctgtaggtcttgctagctacgcgatccaagcgacaatctccggcatttttgtccggctgccaattgtggaaagagtatgcctcgctgatttctttggacaccggcgtgcgcatggttttaactgttgccgcctggttgctgggttatcaattgctggcgttcttgatcatcaccgttgtgggatcaatatcctggctggtcatcgtgctgtgcttcggttcggtgcgttccgttttgggatcggttgctgatgtttcacggggcgttttca

SEQ ID NO: 964 - protein, 203 aa, Corynebacterium glutamicum
VRYLTLATIIAGLSGFVVIIIAAWALGDSSQLSEEFTAYWGLFFAGTGVLTGLTQETTRAVTAGSRGGSRGGRAGSVVGFRPFLFSFVVAAIVLVVLGASAPLWIGQLLSNLQGVGVGLLAVGLASYAIQATISGIFVRLPIVERVCLADFFGHRRAHGFNCCRLVAGLSIAGVLDHHRCGINILAGHRAVLRFGAFRFGIGC

SEQ ID NO: 965 - DNA, 570 bp, Corynebacterium glutamicum
  CDS (101)..(547): FRXA02049
tctacgcagtctccacagaccacgcagctttagatgcagtgtggcagtcctggcttcgcgatctggagttgccggagtttccttctggtggtttggactagtgcgctatctgacgctggccacaatcatcgcaggtctctccgggttcgtcgtcatcatcatcgctgcctgggcccttggtgattccagccaactttccgaagaattcaccgcctactggggtctgttctttgcaggaaccggagtgctgactgggttgacgcaggagacgacccgcgcggtgacggccggttctcgtggtggttctcgtggtgggcgtgctggttctgttgttggatttaggccgtttttgtttagcttcgtggttgcggcgatagtgctcgtggtgcttggcgcttcggcgccgctgtggatcggccagcttttaagtaatttgcaaggtgttggtgttgggctacttgctgtaggtcttgctagctacgcgatccaagcgacaatctccggcatttttgtccggctgccaattgtggaaaagagtatgcctcgctgatttctttggacaccggcgtg

SEQ ID NO: 966 - protein, 149 aa, Corynebacterium glutamicum
VRYLTLATIIAGLSGFVVIIIAAWALGDSSQLSEEFTAYWGLFFAGTGVLTGLTQETTRAVTAGSRGGSRGGRAGSVVGFRPFLFSFVVAAIVLVVLGASAPLWIGQLLSNLQGVGVGLLAVGLASYAIQATISGIFVRLPIVEKSMPR

SEQ ID NO: 967 - DNA, 918 bp, Corynebacterium glutamicum
  CDS (101)..(895): RXN02050
ctacttgctgtaggtcttgctagctacgcgatccaagcgacaatctccggcatttttgtccggctgccaattgtggaaagagtatgcctcgctgatttctttggacaccggcgtgcgcatggttttaactgttgccgcctggttgctgggttatcaattgctggcgttcttgatcatcaccgttgtgggatcaatatcctggctggtcatcgtgctgtgcttcggttcggtgcgttccgttttgggatcggttgctgatgtttcacggggcgttttcatccgacaggctctgcttgcgatggcagcatccggcgccacggcagtgctgattactggtttcccgaccctgctgaaattcacgaacccttcagcggttgcaggaggggtttcgatggccgctgtttcctacgccgtcatcctgacccgcgctcccctgctggttccgctgcagcaattccaatcggcgatcatcgttcgttttgtcaaaggtacgtccggtccattgaaaactttggcgggtccgttggcaattgtgtgggcagtcggacttgttggagctggtcttgcatggttagttggcccatggatcctggacgttgtactccaaaaggaactcttcgcggtccctggctggctactcgcgatgctcaccttaggcgccaccaccaccgcttcattgatggtgtccggctgcgcggcgatcgcctttgaacgtcacgggatctatctcaccggatgggttgttgccactgttgttgccgtcggattcttgctgggaccttttgatttgggcgtcgctgctggccttgcgctcattgttggcccactctgcggtttgctggtacacatgggagcgtttgttggtggggatcggaatcgggttttgactgcgggatagtttggtttgattgggggatt

SEQ ID NO: 968 - protein, 265 aa, Corynebacterium glutamicum
LDTGVRMVLTVAAWLLGYQLLAFLIITVVGSISWLVIVLCFGSVRSVLGSVADVSRGVFIRQALLAMAASGATAVLITGFPTLLKFTNPSAVAGGVSMAAVSYAVILTRAPLLVPLQQFQSAIIVRFVKGTSGPLKTLAGPLAIVWAVGLVGAGLAWLVGPWILDVVLQKELFAVPGWLLAMLTLGATTTASLMVSGCAAIAFERHGIYLTGWVVATVVAVGFLLGPFDLGVAAGLALIVGPLCGLLVHMGAFVGGDRNRVLTAG

SEQ ID NO: 969 - DNA, 495 bp, Corynebacterium glutamicum
  CDS (101)..(472): FRXA02050
cgcgctcccctgctggttccgctgcagcaattccaatcggcgatcatcgttcgttttgtcaaaggtaccgtccggtccattgaaaactttggcgggtccgttggcaattgtgtgggcagtcggacttgttggagctggtcttgcatggttagttggcccatggatcctggacgttgtactccaaaaggaactcttcgcggtccctggctggctactcgcgatgctcaccttaggcgccaccaccaccgcttcattgatggtgtccggctgcgcggcgatcgcctttgaacgtcacgggatctatctcaccggatgggttgttgccactgttgttgccgtcggattcttgctgggaccttttgatttgggcgtcgctgctggccttgcgctcattgttggcccactctgcggtttgctggtacacatgggagcgtttgttggtggggatcggaatcgggttttgactgcgggatagtttggtttgattgggggatt

SEQ ID NO: 970 - protein, 124 aa, Corynebacterium glutamicum
LAIVWAVGLVGAGLAWLVGPWILDVVLQKELFAVPGWLLAMLTLGATTTASLMVSGCAAIAFERHGIYLTGWVVATVVAVGFLLGPFDLGVAAGLALIVGPLCGLLVHMGAFVGGDRNRVLTAG

SEQ ID NO: 971 - DNA, 618 bp, Corynebacterium glutamicum
  CDS (101)..(595): RXN02059
tcgggaaattccactcatgaacgcctagtctacgggaaccatttcaccagcgtgtacgttgtaaatgtgaactgaaaaagtgaaaaggaagatgataaagatgactcaaccacggcccgatgccgcatctgtgtcgctggaaaagaagcgcccagaaggatggccagtgggaagctttgaaacatacccagaagcccaagcagcagtggatttgctcagtgataatgcattccccgtcaccgaattgaccattgttggtgtggacctgattgaagtggaacgcgttacaggtcgtctcacgtggggtcgtgtgattgccggaggaatggcatctggcgcatggttgggtctgttctttggcattgtcatggccttgatgtctggattctggttctcttccatcgcagcgggaataggtatgggtttggtgtttggcattgtcggtgcagcagttccttatgctgcttccaaaggcaagcgggactttacctcttcaactcaaattgtggcggggcgctatgatgtgatttgttccccagaacgtgctcgggaagctcgagacatgattgccctgaaaactcgagatctccgccaataagttaaactaacgcctatgaa

SEQ ID NO: 972 - protein, 165 aa, Corynebacterium glutamicum
MTQPRPDAASVSLEKKRPEGWPVGSFETYPEAQAAVDLLSDNAFPVTELTIVGVDLIEVERVTGRLTWGRVIAGGMASGAWLGLFFGIVMALMSGFWFSSIAAGIGMGLVFGIVGAAVPYAASKGKRDFTSSTQIVAGRYDVICSPERAREARDMIALKTRDLRQ

SEQ ID NO: 973 - DNA, 618 bp, Corynebacterium glutamicum; identical to SEQ ID NO: 971
  CDS (101)..(595): FRXA02059

SEQ ID NO: 974 - protein, 165 aa, Corynebacterium glutamicum; identical to SEQ ID NO: 972

SEQ ID NO: 975 - DNA, 615 bp, Corynebacterium glutamicum
  CDS (101)..(592): RXN02066
ggaacttatcacaggcgacatccgttttgagtagtaggtatcttggataagaagttacccacatccttgaaagtcgagacacaggaggtcatcggaagatatgttcaattccgacaccaccgcgaatctccaagctaaaagtcgagatcgtgcaggatctaaagcaaagcgcagcaggccaagttttgattcagtagcgcgggatgttttggatgttcgaacaaaaacagcacaagttaaaaacaaggctaaagagttttcctctgttgatcacctttcagcagacgccgcagccatgtttgtagacaatgaactgtcccgtggcgccatgcatcgcgccaggctgcacattgtgcactgcgctgaatgtagggaagagattaaccgtcagcgggaaaccgttgattatctccgctcagagtgcaaaaacgaagaagtgtccgccccaatggacctcaaagcacggcttgccagcctcgccactgagtgcatgcctggccctggcgcagagaatttagcaatgcagcgcccagagtcttttgtggctaaagttgagtccgtagtgcgcgcagttcgtaagaaccaaggccgctaatttttaatccttatttacat

SEQ ID NO: 976 - protein, 164 aa, Corynebacterium glutamicum
MFNSDTTANLQAKSRDRAGSKAKRSRPSFDSVARDVLDVRTKTAQVKNKAKEFSSVDHLSADAAAMFVDNELSRGAMHRARLHIVHCAECREEINRQRETVDYLRSECKNEEVSAPMDLKARLASLATECMPGPGAENLAMQRPESFVAKVESVVRAVRKNQGR

SEQ ID NO: 977 - DNA, 615 bp, Corynebacterium glutamicum; identical to SEQ ID NO: 975
  CDS (101)..(592): FRXA02066

SEQ ID NO: 978 - protein, 164 aa, Corynebacterium glutamicum; identical to SEQ ID NO: 976

SEQ ID NO: 979 - DNA, 579 bp, Corynebacterium glutamicum
  CDS (101)..(556): RXN02067
taaagttgagtccgtagtgcgcgcagttcgtaagaaccaaggccgctaatttttaatccttatttacattttctgaaagaccggtctgatgttttctagcgtgggttggggagagatcttcctcttagtcgttgtgggccttgttgtcatcggcccggaacggttgcctcgtttgatccaggacgcacgcgctgcgctgctcgctgcacgtaccgctatcgacaatgcaaagcagtcgttggacagtgattttggttcggaatttgatgaaatccgaaagccactaacccaggttgcacagtacagccggatgagccccaagacggccatcactaaggcgttatttgataatgattcctcgttcctggatgactttgatccaaagaagatcatggccgaaggaacagaaggcgaagctcagcgcaacaagcaggcagctgacaacaatgcgaatgtggtggaacgtccagctgatggttccaccgcacgcccaacgcaaaacgatccaaaagacggcccgaattactcaggtggcgtctcttggaccgatattatttagcttttatttaacgccaagcc

SEQ ID NO: 980 - protein, 152 aa, Corynebacterium glutamicum
VGWGEIFLLVVVGLVVIGPERLPRLIQDARAALLAARTAIDNAKQSLDSDFGSEFDEIRKPLTQVAQYSRMSPKTAITKALFDNDSSFLDDFDPKKIMAEGTEGEAQRNKQAADNNANVVERPADGSTARPTQNDPKDGPNYSGGVSWTDII

SEQ ID NO: 981 - DNA, 579 bp, Corynebacterium glutamicum; identical to SEQ ID NO: 979
  CDS (101)..(556): FRXA02067

SEQ ID NO: 982 - protein, 152 aa, Corynebacterium glutamicum; identical to SEQ ID NO: 980

SEQ ID NO: 983 - DNA, 912 bp, Corynebacterium glutamicum
  CDS (101)..(889): RXN02075
agttttcgaataccgtctacgtggagctttgcggaaaatacgcaccgagacctaggcgcgccatacgcatggttcacaggatttcagtacgattaaccccatgtacaaggtcttcgaagcactggatgatttagttcaagccgttcaacgcgcatacggcgttcccatgaccggaaattgcgtggttccccgtcaggaagtgcttgcgcttctcgatgatttacgtgatgcgcttcctgtagaacttgatgatgcacaagatgtgctggaccaccgtgatggtgtgatccgtgaagctgaagaaaaggccattgccttggtcgacgatgcagaaaacgaggcccgaaacctccttgcacgcgcaactgaggagtcagatgccatggtggaagacgccaccaagcatgcgcattctgtcgttgctaaggctaatgacacagcggatcgcatcgtgagtgacgctcgtcgagaagcaaacagcgtcaccgagcgcgcccaggctgaatctgagcgcctggtcaactccggcaatgatgcgtatcgccgcgcggttgctgaaggccaggccgagcaggatcgcctggtcagcgaggcagaagtggtgcgtcgctccacggaagaagcacaccgcattgtggatgcagcgcacgctgactccaacaagctgcgcaatgaatgcgatgactacgtggataccaagttggcagagtttgaaacctcgctgtccaccacgttgcgttctgtcactgctgatcgttccgcactacgccgaggagctggagctactggccgcgagctgcgcgatgagcaaccggcagcgcgtggtgaatatgagcgggactacgagcgtgattatgaacgaggctacgaacgcgacgatcgagactactagtttccaagaaaccatttagg

SEQ ID NO: 984 - protein, 263 aa, Corynebacterium glutamicum
MYKVFEALDDLVQAVQRAYGVPMTGNCVVPRQEVLALLDDLRDALPVELDDAQDVLDHRDGVIREAEEKAIALVDDAENEARNLLARATEESDAMVEDATKHAHSVVAKANDTADRIVSDARREANSVTERAQAESERLVNSGNDAYRRAVAEGQAEQDRLVSEAEVVRRSTEEAHRIVDAAHADSNKLRNECDDYVDTKLAEFETSLSTTLRSVTADRSALRRGAGATGRELRDEQPAARGEYERDYERDYERGYERDDRDY

SEQ ID NO: 985 - DNA, 657 bp, Corynebacterium glutamicum
  CDS (101)..(634): RXN02076
tagtttccaagaaaccatttaggctttttcacctttccgtctagcgatcctcatctgatgtatgtagtcacgatgaggtacgagtaggatcttcctggtcatgaaatctccatttatttttgatgtcgccgcactccttcgtggaagtgcccttccggaacacctcacccaatcaggtccaagcccgacccgcattggtccggaaatgatcgcgatccccgagggcggaaaagttatcgtagaagcccagatcattccactcggtggaggcctggccgtcgaagcagatatcgaagcgcagcttctgggacagtgctcccgctgcctccgcgaactcaccccaaccaagacgctgcacgtctctgaggtttttgctgccgatccagactttgttactggtgaagatgcagcagatgacgaagatgagctgccaatggttaaccaagaccagattgatctgcttcagtctgtcattgatgaagctggtctgaccttgccgtttaaccctgtctgcgaagaacttgggtacggcgcatgccaggatgatgaaacgccagctcctgacggtgtctctgaagaagtagaagacgaggaaaaggtcgatccgcgctgggctggtttggagaagttcctgtgagcaggaaaaagaatcgcctc

SEQ ID NO: 986 - protein, 178 aa, Corynebacterium glutamicum
MKSPFIFDVAALLRGSALPEHLTQSGPSPTRIGPEMIAIPEGGKVIVEAQIIPLGGGLAVEADIEAQLLGQCSRCLRELTPTKTLHVSEVFAADPDFVTGEDAADDEDELPMVNQDQIDLLQSVIDEAGLTLPFNPVCEELGYGACQDDETPAPDGVSEEVEDEEKVDPRWAGLEKFL

SEQ ID NO: 987 - DNA, 657 bp, Corynebacterium glutamicum; identical to SEQ ID NO: 985
  CDS (101)..(634): FRXA02076

SEQ ID NO: 988 - protein, 178 aa, Corynebacterium glutamicum; identical to SEQ ID NO: 986

SEQ ID NO: 989 - DNA, 840 bp, Corynebacterium glutamicum
  CDS (101)..(817): RXN02094
ttccacctctacaccggagttcttccaaccaacgaccagatcattgctgcggaggagttctccaagtaaatttctctcccctatttttaggaggcaccacatggctgaacacaacgccatcatcacggatgcagtacattccgaccccgctgttttagaagacaacgccgggttcagcggaaagtacctaatccgtgccctggacaaggcagctcatatgcaaacaggtgccatcgagggatacatttcttggcttcggaagcacaatcctgagaaaacaccggcgcagctgcaggtactcgtcgacaagcattttatgcgccttgccaccggctctggcgctggtgtgggcatggctgcggccgtgccaggcattggctttgtcacgggtgctcttgccgttggtgctgaatcgttggtgtttttggatgctgctgcgttttacaccatggcatccgcgcacctgcgtggcatcgacatccgccatcctgaacgccgacgtggtttgattttggtggttctgctgggcaccgcaggcaaagccattgttgacgcaggcgtcggtgatttatccaagaaaaaccacgcgccgggcattgcgatttcccggtttaatatcggtggcttgatggaagtcaacggccgactgatgcgctacgcagtgaaggaagtaagcaagcgtttccgttcggcattgattggcaaaattctgccgtttggtatcggtgcggtgctgggcacgatggccaaccgcaaaattgccaagaggactgtcggaaacgcatacgactctcttggtcctctccccacccatttttaagtactcaagacccttccaac

SEQ ID NO: 990 - protein, 239 aa, Corynebacterium glutamicum
MAEHNAIITDAVHSDPAVLEDNAGFSGKYLIRALDKAAHMQTGAIEGYISWLRKHNPEKTPAQLQVLVDKHFMRLATGSGAGVGMAAAVPGIGFVTGALAVGAESLVFLDAAAFYTMASAHLRGIDIRHPERRRGLILVVLLGTAGKAIVDAGVGDLSKKNHAPGIAISRFNIGGLMEVNGRLMRYAVKEVSKRFRSALIGKILPFGIGAVLGTMANRKIAKRTVGNAYDSLGPLPTHF

SEQ ID NO: 991 - DNA, 840 bp, Corynebacterium glutamicum; identical to SEQ ID NO: 989
  CDS (101)..(817): FRXA02094

SEQ ID NO: 992 - protein, 239 aa, Corynebacterium glutamicum; identical to SEQ ID NO: 990

SEQ ID NO: 993 - DNA, 1245 bp, Corynebacterium glutamicum
  CDS (101)..(1222): RXN02104
catggattcccatttggagccttatttacacaggccacctggcttgtttcccaccgcgatgtgccacaataacgccataacagaaaggcatactgacacaatgtccaactcccccaccgacgtttcaacgagcgcacctcgaattatgatcgcgccagattcctacaaaggaaccgctaccgcatcagaagctgcgcaatacttaggcgaaggcgtgttggaaattttgcccaacgcctccattacgttggcacccatggccgacggtggcgaaggaacatcctcagttttcggcgggcaggtcataacattacccacgacaaatgccgcgggacgcctcaccgaagccagctacaccttagattccgaaacaaacactgcctacattgacatcgccgcagcctccggtttgcccgccgttgcagacgatctagtccccaccaccggcgatacctacggcaccggcgttttgatcgcagacgcggtcacccgtggcgcaactcgcattgctttaggccttggcggatcagccacaactgacgccggctcaggaattctcatcgccctcggcgccgtcccacgcaacaaagagggctacgcactacgaaccggtggcgccgacctcatcaacctcgattacatcgataccgccgaactcaacatccccgcagccgccgtcgaatggatcctgctcaccgatgtcgacgcccccgccaccggcccgcagggcgcggccaccgtattcgggccccaaaaaggtgccaccgaaaaagacatttcgcttctcgacgccgccctccaccacgcctgcgcccaactggaagttgatggcacaaagccaggtatgggcgcagccgggggcattgcaatcggactgacgtggctgtccaccctcatgcacggcaacgaccaacagatccatatcctccccggcgcgccactgattgcccgctccaacggaatcgaggatgcgctgccagaaactgacttgttgatcaccggtgaaggccgactagattcccaatcgttcaccggaaaggttgtgggcaccctccacggtttagctaaagcccacgatgtggatctcgctgttgcggccggcatcgtggaaggcggtattcccgatgatttcctagcggtagaaatgattaaatcctccgacgttgcagcacaattacgtgatgcaggccgaaggatcgctcaagaatacgtagctcaaaactagcgaaggatctccacagtcca

SEQ ID NO: 994 - protein, 374 aa, Corynebacterium glutamicum
MSNSPTDVSTSAPRIMIAPDSYKGTATASEAAQYLGEGVLEILPNASITLAPMADGGEGTSSVFGGQVITLPTTNAAGRLTEASYTLDSETNTAYIDIAAASGLPAVADDLVPTTGDTYGTGVLIADAVTRGATRIALGLGGSATTDAGSGILIALGAVPRNKEGYALRTGGADLINLDYIDTAELNIPAAAVEWILLTDVDAPATGPQGAATVFGPQKGATEKDISLLDAALHHACAQLEVDGTKPGMGAAGGIAIGLTWLSTLMHGNDQQIHILPGAPLIARSNGIEDALPETDLLITGEGRLDSQSFTGKVVGTLHGLAKAHDVDLAVAAGIVEGGIPDDFLAVEMIKSSDVAAQLRDAGRRIAQEYVAQN

SEQ ID NO: 995 - DNA, 443 bp, Corynebacterium glutamicum
  CDS (1)..(420): FRXA02104
cacgcctgcgcccaactggaagttgatggcacaaagccaggtatgggcgcagccgggggcattgcaatcggactgacgtggctgtccaccctcatgcacggcaacgaccaacagatccatatcctccccggcgcgccactgattgcccgctccaacggaatcgaggatgcgctgccagaaactgacttgttgatcaccggtgaaggccgactagattcccaatcgttcaccggaaaggttgtgggcaccctccacggtttagctaaagcccacgatgtggatctcgctgttgcggccggcatcgtggaaggcggtattcccgatgatttcctagcggtagaaatgattaaatcctccgacgttgcagcacaattacgtgatgcaggccgaaggatcgctcaagaatacgtagctcaaaactagcgaaggatctccacagtcca

SEQ ID NO: 996 - protein, 140 aa, Corynebacterium glutamicum
HACAQLEVDGTKPGMGAAGGIAIGLTWLSTLMHGNDQQIHILPGAPLIARSNGIEDALPETDLLITGEGRLDSQSFTGKVVGTLHGLAKAHDVDLAVAAGIVEGGIPDDFLAVEMIKSSDVAAQLRDAGRRIAQEYVAQN

SEQ ID NO: 997 - DNA, 553 bp, Corynebacterium glutamicum
  CDS (101)..(553): FRXA02071
catggattcccatttggagccttatttacacaggccacctggcttgtttcccaccgcgatgtgccacaataacgccataacagaaaggcatactgacacaatgtccaactcccccaccgacgtttcaacgagcgcacctcgaattatgatcgcgccagattcctacaaaggaaccgctaccgcatcagaagctgcgcaatacttaggcgaaggcgtgttggaaattttgcccaacgcctccattacgttggcacccatggccgacggtggcgaaggaacatcctcagttttcggcgggcaggtcataacattacccacgacaaatgccgcgggacgcctcaccgaagccagctacaccttagattccgaaacaaacactgcctacattgacatcgccgcagcctccggtttgcccgccgttgcagacgatctagtccccaccaccggcgatacctacggcaccggcgttttgatcgcagacgcggtcacccgtggcgcaactcgcattgctttaggccttggcggatcagccacaactgacgccggctcagga

SEQ ID NO: 998 - protein, 151 aa, Corynebacterium glutamicum
MSNSPTDVSTSAPRIMIAPDSYKGTATASEAAQYLGEGVLEILPNASITLAPMADGGEGTSSVFGGQVITLPTTNAAGRLTEASYTLDSETNTAYIDIAAASGLPAVADDLVPTTGDTYGTGVLIADAVTRGATRIALGLGGSATTDAGSG

SEQ ID NO: 999 - DNA, 465 bp, Corynebacterium glutamicum
  CDS (101)..(442): RXN02107
aagaagtagagctcagcgatgaagatttcgcggcaggccacgacctagtaaaaaccaaatacgccaccgaggagtggactaagcgagttcaatagtttctatggatctgcacaaggtagctgcagcgcacgcggcgactcttcccctgagcaccaaagagtttcctttcggacccgagcacgaagtgtacaaagtgcggggcaaggtatttttgctgctcacgatactaaatgatgagccgattatcacgctgaaatcagaccccgagattggcgcttcactacgcagtggcttccccaccatccaggctggatatcacatgaacaaagtgcactggctgagcattagcgatggtgaacggatcacgaaagacttcatcgaaggtctcgtggaagagtcctatgaactggtaatttccaccttgccgaagtataaaaggccttaacttggttgcttgcgggtggc

SEQ ID NO: 1000 - protein, 114 aa, Corynebacterium glutamicum
MDLHKVAAAHAATLPLSTKEFPFGPEHEVYKVRGKVFLLLTILNDEPIITLKSDPEIGASLRSGFPTIQAGYHMNKVHWLSISDGERITKDFIEGLVEESYELVISTLPKYKRP

SEQ ID NO: 1001 - DNA, 465 bp, Corynebacterium glutamicum; identical to SEQ ID NO: 999
  CDS (101)..(442): FRXA02107

SEQ ID NO: 1002 - protein, 114 aa, Corynebacterium glutamicum; identical to SEQ ID NO: 1000

SEQ ID NO: 1003 - DNA, 732 bp, Corynebacterium glutamicum
  CDS (101)..(709): RXN02108
aagacttcatcgaaggtctcgtggaagagtcctatgaactggtaatttccaccttgccgaagtataaaaggccttaacttggttgcttgcgggtggcaagatgggtgatatgaaaattacccgccacatccatgcatgcgttgagatctcacagggaaacgatcgaatcattattgatcccggtacttttggcgccccagatttatgtggcgcgaccatcctggtcacccacaatcatgccgatcacgttgatcccgagttgctcaagcccggcatgacgatttacgcgcctcgatcagtagcacattcaattccagtagaatgccacatcgtggaacacggccgaaactttaccgttgggtccctatccgttgaggttcttggttctgaacatgcgatgctcacccattccatgccgatcgcggaaaacgttggatacttaatcaacggccgagtgctccaccccggcgataccttccaacccattaaagatgtcgaactcgccctggttcctgtcaacggcccctgggtgaaaatgctggatgtggaaggctatttgaagaaatttccaccaaagcgtttcatcggcattcacgatggcattgttaatgatcgcggtttggcgatcaacaagaagttcttaacgcatcttggtgaaacctatggctcggaatactcgccgcttgaagagggagagtcgttggaaatttagattcttggtttagattcttg

SEQ ID NO: 1004 - protein, 203 aa, Corynebacterium glutamicum
MGDMKITRHIHACVEISQGNDRIIIDPGTFGAPDLCGATILVTHNHADHVDPELLKPGMTIYAPRSVAHSIPVECHIVEHGRNFTVGSLSVEVLGSEHAMLTHSMPIAENVGYLINGRVLHPGDTFQPIKDVELALVPVNGPWVKMLDVEGYLKKFPPKRFIGIHDGIVNDRGLAINKKFLTHLGETYGSEYSPLEEGESLEI

SEQ ID NO: 1005 - DNA, 558 bp, Corynebacterium glutamicum
  CDS (101)..(535): FRXA02108
ttgatcccggtacttttggcgccccagatttagatgggcgaccatcctgatcacccacaatcatgccgatcacgttgatcccgagttgctcaagcccggcatgacgatttacgcgcctcgatcagtagcacattcaattccagtagaatgccacatcgtggaacacggccgaaactttaccgttgggtccctatccgttgaggttcttggttctgaacatgcgatgctcacccattccatgccgatcgcggaaaacgttggatacttaatcaacggccgagtgctccaccccggcgataccttccaacccattaaagatgtcgaactcgccctggttcctgtcaacggcccctgggtgaaaatgctggatgtggaaggctatttgaagaaatttccaccaaagcgtttcatcggcattcacgatggcattgttaatgatcgcggtttggcgatcaacaagaagttcttaacgcatcttggtgaaacctatggctcggaatactcgccgcttgaagagggagagtcgttggaaatttagattcttggtttagattcttg

SEQ ID NO: 1006 - protein, 145 aa, Corynebacterium glutamicum
MTIYAPRSVAHSIPVECHIVEHGRNFTVGSLSVEVLGSEHAMLTHSMPIAENVGYLINGRVLHPGDTFQPIKDVELALVPVNGPWVKMLDVEGYLKKFPPKRFIGIHDGIVNDRGLAINKKFLTHLGETYGSEYSPLEEGESLEI

SEQ ID NO: 1007 - DNA, 509 bp, Corynebacterium glutamicum
  CDS (1)..(486): RXN02114
tccatcggctacgcctggaccaccgcatttcacgcactcacaccaggccttggcggcatcgccattggtatttggctgctcggtggtgtgctcggtgggttggttatccgcaagccgggtgccgcaattttcgttgaagtagtggccgcatgtgtctctgcagcgcttgcttcacagtttggtatctccaccatttactccggcttggcgcagggaatcggcgctgaaatcatcttcgcgctgttcctctaccgtcgctacagcctgcccaccaccatgcttgcaggtatgggcgcaggtggcggcgcaattttcctggaaatgttcttctacggaaacctcgcaaagacgatgtccttcaacatcatctattccaccactgtccttatttccggtgcgatccttgccggcctgctcagctggtacctggtccgcgcgttggcgaggactggtgcacttgatcgtttcgccgctggccgcgaggtataaatgaccaccgcacttggaac

SEQ ID NO: 1008 - protein, 162 aa, Corynebacterium glutamicum
SIGYAWTTAFHALTPGLGGIAIGIWLLGGVLGGLVIRKPGAAIFVEVVAACVSAALASQFGISTIYSGLAQGIGAEIIFALFLYRRYSLPTTMLAGMGAGGGAIFLEMFFYGNLAKTMSFNIIYSTTVLISGAILAGLLSWYLVRALARTGALDRFAAGREV

SEQ ID NO: 1009 - DNA, 509 bp, Corynebacterium glutamicum; identical to SEQ ID NO: 1007
  CDS (1)..(486): FRXA02114

SEQ ID NO: 1010 - protein, 162 aa, Corynebacterium glutamicum; identical to SEQ ID NO: 1008

SEQ ID NO: 1011 - DNA, 828 bp, Corynebacterium glutamicum
  CDS (101)..(805): RXN02121
ccgggaaatcttcaggcgtctcctcccatatgctgctgacaaattccagaacaggatcgttgggataccttcgagacaaacttccgaaagctccgcaaccatgatcacctcaccatttgagcgcgagctgaagctgctcaacgagggggaactgggtattgtccagcagttggtggaatcaagcaacatcggattcatcgtcgatcttgaattagatggcgattatgggtgggcggtctacaaaccggaattgggggagcaacccctgtgggatttccctcctggcctgtacaaacgtgaacgtgcagcctttgtgatcagtgagtttttgggttggaacatcgtgcctccaacggtgatcatgcacgatgccccggctggtgtgggctcggtgcagtggtttattgaaaacaatggcgaacactattttccactgtttgacacccgcgctgacctgcatccgcagtttgtccgcatggctgtgtttgatctgttgtgcaacaacactgaccggaaagcgggccatgtgttgttagacggcgatcatatttggggcatcgatcacgggttgtgtttttccgtcgaaccgaagctgcgcacggtgatttgggatttcgcaggctgcaccattccagatgacttggtgacagatgttgagcagcttttggaggacgtcccggaagaacttcatcagcttcttcatcccgcagaaattgatgcgctgcagcgccgtgcctcaagaatcagcaggttaccgttccttccgcaggcgaaatcgcatcgtcaattcccttggccacttgtttgagtaggctggcgggcaggtgc

SEQ ID NO: 1012 - protein, 235 aa, Corynebacterium glutamicum
MITSPFERELKLLNEGELGIVQQLVESSNIGFIVDLELDGDYGWAVYKPELGEQPLWDFPPGLYKRERAAFVISEFLGWNIVPPTVIMHDAPAGVGSVQWFIENNGEHYFPLFDTRADLHPQFVRMAVFDLLCNNTDRKAGHVLLDGDHIWGIDHGLCFSVEPKLRTVIWDFAGCTIPDDLVTDVEQLLEDVPEELHQLLHPAEIDALQRRASRISRLPFLPQAKSHRQFPWPLV

SEQ ID NO: 1013 - DNA, 828 bp, Corynebacterium glutamicum
  CDS (101)..(805): FRXA02121
ccgggaaatcttcaggcgtctcctcccatatgctgctgacaaattccagaacaggatcgttgggataccttcgagacaaacttccgaaagctccgcaaccatgatcacctcaccatttgagcgcgagctgaagctgctcaacgagggggaactgggtattgtccagcagttggtggaatcaagcaacatcggattcatcgtcgatcttgaattagatggcgattatgggtgggcggtctacaaaccggaattgggggagcaacccctgtgggatttccctcctggcctgtacaaacgtgaacgtgcagcctttgtgatcagtgagtttttgggttggaacatcgtgcctccaacggtgatcatgcacgatgccccggctggtgtgggctcggtgcagtggtttattgaaaacaatggcgaacactattttccactgtttgacacccgcgctgacctgcatccgcagtttgtccgcatggctgtgtttgatctgttgtgcaacaacactgaccggaaatcgggccatgtgttgctagacggcgatcatatttggggcatcgatcacgggttgtgtttttccgtcgaaccgaagctgcgcacggtgatttgggatttcgcaggctgcaccattccagatgacttggtgacagatgttgagcagcttttggaggacgtcccggaagaacttcatcagcttcttcatcccgcagaaattgatgcgctgcagcgccgtgcctcaagaatcagcaggttaccgttccttccgcaggcgaaatcgcatcgtcaattcccttggccacttgtttgagtaggctggcgggcaggtgc

SEQ ID NO: 1014 - protein, 235 aa, Corynebacterium glutamicum
MITSPFERELKLLNEGELGIVQQLVESSNIGFIVDLELDGDYGWAVYKPELGEQPLWDFPPGLYKRERAAFVISEFLGWNIVPPTVIMHDAPAGVGSVQWFIENNGEHYFPLFDTRADLHPQFVRMAVFDLLCNNTDRKSGHVLLDGDHIWGIDHGLCFSVEPKLRTVIWDFAGCTIPDDLVTDVEQLLEDVPEELHQLLHPAEIDALQRRASRISRLPFLPQAKSHRQFPWPLV

SEQ ID NO: 1015 - DNA, 465 bp, Corynebacterium glutamicum
  CDS (101)..(442): RXN02138
tcactcgccggagatccgtaaaaaggggagtacactgcaagcctatgatgtcccggcctaaaagtaattcaaagggccaacagttaaggagactaaagcgatgaccgctccatcaaccaacaccggtgttatcttgaccgagtccgcagcgtccaaagctaaggcactcatcgatcaggaaggccgcgacgacctctctctgcgtatcgccgttcagcctggcggctgctctggccttcgttaccagctttacttcgacgaccgcacccttgatggcgataaggaagacatcgtcggtggcgttcgccttgtcgttgacaagatgagcaccccatacttgctcggcgctcagatcgacttcgctgacaccatcgagcagcagggcttcaccatcgacaacccaaacgcaggcagctcttgcgcttgtggtgactccttcaactaaagagattccgttatgtagga

SEQ ID NO: 1016 - protein, 114 aa, Corynebacterium glutamicum
MTAPSTNTGVILTESAASKAKALIDQEGRDDLSLRIAVQPGGCSGLRYQLYFDDRTLDGDKEDIVGGVRLVVDKMSTPYLLGAQIDFADTIEQQGFTIDNPNAGSSCACGDSFN

SEQ ID NO: 1017 - DNA, 465 bp, Corynebacterium glutamicum; identical to SEQ ID NO: 1015
  CDS (101)..(442): FRXA02138

SEQ ID NO: 1018 - protein, 114 aa, Corynebacterium glutamicum; identical to SEQ ID NO: 1016

SEQ ID NO: 1019 - DNA, 1311 bp, Corynebacterium glutamicum
  CDS (101)..(1288): RXN02151
atgagcgcatcgtcttttttaggagttgtccgccaccgtgaaaactggaaacttaaacccagccccacagcaggtgacggctccccagaacaaggctcgtatggattggccagacatcgccaagggaatatccatcctaggtgtcgtgttactacacgtgtcgttggcaattccaggtggccaggacaccatgatgtcccacctgaacgcactgcttgatccacttcggatgccattattttttatggtgagtggattttttgcagttaaagttctgaatcaaagctttggtgaacttttccgcgggcgactgtggttctacctggttccatatttgctgtggactccagtgaatctttatctacaccgcctcgagggcacagtttttaccggtagagcaccgggaacatgggaatggtacagcggctcgatgctctcggccaccaatatgtactggttcctctacttcttggtcatcttcaacctatttttatgggcaacgagaaaactcccagcttgggcaattgtggcgttggtggcctcactgtggctacttatgccggcttatagcgagattgagattctacgcaagtccattatttacttgcctacattcctcattggcgcttacttccgcccactgatttcgcgttttgcagaagccgcaacaaggccaaaagcaatagtgtttgcagcggtcctttatgtctcgggacttgctttgggcgtgatctcaaatgggctgcgcgacagcgaaaaccatggcgcaagcgtgctgtggctgatgaacctccgcgatacttttgctcatgcactcggcggcaacctcactggattcgatatggatcaccttcctggaatgatcattcggattgtttccctgcctgcaggaattgtgttgtgcgtatggcttggccgaataaagccagtaggggagtttttgaaacttattggtaggcacacccttcccatctacattgggcatgcaacaggactatcgctgatttttggtttcggcttgcgctggaatttcatggagattgataacttctctgacagtttgtggcaccacaccaatacgtggatggtcatcgcgtttgcctgcgcgatgctcggcgggtacctgacctatctgatctcgcgagttccagtgctgggatggactcttgttccccctaaactgccagaaccagataaaactccagctaaagcacaagctgattctcacgttaaagctcagtctgcgaagcctatgaatgcttctacctcttctaagacgtacggtatataactgaagcataacctgtgtga

SEQ ID NO: 1020 - protein, 396 aa, Corynebacterium glutamicum
MDWPDIAKGISILGVVLLHVSLAIPGGQDTMMSHLNALLDPLRMPLFFMVSGFFAVKVLNQSFGELFRGRLWFYLVPYLLWTPVNLYLHRLEGTVFTGRAPGTWEWYSGSMLSATNMYWFLYFLVIFNLFLWATRKLPAWAIVALVASLWLLMPAYSEIEILRKSIIYLPTFLIGAYFRPLISRFAEAATRPKAIVFAAVLYVSGLALGVISNGLRDSENHGASVLWLMNLRDTFAHALGGNLTGFDMDHLPGMIIRIVSLPAGIVLCVWLGRIKPVGEFLKLIGRHTLPIYIGHATGLSLIFGFGLRWNFMEIDNFSDSLWHHTNTWMVIAFACAMLGGYLTYLISRVPVLGWTLVPPKLPEPDKTPAKAQADSHVKAQSAKPMNASTSSKTYGI

SEQ ID NO: 1021 - DNA, 1311 bp, Corynebacterium glutamicum; identical to SEQ ID NO: 1019
  CDS (101)..(1288): FRXA02151

SEQ ID NO: 1022 - protein, 396 aa, Corynebacterium glutamicum; identical to SEQ ID NO: 1020

SEQ ID NO: 1023 - DNA, 969 bp, Corynebacterium glutamicum
  CDS (101)..(946): RXN02169
gttaaaggtcgaaaaatcccacccctagcccttttaaatgagtgttgttattgttaaccactgttactggtgggattaatacttatttttgggagaacttttggacatgcaaataaaccgccgaggcttcttaaaagccaccacaggacttgccactatcggcgctgccagcatgtttatgccaaaggccaacgcccttggagcaatcaagggcaccgtcatcgactacgcagcaggcgtccccagcgcagcatccattaaaaatgcagggcaccttggagctgtccgttacgtgtcacagcgacgccccggcactgaatcctggatgatcggcaagccagtcacactggcagaaacccgagcttttgaacaaaacggcctcaaaaccgcatccgtctatcaatacggaaaggcagagaccgccgattggaagaacggcgccgcaggagcggcaacccacgctccacaggcaattgcgcttcacgtggcagctggtggccctaaaaatcgccccatctacgtggcgatcgacgacaacccaagctggtctgaatacaccaatcagattcgcccctacctccaggcattcaatgttgcgctgtccgctgccggctaccagttaggtgtctacggcaactacaacgtcattaattgggctatcgccgacggccttggagaattcttctggatgcacaactggggatcagaaggaaagatccacccacgcaccaccatccaccagatccgcattgataaggacaccctcgacggagtcggcatcgacatgaacaatgtctatgcagacgactggggtcagtggaccccaggcaacgcggttgacgatgccatccccaccattcctggaaactccaacacgggaacaggtactggaattgatgctgacaccatcaaccaagtaatcaagattcttggcaccctatctagctaaactagccgtgctgactcaca

SEQ ID NO: 1024 - protein, 282 aa, Corynebacterium glutamicum
LDMQINRRGFLKATTGLATIGAASMFMPKANALGAIKGTVIDYAAGVPSAASIKNAGHLGAVRYVSQRRPGTESWMIGKPVTLAETRAFEQNGLKTASVYQYGKAETADWKNGAAGAATHAPQAIALHVAAGGPKNRPIYVAIDDNPSWSEYTNQIRPYLQAFNVALSAAGYQLGVYGNYNVINWAIADGLGEFFWMHNWGSEGKIHPRTTIHQIRIDKDTLDGVGIDMNNVYADDWGQWTPGNAVDDAIPTIPGNSNTGTGTGIDADTINQVIKILGTLSS

SEQ ID NO: 1025 - DNA, 969 bp, Corynebacterium glutamicum; identical to SEQ ID NO: 1023
  CDS (101)..(946): FRXA02169

SEQ ID NO: 1026 - protein, 282 aa, Corynebacterium glutamicum; identical to SEQ ID NO: 1024

SEQ ID NO: 1027 - DNA, 1581 bp, Corynebacterium glutamicum
  CDS (101)..(1558): RXN02180
gtttcagctaaaagaagaatccttgctagtggaatcagctgagttttccacgagttttccagctttctcacaacttgaatagaaattgaggtatccggcaatgacgtcagggaaatcaacgagtactaggggagccctagaccggtatttcaaaatctcggagcgaggatcaagcattggcacggaaatccgtgcaggtgtggtcacattcttcgcgatggcctacatcatcatcctcaaccccttgatccttggcaccacccctgacgtagagggcaacaccctaggcatcgcacaggttgcagcggcaacagcgcttgccgctggtgtcatgaccatcgcgtttggtttgattgcgcgttatccattcggcattgctgctggcctgggaattaacaccatggtcgccgtgacactggtttcaggtgagggcctgacctggccggaagcaatgggacttgtggtccttgacggtgtggtcattgttattttggctgtgtccggcttccgtgttgctgtgttccgtgcgatcccagcatccatgaaggcggccatcagcgtgggtatcggcctgttcatcgccatgatcggcctcgtggatgcaggctttgttcgccgtattccagatgctgccggtactactgtgccagtgactttgggcattgatggttccattgcgtcttggccaacgttcgtgttcgttgtcggtgttcttctctgtggcatccttgttgtccgtcgagttcgcggtggactgtttatcggcattttgggaaccaccattttggcgatcatcgcagaagcaatctttgattccggtgcgtcctttgaaaatggtgaagcaaacgcagaaggctggtcactcgccgttcctggtctcccagactccttcggtggcatcccggatctttccatcgtcggcgcagttgatttgatcggtgcgttcagccgcatcggtgtggtcgccgcgaccttgctgatctttaccctggtccttgcaaacttcttcgacgccatgggcaccatgaccgctcttggtaagcagggcaacttggttgatgatgaaggcaaccttccagacattaagaaggcactggttgtggaaggcgcaggtgccattgtcggtggtgctttctctgcatcctccaacaccgtgttcgctgactcttctgcaggtgttgcagacggcgcacgaaccggccttgccaacgtggtcaccggctccttgttcttggctgccatgttcttgaccccactgtatgaaatcgtccccatcgaagcagcagcaccagtgcttgtagttgttggcgcgatgatgatggggcaggttaccgagattgatttctccaagttctacatcgcattcccagcgttcttgaccattgtgatcatgcctttcacctactccattgcaaacggcattggcgttggattcatcatgtacgccatcatggctgcagcggcaggcaaagcaaagcaagtgcactggctgatgtggctggtcgctggactcttcgtcgtgttcttcgcgattgatcccatcatggaagctgtcggctaatgacaacgcgcacggtaatt

SEQ ID NO: 1028 - protein, 486 aa, Corynebacterium glutamicum
MTSGKSTSTRGALDRYFKISERGSSIGTEIRAGVVTFFAMAYIIILNPLILGTTPDVEGNTLGIAQVAAATALAAGVMTIAFGLIARYPFGIAAGLGINTMVAVTLVSGEGLTWPEAMGLVVLDGVVIVILAVSGFRVAVFRAIPASMKAAISVGIGLFIAMIGLVDAGFVRRIPDAAGTTVPVTLGIDGSIASWPTFVFVVGVLLCGILVVRRVRGGLFIGILGTTILAIIAEAIFDSGASFENGEANAEGWSLAVPGLPDSFGGIPDLSIVGAVDLIGAFSRIGVVAATLLIFTLVLANFFDAMGTMTALGKQGNLVDDEGNLPDIKKALVVEGAGAIVGGAFSASSNTVFADSSAGVADGARTGLANVVTGSLFLAAMFLTPLYEIVPIEAAAPVLVVVGAMMMGQVTEIDFSKFYIAFPAFLTIVIMPFTYSIANGIGVGFIMYAIMAAAAGKAKQVHWLMWLVAGLFVVFFAIDPIMEAVG

SEQ ID NO: 1029 - DNA, 1581 bp, Corynebacterium glutamicum; identical to SEQ ID NO: 1027
  CDS (101)..(1558): FRXA02180

SEQ ID NO: 1030 - protein, 486 aa, Corynebacterium glutamicum; identical to SEQ ID NO: 1028

SEQ ID NO: 1031 - DNA, 702 bp, Corynebacterium glutamicum
  CDS (101)..(679): RXN02185
caactccttggggtgaagccagacatccactggcagagcaactcctccgctctaacccgacagctaacctcgacggcgacaaatgagaggaaaacttttcatgggacgtcactccactaagactagctccgcgttcaccaagctcgcagcttccaccatcgctttcggtgctgctgcaaccatcatggctccttctgcatctgctgcacctgattccgactgggatcgcctcgcacagtgcgagtccggtggtaactgggcaatcaacaccggtaacggctaccacggtggtctgcagttctccgctagcacctgggctgcttacggcggccaggagttcgctacctacgcataccaggcaacccgtgagcagcagatcgctgttgcagagcgcaccttggctggtcagggctggggcgcatggcctgcttgctccgcttcccttggactgaactccgctccaacccagcgtgacctctccgctaccacctccaccccagagccagctgcagctgcaccagctgttgctgagtacaacgctcctgcagccaacatcgcagttggctccaccgacttgaacaccatcaagtccacctacggcgctgtcaccggcaccctcgctcagtacggcatcaccgttccagctgaggttgagtcttactacaacgctttcgtcggctaaatctagctgcactttttaaa

SEQ ID NO: 1032 - protein, 193 aa, Corynebacterium glutamicum
MGRHSTKTSSAFTKLAASTIAFGAAATIMAPSASAAPDSDWDRLAQCESGGNWAINTGNGYHGGLQFSASTWAAYGGQEFATYAYQATREQQIAVAERTLAGQGWGAWPACSASLGLNSAPTQRDLSATTSTPEPAAAAPAVAEYNAPAANIAVGSTDLNTIKSTYGAVTGTLAQYGITVPAEVESYYNAFVG

SEQ ID NO: 1033 - DNA, 702 bp, Corynebacterium glutamicum; identical to SEQ ID NO: 1031
  CDS (101)..(679): FRXA02185

SEQ ID NO: 1034 - protein, 193 aa, Corynebacterium glutamicum; identical to SEQ ID NO: 1032

SEQ ID NO: 1035 - DNA, 321 bp, Corynebacterium glutamicum
  CDS (101)..(298): RXN02186
tccaaccaccccttgagggtggggatgggggagtcttttttcatgatgttgttaagtttaagccttgttgaggtgacttttgttcccagagtttgaaagaatgtatgacatggcaaacgtagagaagaagcacttcgtcgatccggcatggccggagcacaatccagctgacggacacgtcgttactgaactcatctccaaggtcgcaggcgcgtccagcccatggggcgatgacaaggaattcccagtttctgcagaagagaccggatacgttcacccgtacacccggatcaaccgctaagaaacttaaaaaagaggcaa

SEQ ID NO: 1036 - protein, 66 aa, Corynebacterium glutamicum
MYDMANVEKKHFVDPAWPEHNPADGHVVTELISKVAGASSPWGDDKEFPVSAEETGYVHPYTRINR

SEQ ID NO: 1037 - DNA, 342 bp, Corynebacterium glutamicum
  CDS (101)..(319): FRXA02186
agctgatcatcactttgagtatccaaccaccccttgagggtggggatgggggagtcttttttcatgatgttgttaagtttaagccttgttgaggtgacttttgttcccagagtttgaaagaatgtatgacatggcaaacgtagagaagaagcacttcgtcgatccggcatggccggagcacaatccagctgacggacacgtcgttactgaactcatctccaaggtcgcaggcgcgtccagcccatggggcgatgacaaggaattcccagtttctgcagaagagaccggatacgttcacccgtacacccggatcaaccgctaagaaacttaaaaaagaggcaa

SEQ ID NO: 1038 - protein, 73 aa, Corynebacterium glutamicum
LFPEFERMYDMANVEKKHFVDPAWPEHNPADGHVVTELISKVAGASSPWGDDKEFPVSAEETGYVHPYTRINR

SEQ ID NO: 1039 - DNA, 898 bp, Corynebacterium glutamicum
  CDS (101)..(898): RXN02207
gaatcggtgactttgccaacaccaatcacacaagcccttgatgatgtctccctgtgacttggtccaattacattcactggtaatctgaaaccttgtgaatatgcgccgtcgatcccgtgtgtcccgtttgcttcccgccacagctttgctggcctcaactgcacttcttttaagtgcatgtacgcaaggggtaacggactccccggatatgggcaaggcaactcccgctgtctcccccgcagcaagcaacccggatggccaagtaattgagttcggcaacatcactgacatggaagtcactgatggtgacatcctcggtgtacgcaccgaagacgcactcgctattggtacagtctccgacttcgaagcgggtagccaggtggaactggacgtcgataagcaatgcggcgacctgaccgcaaccggcggcactttcgtgctcccctgcgccgatggcgtttatttgattgatgccaaggacccggatctggatgagttgcgtgcaactgacaagccagtcacggtggcagccttgaccagcgatgatcagcttctggtgggcaatggtgaagatgaagaactcaccatctaccgcgagggcgaagagccagaaaccttcaccgtcgcgggtcccaatacccagctcatcgccgttcctgtcattgatcgccacgacgccgttgtgcgcacctggaacgaaaacaccacgattcaagatgtggactaccccaacgaccgtgaaggcgcgacccttcgcgtgggactcggcgttggtcaaatggctggtggcgaagacggcctgctggtggtctctgatgaaatgggtggccaaattgccatctacaacgctgatgatgtcatccgacttcaaaatgaccgcccccaccgacgaggaacc

SEQ ID NO: 1040 - protein, 266 aa, Corynebacterium glutamicum
MRRRSRVSRLLPATALLASTALLLSACTQGVTDSPDMGKATPAVSPAASNPDGQVIEFGNITDMEVTDGDILGVRTEDALAIGTVSDFEAGSQVELDVDKQCGDLTATGGTFVLPCADGVYLIDAKDPDLDELRATDKPVTVAALTSDDQLLVGNGEDEELTIYREGEEPETFTVAGPNTQLIAVPVIDRHDAVVRTWNENTTIQDVDYPNDREGATLRVGLGVGQMAGGEDGLLVVSDEMGGQIAIYNADDVIRLQNDRPHRRGT

SEQ ID NO: 1041 - DNA, 859 bp, Corynebacterium glutamicum
  CDS (101)..(859): FRXA02207
gaatcggtgactttgccaacaccaatcacacaagcccttgatgatgtctccctgtgacttggtccaattacattcactggtaatctgaaaccttgtgaatatgcgccgtcgatcccgtgtgtcccgtttgcttcccgccacagctttgctggcctcaactgcacttcttttaagtgcatgtacgcaaggggtaacggactccccggatatgggcaaggcaactcccgctgtctcccccgcagcaagcaacccggatggccaagtaattgagttcggcaacatcactgacatggaagtcactgatggtgacatcctcggtgtacgcaccgaagacgcactcgctattggtacagtctccgacttcgaagcgggtagccaggtggaactggacgtcgataagcaatgcggcgacctgaccgcaaccggcggcactttcgtgctcccctgcgccgatggcgtttatttgattgatgccaaggacccggatctggatgagttgcgtgcaactgacaagccagtcacggtggcagccttgaccagcgatgatcagcttctggtgggcaatggtgaagatgaagaactcaccatctaccgcgagggcgaagagccagaaaccttcaccgtcgcgggtcccaatacccagctcatcgccgttcctgtcattgatcgccacgacgccgttgtgcgcacctggaacgaaaacaccacgattcaagatgtggactaccccaacgaccgtgaaggcgcgacccttcgcgtgggactcggcgttggtcaaatggctggtggcgaagacggcctgctggtggtctctgatgaaatgggtggccaaattgccatctacaacgctgatgatgtc

SEQ ID NO: 1042 - protein, 253 aa, Corynebacterium glutamicum
MRRRSRVSRLLPATALLASTALLLSACTQGVTDSPDMGKATPAVSPAASNPDGQVIEFGNITDMEVTDGDILGVRTEDALAIGTVSDFEAGSQVELDVDKQCGDLTATGGTFVLPCADGVYLIDAKDPDLDELRATDKPVTVAALTSDDQLLVGNGEDEELTIYREGEEPETFTVAGPNTQLIAVPVIDRHDAVVRTWNENTTIQDVDYPNDREGATLRVGLGVGQMAGGEDGLLVVSDEMGGQIAIYNADDV

SEQ ID NO: 1043 - DNA, 601 bp, Corynebacterium glutamicum
  CDS (101)..(601): RXN02223
cttgcttttgagggccgctacgcgcagctgtatcaacgatggagtgctcaatagttcaaatccaccacaaactctagagatttggggtagaaacgaagacatgagcacctaccaagacgatcgtttcccaggcccagacccctacgcaccgcttggtgaaaagccaagctttaccctcacctccaccgacttggaaaacggtgcaaagctggccgaagcccaactcggtggcaccgatatttccccacagctgtcctggtcagatcttccagaaggcaccaaatccctcgcgatcacctgcctcgacccagatgccccaaccggcgctggtttctggcactgggcagtgtttaacatccccacaactgtcacggagatccccaccggtgctggcgatgaaaccctcggcggcatcgaaggcgtagtttccctcaagggtgattccggcaagcgtggcttctacggagcgcaacctccagctggccacgcaccgcaccgttacctcttcgcagttcatgcacttgatgtggaaaaactcgacatcgcccccgacgctacccccactggtctaggcttcaacctgtatttccacactcttggc

SEQ ID NO: 1044 - protein, 167 aa, Corynebacterium glutamicum
MSTYQDDRFPGPDPYAPLGEKPSFTLTSTDLENGAKLAEAQLGGTDISPQLSWSDLPEGTKSLAITCLDPDAPTGAGFWHWAVFNIPTTVTEIPTGAGDETLGGIEGVVSLKGDSGKRGFYGAQPPAGHAPHRYLFAVHALDVEKLDIAPDATPTGLGFNLYFHTLG

SEQ ID NO: 1045 - DNA, 520 bp, Corynebacterium glutamicum
  CDS (101)..(520): FRXA02223
cttgcttttgagggccgctacgcgcagctgtatcaacgatggagtgctcaatagttcaaatccaccacaaactctagagatttggggtagaaacgaagacatgagcacctaccaagacgatcgtttcccaggcccagacccctacgcaccgcttggtgaaaagccaagctttaccctcacctccaccgacttggaaaacggtgcaaagctggccgaagcccaactcggtggcaccgatatttccccacagctgtcctggtcagatcttccagaaggcaccaaatccctcgcgatcacctgcctcgacccagatgccccaaccggcgctggtttctggcactgggcagtgtttaacatccccacaactgtcacggagatccccaccggtgctggcgatgaaaccctcggcggcatcgaaggcgtagtttccctcaagggtgattccggcaagcgtggcttctacggagcgcaacctccagctggccacgcaccgcaccgttacctcttcgcagttcatgca

SEQ ID NO: 1046 - protein, 140 aa, Corynebacterium glutamicum
MSTYQDDRFPGPDPYAPLGEKPSFTLTSTDLENGAKLAEAQLGGTDISPQLSWSDLPEGTKSLAITCLDPDAPTGAGFWHWAVFNIPTTVTEIPTGAGDETLGGIEGVVSLKGDSGKRGFYGAQPPAGHAPHRYLFAVHA

SEQ ID NO: 1047 - DNA, 1156 bp, Corynebacterium glutamicum
  CDS (101)..(1156): RXN02226
ctgacacctcctatggcacgcggtatgtttaataaacgtaattcgagtttcggcggccgtgtcgcgcggccaggacgaccctagcttttaaggacccaccatgactgagaaccagactcccagctccacctctgcaccgaagccgggacctcgcccgggcccacggccaggaccccgacctggggctcaggttgctgcaaagaaagctgcggttgctacacctgcgccgatcgccaaaacttctaacgatcctgcaaagtttggtcgcgttgaggcagacggatctgcatatgtcaccacctctgctggcgagcgtctgattggttcttggcaggccggcacccctgaggaaggtcttgctcactacggcgcccgttttgatgatctggccaccgaagttgagctcatggaacagcgcctaatctcccaccctgatgatgcgacctccatccgcacgaaggctgaagaactcaaggcaaccctgcccaccatcgctgcgatcggtgaccttgatggcgttgaagctcgcctgtccaagatcatcaacaactccgaggaagccaacgagcgcgccaaggaacaaaaggctaaaaaccgtgagcgcgcagtagctcgcaaggaagagctcgctgttgaggctgaaaccttggcagaaaactcctccgactggaaggttgctggcgaccgcatccgcgccatcctggatgagtggaagtccatccacggcatcgaccgcaagaccgatgatgaactgtggaaacgctactcccgtgcgcgtgactccttcaaccgtcgccgcggcgcacacttcgcagagctggatcgcacccgcgcatctgcacgcaaactcaaggaagaactcgttgagcgcgccaatgctctcaaggaatccactgagtggaacgacaccgcccgcgcattccgcgatctcatgaccgaatggaaagccgccggccgcgcaccacgcgaaatcgacgacaagctgtgggcagcattcaagggcgcccaggactacttctttgataagcgcaacgccgtagccaaggaacgcgaccaggaattcgaagccaacgcaaccgcaaagcagcagctcatcgacgaatacgacgcacagatcaaccccgagcagggcctcgatggagcgcgcagcaagctc

SEQ ID NO: 1048 - protein, 352 aa, Corynebacterium glutamicum
MTENQTPSSTSAPKPGPRPGPRPGPRPGAQVAAKKAAVATPAPIAKTSNDPAKFGRVEADGSAYVTTSAGERLIGSWQAGTPEEGLAHYGARFDDLATEVELMEQRLISHPDDATSIRTKAEELKATLPTIAAIGDLDGVEARLSKIINNSEEANERAKEQKAKNRERAVARKEELAVEAETLAENSSDWKVAGDRIRAILDEWKSIHGIDRKTDDELWKRYSRARDSFNRRRGAHFAELDRTRASARKLKEELVERANALKESTEWNDTARAFRDLMTEWKAAGRAPREIDDKLWAAFKGAQDYFFDKRNAVAKERDQEFEANATAKQQLIDEYDAQINPEQGLDGARSKL

SEQ ID NO: 1049 - DNA, 1156 bp, Corynebacterium glutamicum; identical to SEQ ID NO: 1047
  CDS (101)..(1156): FRXA02226

SEQ ID NO: 1050 - protein, 352 aa, Corynebacterium glutamicum; identical to SEQ ID NO: 1048

SEQ ID NO: 1051 - DNA, 408 bp, Corynebacterium glutamicum
  CDS (101)..(385): RXN02238
ggcgcttagccaaaacatagagcggtagggtatgcttatccgattgagcaacctttcccgctcttaacactactgtccatatacttttgaaaaggtgtcagtgaccaacgtgagcaacgagaccaacgccaccaaggccgtcttcgatccgccagtgggcattaccgctcctccgatcgatgaactgctggataaggtcacttccaagtacgccctcgtgatcttcgcagccaagcgtgcgcgccagatcaacagcttctaccatcaggcagatgagggagtattcgagttcatcggaccattggttactccgcagccaggcgaaaagccactttctattgctctgcgtgagatcaatgcaggtctgttggaccacgaggaaggttaaaagaccttataacttcacac

SEQ ID NO: 1052 - protein, 95 aa, Corynebacterium glutamicum
VTNVSNETNATKAVFDPPVGITAPPIDELLDKVTSKYALVIFAAKRARQINSFYHQADEGVFEFIGPLVTPQPGEKPLSIALREINAGLLDHEEG

SEQ ID NO: 1053 - DNA, 408 bp, Corynebacterium glutamicum; identical to SEQ ID NO: 1051
  CDS (101)..(385): FRXA02238

SEQ ID NO: 1054 - protein, 95 aa, Corynebacterium glutamicum; identical to SEQ ID NO: 1052

SEQ ID NO: 1055 - DNA, 800 bp, Corynebacterium glutamicum
  CDS (1)..(777): RXN02254
atcgccgttgccgaagaaggcggattgtgggaaaacctcctgcagcaccgcttcggtggacatggtgcgctagctggtcacgccttgggaaacctcgtgatcgcggcgttgaccgacattttgggcacctcccagcatgcgcttgatcaaatcgctcaactcgctggagccaaaggacgcatcatcccggtatgtgctgaacctttggatcttgaagcggaagtatcaggtctagactctgatgctcgagtcatgcgtcaagttcgtggtcaagtggcggtagctgcaacccccgggcaggtgcgacgcgttcgaatcattccggacaatccagaaccgaaccccgctgccatcgaggccattctcgatgcagatttggtcacccttggcccaggttcctggttctcctctgtgattccacacattttggtcccagggatcgttgatgccttggcgcagacaaaagcaaccaaaaccgtggtgttaaacctgacgtccgagccaggggagaccgcgggattctctgcagaacgacacatccatgtgctccgccagcatgctcgaaaccttcaggttgaccaagtcattgtcgatgccaagacactgtcctcacaaaccgaacgcaatcatgtagaacgagctgctcgcacccttggtgcagaagtctccttccatgatgtccaggctgaagatggccgtggtcgattcaccagtattcacgatccagcaaagctgtgtgcagcgttgctggcaagttttgctggagcacgaaagcgttaaggagtaggcgtgtcactgac

SEQ ID NO: 1056 - protein, 259 aa, Corynebacterium glutamicum
IAVAEEGGLWENLLQHRFGGHGALAGHALGNLVIAALTDILGTSQHALDQIAQLAGAKGRIIPVCAEPLDLEAEVSGLDSDARVMRQVRGQVAVAATPGQVRRVRIIPDNPEPNPAAIEAILDADLVTLGPGSWFSSVIPHILVPGIVDALAQTKATKTVVLNLTSEPGETAGFSAERHIHVLRQHARNLQVDQVIVDAKTLSSQTERNHVERAARTLGAEVSFHDVQAEDGRGRFTSIHDPAKLCAALLASFAGARKR

SEQ ID NO: 1057 - DNA, 804 bp, Corynebacterium glutamicum
  CDS (101)..(781): FRXA02254
ttgatcgccgatgccgaagaaggcggattgtgggaaaacctcctgcagcaccgcttcaggtggacatggtgcgctagctggtcacgccttgggaaacctcgtgatcgcggcgttgaccgacattttgggcacctcccagcatgcgcttgatcaaatcgctcaactcgctggagccaaaggacgcatcatcccggtatgtgctgaacctttggatcttgaagcggaagtatcaggtctagactctgatgctcgagtcatgcgtcaagttcgtggtcaagtggcggtagctgcaacccccgggcaggtgcgacgcgttcgaatcattccggacaatccagaaccgaaccccgctgccatcgaggccattctcgatgcagatttggtcacccttggcccaggttcctggttctcctctgtgattccacacattttggtcccagggatcgttgatgccttggcgcagacaaaagcaaccaaaaccgtggtgttaaacctgacgtccgagccaggggagaccgcgggattctctgcagaacgacacatccatgtgctccgccagcatgctcgaaaccttcaggttgaccaagtcattgtcgatgccaagacactgtcctcacaaaccgaacgcaatcatgtagaacgagctgctcgcacccttggtgcagaagtctccttccatgatgtccaggctgaagatggccgtggtcgattcaccagtattcacgatccagcaaagctgtgtgcagcgttgctggcaagttttgctggagcacgaaagcgttaaggagtaggcgtgtcactgac

SEQ ID NO: 1058 - protein, 227 aa, Corynebacterium glutamicum
VIAALTDILGTSQHALDQIAQLAGAKGRIIPVCAEPLDLEAEVSGLDSDARVMRQVRGQVAVAATPGQVRRVRIIPDNPEPNPAAIEAILDADLVTLGPGSWFSSVIPHILVPGIVDALAQTKATKTVVLNLTSEPGETAGFSAERHIHVLRQHARNLQVDQVIVDAKTLSSQTERNHVERAARTLGAEVSFHDVQAEDGRGRFTSIHDPAKLCAALLASFAGARKR

SEQ ID NO: 1059 - DNA, 681 bp, Corynebacterium glutamicum
  CDS (101)..(658): RXN02271
cactcccctatcctaagccacatctcggtttattaaactgttagtgaattctcacccgcaacactggtgtatttcagttacatccgtatggttattggttatgagctttcttaactctgcaaaaaccaagaccgtagccctcaccgcaaccttcgttggtgcagcaacccttgcaactcctgcaatcgcatccgctgacatcgtcgacaacgccctcgcagccctcccatccggtgagatcagctgctcccaggctgaaaagtactggaccaccgaagctgattacaacagcaaggttgcacaggccaacgccttggcaatgtttgactcccgcggcccacagatccaggcagctctcgcacgcgttgacgaagcagcaaaccgctgcggactcaagggcggcaccgtagctgcgcaggctgaggcaactgaggctgcgcctgccgctccagcacctgcaccgcaggataacaccggcacttctcagactgcccctgccccagcagcaccagcagcaccagcagctacccctgtggttaaccttgcacctgcaggatcaccaactttcaccattgaagttccaggagttggcggggttcagctgccagatctataccaaatcgtccaacagttcttggcacagttcggaatcaagatctaaatctattcacatcccttaac

SEQ ID NO: 1060 - protein, 186 aa, Corynebacterium glutamicum
MSFLNSAKTKTVALTATFVGAATLATPAIASADIVDNALAALPSGEISCSQAEKYWTTEADYNSKVAQANALAMFDSRGPQIQAALARVDEAANRCGLKGGTVAAQAEATEAAPAAPAPAPQDNTGTSQTAPAPAAPAAPAATPVVNLAPAGSPTFTIEVPGVGGVQLPDLYQIVQQFLAQFGIKI

SEQ ID NO: 1061 - DNA, 681 bp, Corynebacterium glutamicum; identical to SEQ ID NO: 1059
  CDS (101)..(658): FRXA02271

SEQ ID NO: 1062 - protein, 186 aa, Corynebacterium glutamicum; identical to SEQ ID NO: 1060

SEQ ID NO: 1063 - DNA, 1581 bp, Corynebacterium glutamicum
  CDS (101)..(1558): RXN02279
ggtaagagggcattttccgatgcgcagcgattcttgctcaacgccgacgagctcgcggagctttctgattatgagcgtctggcttatgccatcaccttgcttgatcagcctggaaaagaagcagaaggacgcgaactttttcctttcggagcttcgccgccagggctaccgcgctgtcgatttcttggaatcccagactgttgaccagctgaataaccccgatgtccagacttacctcaccgaagcggaactgattcgcgatgacttgaggtcttgggcagtcatcaatcaaatggcattggacaacatcgatcttgttccatacggcgaggaaaacgacgagccacttgcaatcgcccgcaagatcatcgaggaaaccgcttcccatcctgagctgagattcgaaaacctcgaggcccagttctccgagttcaccatcttgcttgctcaaagcccggagaacctcgacgtagcccgctaccaggagcttcgtacacagggaaactttgttcaagaactcgccttggacagcattttcggccaacatgccgttgttcaagacaccggaaacggcgaagccatcctagatgaaactatcgggtacatgatcggcgccggcatgcgtgaaaccactgcccgcaccgccagccagttcgcgcagctttactcatttgtgggcaggcaggaacgctccattgaaatggcacgactcgctttcgaggaacttcaagcggcaggacttccccaccgtgaggaagaactgcgattgggcatgcaactcgcccaggttgaaccaattgaagcccgcgaaatcctggaaaagctgctgctgcctaaattcgagcagaatctgacacttgatgaacttgaaactgaagcactccttcctttgggtgctaccgttgctatccacgacccccaggctgccgcagcaattttgcgccacgctcgcgaaaacgccgcagggttcggcaacttcgaactcgcagtccaagcgatgaccatgatcacggatgtcctctacacccaaaacatgcacgagcaactgctggaggagctcaaccactctctcccctatgctcaaatgcttgatgatcaacaccaagctgaactgaaactgctggacagcatcgccatcgtccaggcagacctcggttccaccgaagcgctggaaaccctgggcaccgcaatgggactcgcagaaaccacagctcagaagctatacgtgcaggaatccctcaaccgcgcatacttcacttttgcccgccctgaagattgcatcagcggagcagccgacgcttctgccctggccatgcaaaacgatgacccttccaatgcagctgcccagttggagcagtgtgcacagtacttgttccaattgggccacgaaactgacggcgcaagcctgctggaatctgcattcagggttgaaggcatccccactgagcaggcactgtactacgcaaatgcactgtcttccatctatgaagatttcggcgattccgcgaagtcgcagtactgggagcagcaggcgcaggaaaagcagcagcttctggagtaacggccgtttaaagagtcgaa

SEQ ID NO: 1064 - protein, 486 aa, Corynebacterium glutamicum
LISLEKKQKDANFFLSELRRQGYRAVDFLESQTVDQLNNPDVQTYLTEAELIRDDLRSWAVINQMALDNIDLVPYGEENDEPLAIARKIIEETASHPELRFENLEAQFSEFTILLAQSPENLDVARYQELRTQGNFVQELALDSIFGQHAVVQDTGNGEAILDETIGYMIGAGMRETTARTASQFAQLYSFVGRQERSIEMARLAFEELQAAGLPHREEELRLGMQLAQVEPIEAREILEKLLLPKFEQNLTLDELETEALLPLGATVAIHDPQAAAAILRHARENAAGFGNFELAVQAMTMITDVLYTQNMHEQLLEELNHSLPYAQMLDDQHQAELKLLDSIAIVQADLGSTEALETLGTAMGLAETTAQKLYVQESLNRAYFTFARPEDCISGAADASALAMQNDDPSNAAAQLEQCAQYLFQLGHETDGASLLESAFRVEGIPTEQALYYANALSSIYEDFGDSAKSQYWEQQAQEKQQLLE

SEQ ID NO: 1065 - DNA, 1427 bp, Corynebacterium glutamicum
  CDS (1)..(1404): FRXA02279
  misc_feature (1, 3): n = a, t, c, or g
  VARIANT (1): Xaa = Ala, Pro, Ser, or Thr
ncngccagggctaccgcgcttgtcgatttcttggaatcccagactgttgaccagctgaataaccccgatgtccagacttacctcaccgaagcggaactgattcgcgatgacttgaggtcttgggcagtcatcaaatcaaatggcattggacaacatcgatcttgttccatacggcgaggaaacgacgagccacttgcaatcgcccgcaagatcatcgaggaaaccgcttcccatcctgagctgagattcgaaaacctcgaggcccagttctccgagttcaccatcttgcttgctcaaagcccggagaacctcgacgtagcccgctaccaggagcttcgtacacagggaaactttgttcaagaactcgccttggacagcattttcggccaacatgccgttgttcaagacaccggaaacggcgaagccatcctagatgaaactatcgggtacatgatcggcgccggcatgcgtgaaaccactgcccgcaccgccagccagttcgcgcagctttactcatttgtgggcaggcaggaacgctccattgaaatggcacgactcgctttcgaggaacttcaagcggcaggacttccccaccgtgaggaagaactgcgattgggcatgcaactcgcccaggttgaaccaattgaagcccgcgaaatcctggaaaagctgctgctgcctaaattcgagcagaatctgacacttgatgaacttgaaactgaagcactccttcctttgggtgctaccgttgctatccacgacccccaggctgccgcagcaattttgcgccacgctcgcgaaaacgccgcagggttcggcaacttcgaactcgcagtccaagcgatgaccatgatcacggatgtcctctacacccaaaacatgcacgagcaactgctggaggagctcaaccactctctcccctatgctcaaatgcttgatgatcaacaccaagctgaactgaaactgctggacagcatcgccatcgtccaggcagacctcggttccaccgaagcgctggaaaccctgggcaccgcaatgggactcgcagaaaccacagctcagaagctatacgtgcaggaatccctcaaccgcgcatacttcacttttgcccgccctgaagattgcatcagcggagcagccgacgcttctgccctggccatgcaaaacgatgacccttccaatgcagctgcccagttggagcagtgtgcacagtacttgttccaattgggccacgaaactgacggcgcaagcctgctggaatctgcattcagggttgaaggcatccccactgagcaggcactgtactacgcaaatgcactgtcttccatctatgaagatttcggcgattccgcgaagtcgcagtactgggagcagcaggcgcaggaaaagcagcagcttctggagtaacggccgtttaaagagtcgaa

SEQ ID NO: 1066 - protein, 468 aa, Corynebacterium glutamicum
  VARIANT (1): Xaa = Ala, Pro, Ser, or Thr
XARATALVDFLESQTVDQLNNPDVQTYLTEAELIRDDLRSWAVIKSNGIGQHRSCSIRRGNDEPLAIARKIIEETASHPELRFENLEAQFSEFTILLAQSPENLDVARYQELRTQGNFVQELALDSIFGQHAVVQDTGNGEAILDETIGYMIGAGMRETTARTASQFAQLYSFVGRQERSIEMARLAFEELQAAGLPHREEELRLGMQLAQVEPIEAREILEKLLLPKFEQNLTLDELETEALLPLGATVAIHDPQAAAAILRHARENAAGFGNFELAVQAMTMITDVLYTQNMHEQLLEELNHSLPYAQMLDDQHQAELKLLDSIAIVQADLGSTEALETLGTAMGLAETTAQKLYVQESLNRAYFTFARPEDCISGAADASALAMQNDDPSNAAAQLEQCAQYLFQLGHETDGASLLESAFRVEGIPTEQALYYANALSSIYEDFGDSAKSQYWEQQAQEKQQLLE

SEQ ID NO: 1067 - DNA, 612 bp, Corynebacterium glutamicum
  CDS (101)..(589): RXN02296
gcatcatttgtgttgtttaaagtatatggctgttgaagtgccattttcgcggattagcatgggaatcaccagtatttctggacggttaaggatgattcatatgcgtaatcaaacaatcgctgcggtcgcagctttggtcctgctcaccgccgccacgcccgcgatcgctgccaccccggcgacagctggaaacggactctattccattgacatgggcgacgagcaaaagcttacctgcgtgcttttcgatgagccctccaccgaagcgcacgtcgtcgccagctgtgctgcgactttcccggtgacctggaagcttctcgacggcgctcacgaacaagccgcgaaacttgaaatcacccaggctcaagacggtgaactctcggtgacagccagcaagcagccgttgatcaccacgatgattgcgcccaccagcatcactaagcccatcactgtcaataggcttgtggttgttcctggtgagaatgaggttcgcttttatgctaccgatcctgatgttttaccagtgctgatcacgcctgactcctatgaagtgttgaccgattccgctgctaaagtgaaagcgacattatgaaataaacgtggatcaaggag

SEQ ID NO: 1068 - protein, 163 aa, Corynebacterium glutamicum
MRNQTIAAVAALVLLTAATPAIAATPATAGNGLYSIDMGDEQKLTCVLFDEPSTEAHVVASCAATFPVTWKLLDGAHEQAAKLEITQAQDGELSVTASKQPLITTMIAPTSITKPITVNRLVVVPGENEVRFYATDPDVLPVLITPDSYEVLTDSAAKVKATL

SEQ ID NO: 1069 - DNA, 612 bp, Corynebacterium glutamicum; identical to SEQ ID NO: 1067
  CDS (101)..(589): FRXA02296

SEQ ID NO: 1070 - protein, 163 aa, Corynebacterium glutamicum; identical to SEQ ID NO: 1068

SEQ ID NO: 1071 - DNA, 456 bp, Corynebacterium glutamicum
  CDS (101)..(433): RXN02300
gggtcattccggtgaacacggatttcgcgccggtgaatctgacggtcagccaattgcgggcaatgctgtccaaagcggagcgtaaagataaggatcagaaatgaaaacttatgcagtactaattgcggtggcagggttggcacttgctgggtgtagctcgtcggctcctggaatctggcgtgccactgaacccgcagatgcctaccttgaaatagccgatgacggcacgctgtccggaaccgacggctgcaacagactttttggtggctgggaaaaagacggctctaccatcactttcggcgccatcggtatgacagaaatgtactgcgaaggcgtcaacgattggctgtcccagatgcacaccgccaccgtcaccgatgccaccatgaccattttcaacgaggccggcagcaatattggcgagctaaaacgctaaatgcttctcgacgtcaaaag

SEQ ID NO: 1072 - protein, 111 aa, Corynebacterium glutamicum
MKTYAVLIAVAGLALAGCSSSAPGIWRATEPADAYLEIADDGTLSGTDGCNRLFGGWEKDGSTITFGAIGMTEMYCEGVNDWLSQMHTATVTDATMTIFNEAGSNIGELKR

SEQ ID NO: 1073 - DNA, 456 bp, Corynebacterium glutamicum; identical to SEQ ID NO: 1071
  CDS (101)..(433): FRXA02300

SEQ ID NO: 1074 - protein, 111 aa, Corynebacterium glutamicum; identical to SEQ ID NO: 1072

SEQ ID NO: 1075 - DNA, 840 bp, Corynebacterium glutamicum
  CDS (101)..(817): RXN02301
gcttcgcatatgtctggatcttattggatgtatgagtcagagatcagggagatcgcgcactaaccgaacctggccagtgcaacaggattatgtttaaagcatggatcttgcactggctcaggttgattccaccgtttcggggctttatgacgccctcgatctcatcggcgtgctgctgaacggaataatcggtggaacgatcgccaggcaacgaggctatgacatcattggctttctgttcctggcgttattttctgcgctgggtggcggaatgatccgtgacatgctgattcagcaggggactgtcgcggcgatcgataatcagatctaccttgcgctcgcgttttctggcgcgctgattgccatggcggtgaactttaaaggcagggtgtgggagctgtttaaagttcacggcgatgccattgtgttgggcgtctgggcggtgacgggttccgtgaaggcgatgaatgcgggggtggctccgctgccgagtattttcatgggcgtgctcaccgcggtgggtggtggcatggtgcgtgatgtggctactggccagacgccgacgatttttggtggcggaactctttacgctgtgcctgcgacgctttctgccacgtcaatggttatttttcatagctttgaccaggtaattctgggtatgattatttcaccgttcttgggtatcgcgttggcggttactgcgtattggtgcggttgggtcattccggtgaacacggatttcgcgccggtgaatctgacggtcagccaattgcgggcaatgctgtccaaagcggagcgtaaagataaggatcagaaatgaaaacttatgcagtactaatt

SEQ ID NO: 1076 - protein, 239 aa, Corynebacterium glutamicum
MDLALAQVDSTVSGLYDALDLIGVLLNGIIGGTIARQRGYDIIGFLFLALFSALGGGMIRDMLIQQGTVAAIDNQIYLALAFSGALIAMAVNFKGRVWELFKVHGDAIVLGVWAVTGSVKAMNAGVAPLPSIFMGVLTAVGGGMVRDVATGQTPTIFGGGTLYAVPATLSATSMVIFHSFDQVILGMIISPFLGIALAVTAYWCGWVIPVNTDFAPVNLTVSQLRAMLSKAERKDKDQK

SEQ ID NO: 1077 - DNA, 840 bp, Corynebacterium glutamicum; identical to SEQ ID NO: 1075
  CDS (101)..(817): FRXA02301

SEQ ID NO: 1078 - protein, 239 aa, Corynebacterium glutamicum; identical to SEQ ID NO: 1076

SEQ ID NO: 1079 - DNA, 1002 bp, Corynebacterium glutamicum
  CDS (101)..(979): RXN02302
ggccaggttcggttagtgcgcgatctccctgatctctgactcatacatccaataagatccagacatatgcgaagctaatgaaggaaacgaggagctgatagtggcaacaaatcgtacatcttccgctggtgtcatcacgtctgttctcgcatccgctttgttcggagcgatctttttcatctctggggcgattgaggcaaaggcggaaacacttgttgcttggcgtgtccttctaacagcggcatgctatttgcttgcccttctgcaccctgctggtcggaaggtgtttaaggaattttgggacacactaaggtcccaacctcgtcaaattctgtactttatcttcctcgttgtactcatcacgcttcagctgtggctgttttcttggtcgcctaagagtcatgctttagatgcctcacttggttacctgttactgcccattttcctagtaattgtggggcggtttttcttcgctgattacatcaccaggctgcagtggattgcggtgggaatcgcgctgatcgcagtaaccttgaaatttgtcattagtgcgcaattatcgtgggtaacttttgccatcgctgcgggttatgcactgtattttgcgcttcgtaaatactcggggctgaacaacgcttttgcttacggcgcagaagttttagcgttaagtcccctggcatttttcatgctcgccactgtcgaggatccgctgtctaacgccatgttgtcaatggttattctggcgggcctcgctggcgcattagctatggcgttgtatctagccgcctcaactctgcttagtatgccgatgtttggcctgctcagttatggtgaaccaatcttgctgtttgttgcagcactattacttggtgaaacgttgaatctcagcgacgccattgtctactcactactggcgtgcgccctggcgttactgggatttgatgggatacgaaggtctcgaaaaaacctcgagaccgattaacttctgctcaacttcccacc

SEQ ID NO: 1080 - protein, 293 aa, Corynebacterium glutamicum
VATNRTSSAGVITSVLASALFGAIFFISGAIEAKAETLVAWRVLLTAACYLLALLHPAGRKVFKEFWDTLRSQPRQILYFIFLVVLITLQLWLFSWSPKSHALDASLGYLLLPIFLVIVGRFFFADYITRLQWIAVGIALIAVTLKFVISAQLSWVTFAIAAGYALYFALRKYSGLNNAFAYGAEVLALSPLAFFMLATVEDPLSNAMLSMVILAGLAGALAMALYLAASTLLSMPMFGLLSYGEPILLFVAALLLGETLNLSDAIVYSLLACALALLGFDGIRRSRKNLETD

SEQ ID NO: 1081 - DNA, 865 bp, Corynebacterium glutamicum
  CDS (101)..(865): FRXA02302
ggccaggttcggttagtgcgcgatctccctgatctctgactcatacatccaataagatccagacatatgcgaagctaatgaaggaaacgaggagctgatagtggcaacaaatcgtacatcttccgctggtgtcatcacgtctgttctcgcatccgctttgttcggagcgatctttttcatctctggggcgattgaggcaaaggcggaaacacttgttgcttggcgtgtccttctaacagcggcatgctatttgcttgcccttctgcaccctgctggtcggaaggtgtttaaggaattttgggacacactaaggtcccaacctcgtcaaattctgtactttatcttcctcgttgtactcatcacgcttcagctgtggctgttttcttggtcgcctaagagtcatgctttagatgcctcacttggttacctgttactgcccattttcctagtaattgtggggcggtttttcttcgctgattacatcaccaggctgcagtggattgcggtgggaatcgcgctgatcgcagtaaccttgaaatttgtcattagtgcgcaattatcgtgggtaacttttgccatcgctgcgggttatgcactgtattttgcgcttcgtaaatactcggggctgaacaacgcttttgcttacggcgcagaagttttagcgttaagtcccctggcatttttcatgctcgccactgtcgaggatccgctgtctaacgccatgttgtcaatggttattctggcgggcctcgctggcgcattagctatggcgttgtatctagccgcctcaactctgcttagtatgccgatgtttggcctgctcagttatggtgaaccaatcttgctgtttgttgcagcactatta

SEQ ID NO: 1082 - protein, 255 aa, Corynebacterium glutamicum
VATNRTSSAGVITSVLASALFGAIFFISGAIEAKAETLVAWRVLLTAACYLLALLHPAGRKVFKEFWDTLRSQPRQILYFIFLVVLITLQLWLFSWSPKSHALDASLGYLLLPIFLVIVGRFFFADYITRLQWIAVGIALIAVTLKFVISAQLSWVTFAIAAGYALYFALRKYSGLNNAFAYGAEVLALSPLAFFMLATVEDPLSNAMLSMVILAGLAGALAMALYLAASTLLSMPMFGLLSYGEPILLFVAALL

SEQ ID NO: 1083 - DNA, 1029 bp, Corynebacterium glutamicum
  CDS (101)..(1006): RXN02303
gcccgggccgaaatcattccaatctcacccccacccaaaacactgttgatattttcactttccaaccagcgacgtgagcgcacgcactaaggttgtgcccatggctgaaaacaacaccccacaagaaactgaacaagatcaggaagcacgcttccgtgaggagttcgaggttggcggtaaggatcgtcagctttctgaagaagaacagctggagcagctcggatcgtatattgatgcgcactaccctgttccagatttcacgcccccttgggcaggtggcgccggcgatcctgatccagcagaccgctatattgcacatcttcccgatcgcaccacgcatactgcgatgatcatgttgggttctggccttgatcattccatgccgggtgtcgcatttatcggtggtgtgagcgtcgatgacgtcccggaggtcggaggcgcgattttccacccgtcgaatccgacgggccgctgggctgtatcgttccacagcggtggttggtggcgcggttccggtgatgcgttggagttccagtggcgtccagaggtcgcggcagctgcggaattgtccggcacaaccatccttgacctggactatccgctggccccaggccataacctccacgatatgaatgaggttgtgggcaaggcggtcggttacgcccgccaccataatccggtgtcgatcacgggttggggttattcctcgggcgcggcgttagccgcgattaatgcatcgcttttcgacgccctggtcctcacctttccggacctgggtagcgtcgagaagctccctgccgaaattcgtggagacgctgtagtgcccgcggcggctgcgtggccgacgacctttgtgcagatcgcggcgcaggatgagatcgcggagcggccaggagagcttggcgacgcgaccgtgaaggaatacgtttcccgccaccgtatttccacaccgaaggtcgcgcgcgaaaaaatcaccgacgtggcggagttccttaaaactgtttgctaatgtgccagcaggttgtaaat

SEQ ID NO: 1084 - protein, 302 aa, Corynebacterium glutamicum
MAENNTPQETEQDQEARFREEFEVGGKDRQLSEEEQLEQLGSYIDAHYPVPDFTPPWAGGAGDPDPADRYIAHLPDRTTHTAMIMLGSGLDHSMPGVAFIGGVSVDDVPEVGGAIFHPSNPTGRWAVSFHSGGWWRGSGDALEFQWRPEVAAAAELSGTTILDLDYPLAPGHNLHDMNEVVGKAVGYARHHNPVSITGWGYSSGAALAAINASLFDALVLTFPDLGSVEKLPAEIRGDAVVPAAAAWPTTFVQIAAQDEIAERPGELGDATVKEYVSRHRISTPKVAREKITDVAEFLKTVC

SEQ ID NO: 1085 - DNA, 743 bp, Corynebacterium glutamicum
  CDS (1)..(720): FRXA02303
gatcctgatccagcagaccgctatattgcacatcttcccgatcgcaccacgcatactgcgatgatcatgttgggttctggccttgatcattccatgccgggtgtcgcatttatcggtggtgtgagcgtcgatgacgtcccggaggtcggaggcgcgattttccacccgtcgaatccgacgggccgctgggctgtatcgttccacagcggtggttggtggcgcggttccggtgatgcgttggagttccagtggcgtccagaggtcgcggcagctgcggaattgtccggcacaaccatccttgacctggactatccgctggccccaggccataacctccacgatatgaatgaggttgtgggcaaggcggtcggttacgcccgccaccataatccggtgtcgatcacgggttggggttattcctcgggcgcggcgttagccgcgattaatgcatcgcttttcgacgccctggtcctcacctttccggacctgggtagcgtcgagaagctccctgccgaaattcgtggagacgctgtagtgcccgcggcggctgcgtggccgacgacctttgtgcagatcgcggcgcaggatgagatcgcggagcggccaggagagcttggcgacgcgaccgtgaaggaatacgtttcccgccaccgtatttccacaccgaaggtcgcgcgcgaaaaaatcaccgacgtggcggagttccttaaaactgtttgctaatgtgccagcaggttgtaaat

SEQ ID NO: 1086 - protein, 240 aa, Corynebacterium glutamicum
DPDPADRYIAHLPDRTTHTAMIMLGSGLDHSMPGVAFIGGVSVDDVPEVGGAIFHPSNPTGRWAVSFHSGGWWRGSGDALEFQWRPEVAAAAELSGTTILDLDYPLAPGHNLHDMNEVVGKAVGYARHHNPVSITGWGYSSGAALAAINASLFDALVLTFPDLGSVEKLPAEIRGDAVVPAAAAWPTTFVQIAAQDEIAERPGELGDATVKEYVSRHRISTPKVAREKITDVAEFLKTVC

SEQ ID NO: 1087 - DNA, 744 bp, Corynebacterium glutamicum
  CDS (101)..(721): RXN02307
ttttgcattaaccccaggtaggggcattgtcgcaaagcccaactacagcaaggtgcgtacgctggtggccaactgaatacgtttgaggagaaggttttctatgagtggcaccgccatcatgtacgacacgacagttgttccatcgaagaaagaaatcgcgcaggcttggactggttatgtggatcttcagggaagctaccgcctggtagatacggtggatggggaagttggcgttgaggtgctgatttccaaggatcgggaggggcgtttactccagattccgtttagttatcgttcggcagagattaacccagagcagacactttccacattggagcatggtgtgttgggcaagcgttgggtgactaatgcgttgggtgacccggtggcagtgcgggagtttattcgcactattttgacgggcgatgatggtgcagctcgtagcgatggcgtgaagggctatctggatattaaaggttccggcgatgctgagtcggtggatttacaggatgtaaagcttactgaggttacaaggcagcgtgcgattggttcggtaaccatcaacggtgagcgaaagcaattctcgctgcggttgcctcagttgctgaagaatttcagggagacagccgcgggccatacagctacgactcttcgtattgtggcgactcatccggaaaaggacgatgttgagctgctggtcgctgagttcaactggatggaataatccgagacagctcctgaaag

SEQ ID NO: 1088 - protein, 207 aa, Corynebacterium glutamicum
MSGTAIMYDTTVVPSKKEIAQAWTGYVDLQGSYRLVDTVDGEVGVEVLISKDREGRLLQIPFSYRSAEINPEQTLSTLEHGVLGKRWVTNALGDPVAVREFIRTILTGDDGAARSDGVKGYLDIKGSGDAESVDLQDVKLTEVTRQRAIGSVTINGERKQFSLRLPQLLKNFRETAAGHTATTLRIVATHPEKDDVELLVAEFNWME

SEQ ID NO: 1089 - DNA, 490 bp, Corynebacterium glutamicum
  CDS (101)..(490): FRXA02307
ttttgcattaaccccaggtaggggcattgtcgcaaagcccaactacagcaaggtgcgtacgctggtggccaactgaatacgtttgaggagaaggttttctatgagtggcaccgccatcatgtacgacacgacagttgttccatcgaagaaagaaatcgcgcaggcttggactggttatgtggatcttcagggaagctaccgcctggtagatacggtggatggggaagttggcgttgaggtgctgatttccaaggatcgggaggggcgtttactccagattccgtttagttatcgttcggcagagattaacccagagcagacactttccacattggagcatggtgtgttgggcaagcgttgggtgactaatgcgttgggtgacccggtggcagtgcgggagtttattcgcactattttgacgggcgatgatggtgcagctcgtagcgatggcgtgaagggctatctggatattaaaggttccggcgatgct

SEQ ID NO: 1090 - protein, 130 aa, Corynebacterium glutamicum
MSGTAIMYDTTVVPSKKEIAQAWTGYVDLQGSYRLVDTVDGEVGVEVLISKDREGRLLQIPFSYRSAEINPEQTLSTLEHGVLGKRWVTNALGDPVAVREFIRTILTGDDGAARSDGVKGYLDIKGSGDA

SEQ ID NO: 1091 - DNA, 564 bp, Corynebacterium glutamicum
  CDS (101)..(541): RXN02314
tgataccaccgaagtatccggattcaccattattgaagcttcgaccgtccgagatacccgccgtgcacaacagcaagctctcatggacacggtgcactaaatggagtggtaccaagtgcgccgacgggcccgacaactgctcattgtcctttttatagcagcgatgctcggagcagcctccatggtgatcgggccattccttaacgaccgcactatcgaaggcaactccgggcgcgccttggcacaagtaaccaacgtcggcagctaccgcacaacggtggatttccaagatgaaaacggcatctatcactcaccagccaccggcctgttgttccccacgggactgggcgaggggcaacgcgtgtgggtgaactacgccaaatcagatccagacctggtcaaagtagaaggccgcaagtggacactgtccatcatcccagcgcttagtgtcgcagctgtcgccaccgctacctggtcagtactatggctgggagtgggcagattcggaagacgatccgacgacgccaacgaaaccacagtgtaaagctctatgccgggagcatt

SEQ ID NO: 1092 - protein, 147 aa, Corynebacterium glutamicum
MEWYQVRRRARQLLIVLFIAAMLGAASMVIGPFLNDRTIEGNSGRALAQVTNVGSYRTTVDFQDENGIYHSPATGLLFPTGLGEGQRVWVNYAKSDPDLVKVEGRKWTLSIIPALSVAAVATATWSVLWLGVGRFGRRSDDANETTV

SEQ ID NO: 1093 - DNA, 564 bp, Corynebacterium glutamicum; identical to SEQ ID NO: 1091
  CDS (101)..(541): FRXA02314

SEQ ID NO: 1094 - protein, 147 aa, Corynebacterium glutamicum; identical to SEQ ID NO: 1092

SEQ ID NO: 1095 - DNA, 1446 bp, Corynebacterium glutamicum
  CDS (101)..(1423): RXN02337
cacaaggtaaaatttgtgtaattgtgtcgtgtggatttgaaggtttttgtaaatctagttaaatcatgaggtcataagcttttcgggaggttgtcaaaggatgtcgaagctttacgcgggggcaaggatcaatgcactgcgccgaacccatcagctcacccaatcagcattggccgacaagcttgatctctccaccagctatctcaaccagttggaaaatgacggacggccactcactgccacggtgcttctgcagctgatgaaagtgttcgatgttgaggccagttacttctcccctgaccggggtacggccactgctacccgactggctgaaaccttggcgatgaatcagggtccgacgatgtcgatggatgatcttttagatttcgcggatcgtttccctcagttagcgcagcatattatccagcctgctgaggttgatcccacgcatagttctgcgcatgattttgttcgggattattttgccacccacaaaaactacattgattcgctcgatcgccttggagaggagttggcaactgccattggtcagccgggacttcgggttactaggctcgcgcagttgcttgatgcggagtacaacatcacggtgcgtttccgggcgccggatattactggccggaggcactttgatccccaatcgcgtcagattctgctgcggcaagatctcagcgaggcgcagcagtgtttccagttggcggaggaattgacgtttcttgctcatgcagagctcttggataccctgaccacagatcaaccggatctcccttctgaggcagctatccgcctggctaaggtgggtctctcccaatatttcgcggctgctgttgtcatgccgtacacccgctttttggaattcgcccaggataagcactatgacatcgagttgatctctgaggcgtttggagtgtctttcgagtctgcatgccaccgcctgtctactctgcagcgttcgggggcgtcaggggtgccgtttttctttgtgcgctcggatcgtgcaggaaatatctccaagcggcaatctgcagctacgttccacttctcgcgaacagacggcacttgtcctttgtgggcgctgcatcgtgcttttgaacgtcagggaaacatcacccgccaggttgctcgcatgccggatggccggacctatttgtggctcgcacgcgcggtgaaaggtcgaactcatggtttcgggtatcctgctgcggaattcgccatcggcctgggctgcgatatcagcgaggcaccaggcttggtgtattcccaaggccttaatttggatcccgagtccgccgcagagatcggccctggttgtcggatctgtcctcgggagaactgtgtgcagcgtgcattcccaccatcgggtcaagaatctatccgcccagcccctgtccaactcctcaactaaaaaggcagcacttaaaaaac

SEQ ID NO: 1096 - protein, 441 aa, Corynebacterium glutamicum
MSKLYAGARINALRRTHQLTQSALADKLDLSTSYLNQLENDGRPLTATVLLQLMKVFDVEASYFSPDRGTATATRLAETLAMNQGPTMSMDDLLDFADRFPQLAQHIIQPAEVDPTHSSAHDFVRDYFATHKNYIDSLDRLGEELATAIGQPGLRVTRLAQLLDAEYNITVRFRAPDITGRRHFDPQSRQILLRQDLSEAQQCFQLAEELTFLAHAELLDTLTTDQPDLPSEAAIRLAKVGLSQYFAAAVVMPYTRFLEFAQDKHYDIELISEAFGVSFESACHRLSTLQRSGASGVPFFFVRSDRAGNISKRQSAATFHFSRTDGTCPLWALHRAFERQGNITRQVARMPDGRTYLWLARAVKGRTHGFGYPAAEFAIGLGCDISEAPGLVYSQGLNLDPESAAEIGPGCRICPRENCVQRAFPPSGQESIRPAPVQLLN

SEQ ID NO: 1097 - DNA, 1024 bp, Corynebacterium glutamicum
  CDS (101)..(1024): FRXA02337
cacaaggtaaaatttgtgtaattgtgtcgtgtggatttgaaggtttttgtaaatctagttaaatcatgaggtcataagcttttcgggaggttgtcaaaggatgtcgaagctttacgcgggggcaaggatcaatgcactgcgccgaacccatcagctcacccaatcagcattggccgacaagcttgatctctccaccagctatctcaaccagttggaaaatgacggacggccactcactgccacggtgcttctgcagctgatgaaagtgttcgatgttgaggccagttacttctcccctgaccggggtacggccactgctacccgactggctgaaaccttggcgatgaatcagggtccgacgatgtcgatggatgatcttttagatttcgcggatcgtttccctcagttagcgcagcatattatccagcctgctgaggttgatcccacgcatagttctgcgcatgattttgttcgggattattttgccacccacaaaaactacattgattcgctcgatcgccttggagaggagttggcaactgccattggtcagccgggacttcgggttactaggctcgcgcagttgcttgatgcggagtacaacatcacggtgcgtttccgggcgccggatattactggccggaggcactttgatccccaatcgcgtcagattctgctgcggcaagatctcagcgaggcgcagcagtgtttccagttggcggaggaattgacgtttcttgctcatgcagagctcttggataccctgaccacagatcaaccggatctcccttctgaggcagctatccgcctggctaaggtgggtctctcccaatatttcgcggctgctgttgtcatgccgtacacccgctttttggaattcgcccaggataagcactatgacatcgagttgatctctgaggcgtttggagtgtctttcgagtctgcatgccaccgcctgtctactctgcagcgttcgggggcgtcaggggtgccgtttttctttgtgcgctcggatcgtgcagga

SEQ ID NO: 1098 - protein, 308 aa, Corynebacterium glutamicum
MSKLYAGARINALRRTHQLTQSALADKLDLSTSYLNQLENDGRPLTATVLLQLMKVFDVEASYFSPDRGTATATRLAETLAMNQGPTMSMDDLLDFADRFPQLAQHIIQPAEVDPTHSSAHDFVRDYFATHKNYIDSLDRLGEELATAIGQPGLRVTRLAQLLDAEYNITVRFRAPDITGRRHFDPQSRQILLRQDLSEAQQCFQLAEELTFLAHAELLDTLTTDQPDLPSEAAIRLAKVGLSQYFAAAVVMPYTRFLEFAQDKHYDIELISEAFGVSFESACHRLSTLQRSGASGVPFFFVRSDRAG

SEQ ID NO: 1099 - DNA, 515 bp, Corynebacterium glutamicum
  CDS (1)..(492): RXN02339
cccaccgacaacctcttttcatatcctgcacaacgctatgatcttctcacacttgcctttgaagttaggattggggacatggttcaaattaatgacatgcttgcccctcctccagtaaaacttccggaagatcctgccctcggcgccgatccaactttgacctcgacagcgattgcgcatcctgacagcccattggtgtgggcgtaccgagctgaaaatcttatcaaatctgcatcaaatgatgaagagaagattcaggcctacgcttttgcgcgcacgggttaccaccgcagtctcgatcgtctgcgtgccaatggttggaagggttggggtcctgtccccttctctcatgagccaaaccagggagtgttgcgggctatcgcttccctagctcttgctgcgaagctgattggtgaggacaacgaatacgatcgttgccgccagatgctctctgatgcggatccagagtccgtcgcagtcctactcgacaaataaaccaccaaaaataaaacaat

SEQ ID NO: 1100 - protein, 164 aa, Corynebacterium glutamicum
PTDNLFSYPAQRYDLLTLAFEVRIGDMVQINDMLAPPPVKLPEDPALGADPTLTSTAIAHPDSPLVWAYRAENLIKSASNDEEKIQAYAFARTGYHRSLDRLRANGWKGWGPVPFSHEPNQGVLRAIASLALAAKLIGEDNEYDRCRQMLSDADPESVAVLLDK

SEQ ID NO: 1101 - DNA, 515 bp, Corynebacterium glutamicum; identical to SEQ ID NO: 1099
  CDS (1)..(492): FRXA02339

SEQ ID NO: 1102 - protein, 164 aa, Corynebacterium glutamicum; identical to SEQ ID NO: 1100

SEQ ID NO: 1103 - DNA, 1188 bp, Corynebacterium glutamicum
  CDS (101)..(1165): RXN02340
aaaacgtgtctaaaaattcagtttttattgctgctgatcacctcttgaagaactcaacccaaaagtgcttcaagttatgagaaagtgaaatccaacacccatgaaaaagagcatcgttgtatttgaagtcgaaggcggctccgacaagcacttcgacggtcaccgtaaagacaccatgcctatcgtcaactccataaatgatgctggctggcaggcagaggttgtgtactaccgcccagagtggaccgaaggtctctttgagtacgtatctgaaaacttcgacggctacatctcacgtgtcaacccaggcaacatcccaggcggcgagcgcggctactttgacctgctcacccgcctgtccgaagcagggctcgtgggcatgtccacccctgaggaaatgatggcatacggcgcgaaagatgcgctggtcaagctatcccaaaccgacctggtgccatccgacaccgaggcgtactacgacgtggagaccttccacaaggttttcccaacctccctgtccttcggtgagcgcgtgctcaagcaaaaccgtggctccaccggctccggcatttggcgcgtccagttggtagacaaggaactggctgcatccatcgagccaggcaccgcactgccattggacactgaaatcaagtgcaccgaagcagtcgacaaccacactgaagtccgcaagctcggcgagttcatggatttctgtgaccagtacatcatcggcgacaacggcatgctcgttgatatgcgtttcatgccacgcatcgtcgaaggcgaaatccgcatccttctcgtcggaccacacccagtgttcgtcgtgcacaagaagccagcagaaggcggcgacaacttctccgcaaccctgttctccggcgcgaagtacacctacgacaagccagagcagtggcaggaactgattgacctcttcgcagacgctcgcccagtcatcgcagaaaagctcggcggcgacaacatcccattgatctggaccgcagacttcatgctcggcgatgtcgttgacggcaaggacacctacgtgctcggtgaaatcaactgctcctgcgtcggcttcacctccgagctggacatgggcatccagcagcttgtggcatcagaggccatcaagcgcatcgaggaattcgcgcagcttactgtttaaaactttgcttctcgacgtct

SEQ ID NO: 1104 - protein, 355 aa, Corynebacterium glutamicum
MKKSIVVFEVEGGSDKHFDGHRKDTMPIVNSINDAGWQAEVVYYRPEWTEGLFEYVSENFDGYISRVNPGNIPGGERGYFDLLTRLSEAGLVGMSTPEEMMAYGAKDALVKLSQTDLVPSDTEAYYDVETFHKVFPTSLSFGERVLKQNRGSTGSGIWRVQLVDKELAASIEPGTALPLDTEIKCTEAVDNHTEVRKLGEFMDFCDQYIIGDNGMLVDMRFMPRIVEGEIRILLVGPHPVFVVHKKPAEGGDNFSATLFSGAKYTYDKPEQWQELIDLFADARPVIAEKLGGDNIPLIWTADFMLGDVVDGKDTYVLGEINCSCVGFTSELDMGIQQLVASEAIKRIEEFAQLTV

SEQ ID NO: 1105 - DNA, 580 bp, Corynebacterium glutamicum
  CDS (101)..(580): FRXA02338
aaaacgtgtctaaaaattcagtttttattgctgctgatcacctcttgaagaactcaacccaaaagtgcttcaagttatgagaaagtgaaatccaacacccatgaaaaagagcatcgttgtatttgaagtcgaaggcggctccgacaagcacttcgacggtcaccgtaaagacaccatgcctatcgtcaactccataaatgatgctggctggcaggcagaggttgtgtactaccgcccagagtggaccgaaggtctctttgagtacgtatctgaaaacttcgacggctacatctcacgtgtcaacccaggcaacatcccaggcggcgagcgcggctactttgacctgctcacccgcctgtccgaagcagggctcgtgggcatgtccacccctgaggaaatgatggcatacggcgcgaaagatgcgctggtcaagctatcccaaaccgacctggtgccatccgacaccgaggcgtactacgacgtggagaccttccacaaggttttcccaacctccctgtccttcggtgaagcgcgtgctcaagcaaaaacctggcttcaccggcttccgcatttggcgcgt

SEQ ID NO: 1106 - protein, 160 aa, Corynebacterium glutamicum
MKKSIVVFEVEGGSDKHFDGHRKDTMPIVNSINDAGWQAEVVYYRPEWTEGLFEYVSENFDGYISRVNPGNIPGGERGYFDLLTRLSEAGLVGMSTPEEMMAYGAKDALVKLSQTDLVPSDTEAYYDVETFHKVFPTSLSFGEARAQAKTWLHRLPHLAR

SEQ ID NO: 1107 - DNA, 662 bp, Corynebacterium glutamicum
  CDS (1)..(639): FRXA02340
gagcgcgtgctcaagcaaaaccgtggctccaccggctccggcatttggcgcgtccagttggtagacaaggaactggctgcatccatcgagccaggcaccgcactgccattggacactgaaatcaagtgcaccgaagcagtcgacaaccacactgaagtccgcaagctcggcgagttcatggatttctgtgaccagtacatcatcggcgacaacggcatgctcgttgatatgcgtttcatgccacgcatcgtcgaaggcgaaatccgcatccttctcgtcggaccacacccagtgttcgtcgtgcacaagaagccagcagaaggcggcgacaacttctccgcaaccctgttctccggcgcgaagtacacctacgacaagccagagcagtggcaggaactgattgacctcttcgcagacgctcgcccagtcatcgcagaaaagctcggcggcgacaacatcccattgatctggaccgcagacttcatgctcggcgatgtcgttgacggcaaggacacctacgtgctcggtgaaatcaactgctcctgcgtcggcttcacctccgagctggacatgggcatccagcagcttgtggcatcagaggccatcaagcgcatcgaggaattcgcgcagcttactgtttaaaactttgcttctcgacgtct

SEQ ID NO: 1108 - protein, 213 aa, Corynebacterium glutamicum
ERVLKQNRGSTGSGIWRVQLVDKELAASIEPGTALPLDTEIKCTEAVDNHTEVRKLGEFMDFCDQYIIGDNGMLVDMRFMPRIVEGEIRILLVGPHPVFVVHKKPAEGGDNFSATLFSGAKYTYDKPEQWQELIDLFADARPVIAEKLGGDNIPLIWTADFMLGDVVDGKDTYVLGEINCSCVGFTSELDMGIQQLVASEAIKRIEEFAQLTV

SEQ ID NO: 1109 - DNA, 609 bp, Corynebacterium glutamicum
  CDS (101)..(586): RXN02341
cgcgactggcggagaaattcgtgttcgcgatgcttcgggcaccgttcacaccctcaacgccggtgaaattacgcaccttcgcctgcagtaaggtgacggtatggggaattcacttgagaaacatattgcagagggagaccggatccacgtcgatctgacatctcctttatccgcaatgttgttccccatttttgaactcattgtgattactggaatctgttggatgggcatcggctttttggatcagcttccaggaatcgatggcaccaaccccgccgatagcttccccgaaggcacccgcaatcttctagtgggtgtgtgggcagtacttgctgcatggcgtttcggtcttcctttaataaggcaacgtcgactccgcgtgatcttgagcgaccgcaaactgctggtccgacgcgcgggtctgcgcaccgggttcgattccattccactgagctacattcagcgagtccaacgtcggcgaaacaccctggtcttaggtgttggtggacaccaccgaccctatgtaatcaaccaggttcccaaggctcgaaaagtggaagcgctgctcaaagatcttacattttggtgaaggcgttatagttaggactt

SEQ ID NO: 1110 - protein, 162 aa, Corynebacterium glutamicum
MGNSLEKHIAEGDRIHVDLTSPLSAMLFPIFELIVITGICWMGIGFLDQLPGIDGTNPADSFPEGTRNLLVGVWAVLAAWRFGLPLIRQRRLRVILSDRKLLVRRAGLRTGFDSIPLSYIQRVQRRRNTLVLGVGGHHRPYVINQVPKARKVEALLKDLTFW

SEQ ID NO: 1111 - DNA, 511 bp, Corynebacterium glutamicum
  CDS (101)..(511): FRXA02341
cgcgactggcggagaaattcgtgttcgcgatgcttcgggcaccgttcacaccctcaacgccggtgaaattacgcaccttcgcctgcagtaaggtgacggtatggggaattcacttgagaaacatattgcagagggagaccggatccacgtcgatctgacatctcctttatccgcaatgttgttccccatttttgaactcattgtgattactggaatctgttggatgggcatcggctttttggatcagcttccaggaatcgatggcaccaaccccgccgatagcttccccgaaggcacccgcaatcttctagtgggtgtgtgggcagtacttgctgcatggcgtttcggtcttcctttaataaggcaacgtcgactccgcgtgatcttgagcgaccgcaaactgctggtccgacgcgcgggtctgcgcaccgggttcgattccattccactgagctacattcagcgagtccaacgtcggcgaaacaccctggtcttaggtgttggtggacac

SEQ ID NO: 1112 - protein, 137 aa, Corynebacterium glutamicum
MGNSLEKHIAEGDRIHVDLTSPLSAMLFPIFELIVITGICWMGIGFLDQLPGIDGTNPADSFPEGTRNLLVGVWAVLAAWRFGLPLIRQRRLRVILSDRKLLVRRAGLRTGFDSIPLSYIQRVQRRRNTLVLGVGGH

SEQ ID NO: 1113 - DNA, 2556 bp, Corynebacterium glutamicum
  CDS (101)..(2533): RXN02360
aagtaactaaagttcgaaagtatttccgaacggtgtcggcctctgcgcatacactgtatttttaaagaaaattcttctcaattctaagggtgaatatccaatgcgtggtgacgttcaaaaaataaccaaggtttatgacggcaagcaccgaaccttggaaatcccggtttatcaacgcaattacgactggactgaaaagcaatgttcacgcctctttgatgacctcagcgaagtggtcaaagaaaaccaccgtcaacatttttttggagctgtggttggtaagcctcaaggcagctggacctgggttgtcatcgatggacagcagcgtcttacaacaatcagcttgttcatgcttgcgctggtacattccttgcgcgcatctgaagttgaagaaggtgagtttaatgctggctacaacattgatctagccacattgattgaggatgactacctccgatccggcaatgagggaaacctcaagttcaagctcaagccagttaaaaacgataatgaggcttatcaaaagctcttcggcccagaatctgaattcatagagtcctcaaacctcactgctaattatcgctacttccgcaatgtccttaaggcaaccgatctcaccgcagctcaactatgggaagctatcgagaaactcagggtcatgtatcttgaccttgaggaatttgatgatccgcagcgaatctttgaaagtctcaactccacgggattagagctcagtgaagctgataaggtacgcaacttggttcttatggatcaggagctcaaaacccaagaaaagctctatgagcagcgttggaatcccattgaagtctgcgtgaaatttgataccgacaatttcattcgctggtacttaactctcaaaaccgcgcgcaccccaagaaagcaagatgtttatgaggaattcaagaaattcatccgtaactccaagctcccggtcgaattcatcctcgacgatatgtacgagtacgcgaagctgtaccgagatctcttaggtgccactactgggtttatagctgccgataggtgtcttaagcgttttgtccctgtcatgggcgatgtggttttgccttttctgctgcctgttctcaaagatgctaaagacggcatcatcaccgaatcagacttcctcggagttctaaaagttctggaatcctatttattccgccgttttgcagtcggggttgctagtaacgccttaagcaagatcttctccactgcttatagcgacatcaagaaattctggactccagggcaaagttatagctcactgctggcctacattctgaaacgtcgcgatggttccgggcgttttccctccgacagtgaattccgtgagaacttcgcaaccaaaaatttctggaatattcataacgaaaacaggcgttacttatttgattgtctagaaaatgccgattccaatgatgttcgtgacatccaaacaagtctggatgaaggatctctctccattgaacacatcatgccacgtagcctaaacgatcagtggagagctgaactcggccctgaatatgctcgaattcatgagacttggattaatagaattggtaacctcaccatcaccggctacaactccgcctattcaaattcttcctatgagcgcaagcggacgatggaaaatggatttttggtatccccctatcgcatcaataatttcatcaaaaagcagaagcattggtctgaagaacagctaattgagcgaaccgagctgctcactcaagcagcgctggactactggccccttccaaaagaaaccttccagccaccacaagctgtgcttcctacagaatccttagatagtgatctttctttccgcggacgcgaaattgtcgcctttgaatatgaggactacaaggaaacggtaacgtcctgggcagacatgctccagagcgttctaaaagtcttgaaccaatccttccgccaggaactcatagctttgaccaatgaagaaatctgcctggcaacttcaaacaacagtaacagcagtctccgtgaaattgaccacgggctttttgtagacactggctctagtacgagtgtaaagattggcttcctccgcagagtttttactcaactggggctagagcaggaagcattggttttcacccttcgaccactggcaaatgatgtagaaccccgagatgatgaactcgaggtagaggtagaaaagaaatattccgatttgactaaattcatcccacagttagaagaagctgagaatctcgagggggcggatacagaggttattcctctcctctcaaagctcaaggaacaactgacagcctttagcccggagaatcctcaagcagccctagggggcctacctgttccagaattcctcaaacaaaatgtgattgaacaactaagcgcagagcacatccttgctgtactcactcaacactttaatatcgcatccatgatgggtgatgactatttgctcgaagagctcaggtcaggccgcttaagggaattactgcagcgtttagaggaattggatagctaatagccgtagtcggtggtcaa

SEQ ID NO: 1114 - protein, 811 aa, Corynebacterium glutamicum
MRGDVQKITKVYDGKHRTLEIPVYQRNYDWTEKQCSRLFDDLSEVVKENHRQHFFGAVVGKPQGSWTWVVIDGQQRLTTISLFMLALVHSLRASEVEEGEFNAGYNIDLATLIEDDYLRSGNEGNLKFKLKPVKNDNEAYQKLFGPESEFIESSNLTANYRYFRNVLKATDLTAAQLWEAIEKLRVMYLDLEEFDDPQRIFESLNSTGLELSEADKVRNLVLMDQELKTQEKLYEQRWNPIEVCVKFDTDNFIRWYLTLKTARTPRKQDVYEEFKKFIRNSKLPVEFILDDMYEYAKLYRDLLGATTGFIAADRCLKRFVPVMGDVVLPFLLPVLKDAKDGIITESDFLGVLKVLESYLFRRFAVGVASNALSKIFSTAYSDIKKFWTPGQSYSSLLAYILKRRDGSGRFPSDSEFRENFATKNFWNIHNENRRYLFDCLENADSNDVRDIQTSLDEGSLSIEHIMPRSLNDQWRAELGPEYARIHETWINRIGNLTITGYNSAYSNSSYERKRTMENGFLVSPYRINNFIKKQKHWSEEQLIERTELLTQAALDYWPLPKETFQPPQAVLPTESLDSDLSFRGREIVAFEYEDYKETVTSWADMLQSVLKVLNQSFRQELIALTNEEICLATSNNSNSSLREIDHGLFVDTGSSTSVKIGFLRRVFTQLGLEQEALVFTLRPLANDVEPRDDELEVEVEKKYSDLTKFIPQLEEAENLEGADTEVIPLLSKLKEQLTAFSPENPQAALGGLPVPEFLKQNVIEQLSAEHILAVLTQHFNIASMMGDDYLLEELRSGRLRELLQRLEELDS

SEQ ID NO: 1115 - DNA, 2556 bp, Corynebacterium glutamicum; identical to SEQ ID NO: 1113
  CDS (101)..(2533): FRXA02360

SEQ ID NO: 1116 - protein, 811 aa, Corynebacterium glutamicum; identical to SEQ ID NO: 1114

SEQ ID NO: 1117 - DNA, 774 bp, Corynebacterium glutamicum
  CDS (101)..(751): RXN02361
tagaggaattggatagctaatagccgtagtcggtggtcaaactttgaccaccggactcccctttaagcacaatctctagcttttatttaggcttggagttatggaacttctctcccacttgcttgctcttgatcctgcctcccctcgtttgactgtttataacgagtccacgggtgcgcgtttggatttctccgccatcactcttgataactgggcgtccaaggttggcaatatgctccttgaggaattggatctggaggaaggctcgctcatcactattgatttgccggtgagctggcaggccgcaatgattatgctcggcgctttagcaactagtgttgaggtctcttttgatgatcccgaggcagatgccatctttacctccctcgatagattttcccactacaagggccatagtgatgtgctgattgtcagcgaggatccttttggtcgtggagttgttgaaggtggcggtgaactgcctaatggtgccatcgattttggccccacagtgcgtttttatggcgatcaattcttccagcctacccgcacattgccggaaatcatccagcattctgatgttccggttggcgccagagttcttgcaactggttggtcagatatcgagtccttcaatcaccaggttttagaaccactcgcagtgggtggctctgcagtaattgtgaccggactggctgatattgagcgtttaaaccagattgcaaccaatgagaagacaacccaccgtatctaggcaaatttcggttactacta

SEQ ID NO: 1118 - protein, 217 aa, Corynebacterium glutamicum
MELLSHLLALDPASPRLTVYNESTGARLDFSAITLDNWASKVGNMLLEELDLEEGSLITIDLPVSWQAAMIMLGALATSVEVSFDDPEADAIFTSLDRFSHYKGHSDVLIVSEDPFGRGVVEGGGELPNGAIDFGPTVRFYGDQFFQPTRTLPEIIQHSDVPVGARVLATGWSDIESFNHQVLEPLAVGGSAVIVTGLADIERLNQIATNEKTTHRI

SEQ ID NO: 1119 - DNA, 774 bp, Corynebacterium glutamicum; identical to SEQ ID NO: 1117
  CDS (101)..(751): FRXA02361

SEQ ID NO: 1120 - protein, 217 aa, Corynebacterium glutamicum; identical to SEQ ID NO: 1118

SEQ ID NO: 1121 - DNA, 732 bp, Corynebacterium glutamicum
  CDS (101)..(709): RXN02367
ggcacttgaatccggacgctaagttgttgatacatcaacttatttcttggctatacttgaggtcacgtttcctcagctcaggagaagttcggagaagtccatgtcaaacgcagaaattaatcccgttgaatatgaaatcaacaaccacgcccctggtaccgcgctaaacccacagtgcgaagacggcgccaacgtagaaatcatcacctcccgtgaagtccccctcggcggaccacgcgccatgaccgtgcaccgcacactcccccaacgccagcgctccctcatcggtgcctggtgttttgtggatcattacggccccgatgatgtctcactaaccggtggcatggatatggcctcccacccgcacaccggattgcaaacagtcacgtggctttttgaaggcgaagtcacccaccatgattccggcggaaatcacgcagtcgtgcttcctggcgaagtcaacctcatgaccgccggcgcaggcatctgtcacaccgaagtttccgccacctccaccacgattctgcatggtctgcagttgtggacagttcttcccgacaaagaccgcgaaggaccacgccgctttgatcactacgctccagaagaaatcacactcgaaggcggaagtgcacgcgttttcctaggttcgctatttggtcaaacctcccctgttcatacgtttactggctcttcctgttttagagtgcattgatcttatggaccaactgccct

SEQ ID NO: 1122 - protein, 203 aa, Corynebacterium glutamicum
MSNAEINPVEYEINNHAPGTALNPQCEDGANVEIITSREVPLGGPRAMTVHRTLPQRQRSLIGAWCFVDHYGPDDVSLTGGMDMASHPHTGLQTVTWLFEGEVTHHDSGGNHAVVLPGEVNLMTAGAGICHTEVSATSTTILHGLQLWTVLPDKDREGPRRFDHYAPEEITLEGGSARVFLGSLFGQTSPVHTFTGSSCFRVH

SEQ ID NO: 1123 - DNA, 732 bp, Corynebacterium glutamicum; identical to SEQ ID NO: 1121
  CDS (101)..(709): FRXA02367

SEQ ID NO: 1124 - protein, 203 aa, Corynebacterium glutamicum; identical to SEQ ID NO: 1122

SEQ ID NO: 1125 - DNA, 798 bp, Corynebacterium glutamicum
  CDS (101)..(775): RXN02368
cttaggtcaagcttgcatttattggctagtgtcggaaatcatgggagatttagcaaagcacatgggcagtgaaccaccagcatggtggaagtttttaccgatgattgtcctcgctggagccactcgagttacctatgaagtagaaccttggctggcgatcccattattcattttggcttttgcatcgatattgatcccattcccgatctctaagacaaaaggactccgtgatatcgatgcctggaaaatccacaccacgcaaggcgataaaaagcgtgccatccgccaactgatcattccggctacggctttggccatcgacatcattgggctgccgacattatttaatgcccctccccttgcttccgctgcactttttggcggtgtttacggcgcttccctagcttgggctgcgtacagagctgatcagcttccacgcattcgaacgaaggaacgcctcgcagaactttcacaaaatgcatctctggatgatgtgcgctcagatgacttagatgttctagagcagccggaatcccgtgaattagtgcgctgtctgcttgcccacggtgcgatggatggcactcgggtgatggccagacaggtcgcgcgagtactggataccgaggtagacgaagtacatcaggtagcacgctcactagaacagcatggtttggttagtcgctccaccatcatgccgggtggggatccaggaaaagtattcatcgaagtttccctgaaagggatctcagccatcaaggcacttgaatccggacgctaagttgttgatacatcaactta

SEQ ID NO: 1126 - protein, 225 aa, Corynebacterium glutamicum
MIVLAGATRVTYEVEPWLAIPLFILAFASILIPFPISKTKGLRDIDAWKIHTTQGDKKRAIRQLIIPATALAIDIIGLPTLFNAPPLASAALFGGVYGASLAWAAYRADQLPRIRTKERLAELSQNASLDDVRSDDLDVLEQPESRELVRCLLAHGAMDGTRVMARQVARVLDTEVDEVHQVARSLEQHGLVSRSTIMPGGDPGKVFIEVSLKGISAIKALESGR

SEQ ID NO: 1127 - DNA, 798 bp, Corynebacterium glutamicum; identical to SEQ ID NO: 1125
  CDS (101)..(775): FRXA02368

SEQ ID NO: 1128 - protein, 225 aa, Corynebacterium glutamicum; identical to SEQ ID NO: 1126

SEQ ID NO: 1129 - DNA, 1146 bp, Corynebacterium glutamicum
  CDS (101)..(1123): RXN02381
aagtttgaagaagtaatcaagctcccctgtgaggactcgttgtagtcttttatttagttaataaaagatttcataccaacttgtcagcaggggagctttcatgtctgtcacaaacttccgtcggtttcttgctggcatagcggtcatcgcggcgtgtgttgctgcgactccaacagctcaggcacaaagcagtggctcttctggatcctctggttcttcagcgggatctagcgggctgtgggatttactttttccagaatcccatgagtcttttatcgagcggcttcttgatcctttggatgacagccatatatctattcaccctgacctcaccccagacctgtatgaagaggtgtttgatccaccgcaaattggtgaatgcccagccgttgttgctgtggtcgcacgaggcagtgaacaaaaccttcaaatccgacccgcgcgatacagcgaggaatctccatggacatccaatggatttgaggaaaaaaactttcgtagtttctttggccgaatggaaaaacactaccgtgaatcgactggcgagtcgttgatgaaagacgtctacgtgatgggtctgaataatatcgaataccctgcttctttgccactgtcttcggagggaagcagcgccattgaattgggcacttccatttctagtggtcgcgacaatgtcatcagcgcgattgatcgctttgaatcagcgacagggtgcacgccgaagtacctgttggcgggttattctcaaggtgtcctcatcgttgatggctatgaagaggagttgattgcgagggatcagtacctcggcaccctgcacatcgcgaatccagcgcaacaagttgatgatccaacacttgttgggcatgaagtaaccacgggaggcttggctagttccgtggagcccgtcgaggacaatcctttcaaggtgagctactgcctgcctggagacatcgtgtgcgatcgttcttttgaacagttctctgctgcgggatcctctatagcagctgcgcaattgagcaccggaaatatccgtccaggtcgagtacacgtgcaatacttcgttaccacccaaccgtgggatgagcagatttttgacgaagtcgcatcgtggattgaagctgcctaaaaactcgcgaggacgcatgc

SEQ ID NO: 1130 - protein, 341 aa, Corynebacterium glutamicum
MSVTNFRRFLAGIAVIAACVAATPTAQAQSSGSSGSSGSSAGSSGLWDLLFPESHESFIERLLDPLDDSHISIHPDLTPDLYEEVFDPPQIGECPAVVAVVARGSEQNLQIRPARYSEESPWTSNGFEEKNFRSFFGRMEKHYRESTGESLMKDVYVMGLNNIEYPASLPLSSEGSSAIELGTSISSGRDNVISAIDRFESATGCTPKYLLAGYSQGVLIVDGYEEELIARDQYLGTLHIANPAQQVDDPTLVGHEVTTGGLASSVEPVEDNPFKVSYCLPGDIVCDRSFEQFSAAGSSIAAAQLSTGNIRPGRVHVQYFVTTQPWDEQIFDEVASWIEAA

SEQ ID NO: 1131 - DNA, 1146 bp, Corynebacterium glutamicum; identical to SEQ ID NO: 1129
  CDS (101)..(1123): FRXA02381

SEQ ID NO: 1132 - protein, 341 aa, Corynebacterium glutamicum; identical to SEQ ID NO: 1130

SEQ ID NO: 1133 - DNA, 736 bp, Corynebacterium glutamicum
  CDS (101)..(736): RXN02383
gggcaacaatgtggaaaacgcccagtggtatcttgacggctggaacatgggtgttacgcagtaaagaagatggcaataaaaatgtggaggagtaaaggcgatgccagttcgggtaattgttgattcctccgcatgcttgccaacgcatgtggccgaggacctcgacatcacggtgattaacttgcacgtgatgaataacggtgaagaacgcagtacatccgggttgtcgtcgttggaacttgcagcaagttacgcccgccagcttgaacgcggtggcgatgacggtgtgcttgcgctgcatatttctaaagagctctcgtccacgtggtccgcagcggtgacagcagccgctgtgtttgatgatgattctgtgcgcgtggtggataccagttcgctcggtatggctgtgggtgctgccgcgatggctgctgcccgcatggctaaagatggcgcgtctttgcaggaatgctacgacatcgcggtggataccttgaagcgttcagaaacctggatctacctgcaccgcattgatgaaatctggaagtcgggacggatttccactgcaaccgccatggtgtcaacggctctggcaacccgccccatcatgcgtttcaacggtggtcgcatggagatcgccgctaagacccgcacccaatctaaagcgtttgccaaattggtggaattagcccagatcagggcagatggtgaacccgtattcattgcgattggccaaaac

SEQ ID NO: 1134 - protein, 212 aa, Corynebacterium glutamicum
MPVRVIVDSSACLPTHVAEDLDITVINLHVMNNGEERSTSGLSSLELAASYARQLERGGDDGVLALHISKELSSTWSAAVTAAAVFDDDSVRVVDTSSLGMAVGAAAMAAARMAKDGASLQECYDIAVDTLKRSETWIYLHRIDEIWKSGRISTATAMVSTALATRPIMRFNGGRMEIAAKTRTQSKAFAKLVELAQIRADGEPVFIAIGQN

SEQ ID NO: 1135 - DNA, 703 bp, Corynebacterium glutamicum
  CDS (101)..(703): FRXA02383
gggcaacaatgtggaaaacgcccagtggtatcttgacggctggaacatgggtgttacgcagtaaagaagatggcaataaaaatgtggaggagtaaaggcgatgccagttcgggtaattgttgattcctccgcatgcttgccaacgcatgtggccgaggacctcgacatcacggtgattaacttgcacgtgatgaataacggtgaagaacgcagtacatccgggttgtcgtcgttggaacttgcagcaagttacgcccgccagcttgaacgcggtggcgatgacggtgtgcttgcgctgcatatttctaaagagctctcgtccacgtggtccgcagcggtgacagcagccgctgtgtttgatgatgattctgtgcgcgtggtggataccagttcgctcggtatggctgtgggtgctgccgcgatggctgctgcccgcatggctaaagatggcgcgtctttgcaggaatgctacgacatcgcggtggataccttgaagcgttcagaaacctggatctacctgcaccgcattgatgaaatctggaagtcgggacggatttccactgcaaccgccatggtgtcaacggctctggcaacccgccccatcatgcgtttcaacggtggtcgcatggagatcgccgctaagacccgcacccaatctaaagcgtttgccaaattggtggaattagcccagatcagggcagat

SEQ ID NO: 1136 - protein, 201 aa, Corynebacterium glutamicum
MPVRVIVDSSACLPTHVAEDLDITVINLHVMNNGEERSTSGLSSLELAASYARQLERGGDDGVLALHISKELSSTWSAAVTAAAVFDDDSVRVVDTSSLGMAVGAAAMAAARMAKDGASLQECYDIAVDTLKRSETWIYLHRIDEIWKSGRISTATAMVSTALATRPIMRFNGGRMEIAAKTRTQSKAFAKLVELAQIRAD

SEQ ID NO: 1137 - DNA, 885 bp, Corynebacterium glutamicum
  CDS (101)..(862): RXN02387
gctagccccgattcgcttcaggtcaccaccttgaaggccagcgaaattactcagggtgaattgttggatgcgttaagcccatccttgtttgctgaagaccgtgtggtggtgcttaccaacatggatcaaagcaggccaagatgctgtagatctagccttatccgcagcagttgatcccagccctggtacctacttgatcgtcatgcactctggcggtggacgctctaagtcgatggtgaagaagctggaaaaagtcgcggtggtgcacgatgccgcaaagctgaaagaccgggatcgtccaggttgggtaaaacaagagttcaaaaaccacaaagtccaggtcaccccagatgtcattcatgctcttttagagggcgtgggttcagatcttagagagctggcgtccgccgtatcccaattggttgaggacacccaaggcaacgtgacggtggaaaaagtccgtgcctattacgtgggtgttgctgaggtatcgggtttcgacatcgccgattctgcatgcgccggtcaaatgtcaaaggccgtggccagcaccagacgtgcccttcaattgggtaccagcccggttgcattggcagctgcgttgagtatgaaagttggccagatcgccaggctgtattccaccaggggacgcatcaacggttttgagctggccaaagaattgggcatgccgccgttcgtggtggagaagactgcgaaagtggcccgaaactggtcgggagatgcggtcagcgaggccgtgattttgatggccgatctggatgccgctgtaaaaggacaaagtggcgatcctgaatttgccatcgaatctgccgtgagaagagttgcagagctggcgaggcggtaacgctgaacggcggcgggtaa

SEQ ID NO: 1138 - protein, 254 aa, Corynebacterium glutamicum
VWWCLPTWIKAGQDAVDLALSAAVDPSPGTYLIVMHSGGGRSKSMVKKLEKVAVVHDAAKLKDRDRPGWVKQEFKNHKVQVTPDVIHALLEGVGSDLRELASAVSQLVEDTQGNVTVEKVRAYYVGVAEVSGFDIADSACAGQMSKAVASTRRALQLGTSPVALAAALSMKVGQIARLYSTRGRINGFELAKELGMPPFVVEKTAKVARNWSGDAVSEAVILMADLDAAVKGQSGDPEFAIESAVRRVAELARR

SEQ ID NO: 1139 - DNA, 778 bp, Corynebacterium glutamicum
  CDS (101)..(778): FRXA02387
gctagccccgattcgcttcaggtcaccaccttgaaggccagcgaaattactcagggtgaattgttggatgcgttaagcccatccttgtttgctgaagaccgtgtggtggtgcttaccaacatggatcaaagcaggccaagatgctgtagatctagccttatccgcagcagttgatcccagccctggtacctacttgatcgtcatgcactctggcggtggacgctctaagtcgatggtgaagaagctggaaaaagtcgcggtggtgcacgatgccgcaaagctgaaagaccgggatcgtccaggttgggtaaaacaagagttcaaaaaccacaaagtccaggtcaccccagatgtcattcatgctcttttagagggcgtgggttcagatcttagagagctggcgtccgccgtatcccaattggttgaggacacccaaggcaacgtgacggtggaaaaagtccgtgcctattacgtgggtgttgctgaggtatcgggtttcgacatcgccgattctgcatgcgccggtcaaatgtcaaaggccgtggccagcaccagacgtgcccttcaattgggtaccagcccggttgcattggcagctgcgttgagtatgaaagttggccagatcgccaggctgtattccaccaggggacgcatcaacggttttgagctggccaaagaattgggcatgccgccgttcgtggtggagaagactgcgaaagtggcccgaaactggtcgggagatgcggtcagcgaggccgtgattttgatggccgatctg

SEQ ID NO: 1140 - protein, 226 aa, Corynebacterium glutamicum
VWWCLPTWIKAGQDAVDLALSAAVDPSPGTYLIVMHSGGGRSKSMVKKLEKVAVVHDAAKLKDRDRPGWVKQEFKNHKVQVTPDVIHALLEGVGSDLRELASAVSQLVEDTQGNVTVEKVRAYYVGVAEVSGFDIADSACAGQMSKAVASTRRALQLGTSPVALAAALSMKVGQIARLYSTRGRINGFELAKELGMPPFVVEKTAKVARNWSGDAVSEAVILMADL

SEQ ID NO: 1141 - DNA, 1725 bp, Corynebacterium glutamicum
  CDS (101)..(1702): RXN02398
gtgtccaatgaatgcgttcaataaatgccctctttaagcatattctctgagtgcattcattacaggcgttaattaaatgcgttcatagaagaacttgaaagtggttgaagtgaagaagcgtaatctcctcgtagctcccctcactgcttccctggtgttctgtaacttggctgttgcagcaaacgccgttgaagttgaggccgaatcaccagttgtcatcaatgaagttgaatccaacagcgacccagttggtgactgggtggagttggctaacaccgacaacaacaactccatcgacatttccggttggtccttagtcgatgacaaggaagacctggaaaatgccctcgtccttcctgaaggcactgagattgagtccggtggatactttgttatctacaccgactctgctgattacgtgcctaccaacaacacctttggtggccaggaatacttcggcctcggcaaagatgacactgttactctgcgcaacgctgaaggcgaagtagttgctacctattcctggaaggatctgggcgagcacgcagaaaacacctatggtcgcatcccagatatgactggtgatttcgcaaacaccggcgttccaaccccaggtgcaaagaatgttgctgctgaaggctccggcgaagaagaaggcgttgttgcaaacgcccagcttccattccacaacgttgaaatcaccccaattcacctcggtggagatttcaccggtgaagatatgtccggcgttgatttcgatgcaaacagcaccgcatggatcgccaacaatgacattggaaagatctactccctcgcccacgacatagctaacaacacctacaagctgactggcgaatgggaaaccggctacccagaaggcggcggagagccagacgctgaaggcatcgtcgcagctaccaacggtgacatctacctgtccaccgagcgcaacaacgctgacaagaacgtctctcgcccatccatcctgcgttttgctaccccaactggcaagactggcgtacaaaacgcagttcaggaatgggacctgtctgagttcgtcggcgacattcagcccaatggtggtcttgaggcaatcgcgcagctcgaggacaacatcttcgttgtcggtgtcgaagagacaggtgatgtcatcgttgttgatctttccgctgaccagccagttctggttcaaaggtacgaatcttccttcgacggtgtcatgtcgcttgattacaacgcagcaaccaagcagctcagcgttgtgtgcgacgaagcatgtgacggcttgtctgaaatcctcgaatgggatggcgagaagctgtacaagtccgacgacaagatctacgagcgtccagcaaacctgggcaactgggctaacgaaggcttcggcacctacacctcagagcttaaatgcgagaacggcaacaccgtttctgtcaccagctacctctgggctgacgatgcagcaaccaacgaaggcacctccctcaactccgcacaggtcatcaacggagattgcggcgacgtcaacatccctggagagtcctcttccgacaattcctcttctgactttgcaaccggcagcatcgcaggcgcctttgcaaccgcagtgctcgcagtcgtaggcattgcgggcgcactgggtggattcttccagcagatcctcgcagcgttcccagcattgcagcaggtcatccgtttctaaacccactgcttgaaacactt

SEQ ID NO: 1142 - protein, 534 aa, Corynebacterium glutamicum
VVEVKKRNLLVAPLTASLVFCNLAVAANAVEVEAESPVVINEVESNSDPVGDWVELANTDNNNSIDISGWSLVDDKEDLENALVLPEGTEIESGGYFVIYTDSADYVPTNNTFGGQEYFGLGKDDTVTLRNAEGEVVATYSWKDLGEHAENTYGRIPDMTGDFANTGVPTPGAKNVAAEGSGEEEGVVANAQLPFHNVEITPIHLGGDFTGEDMSGVDFDANSTAWIANNDIGKIYSLAHDIANNTYKLTGEWETGYPEGGGEPDAEGIVAATNGDIYLSTERNNADKNVSRPSILRFATPTGKTGVQNAVQEWDLSEFVGDIQPNGGLEAIAQLEDNIFVVGVEETGDVIVVDLSADQPVLVQRYESSFDGVMSLDYNAATKQLSVVCDEACDGLSEILEWDGEKLYKSDDKIYERPANLGNWANEGFGTYTSELKCENGNTVSVTSYLWADDAATNEGTSLNSAQVINGDCGDVNIPGESSSDNSSSDFATGSIAGAFATAVLAVVGIAGALGGFFQQILAAFPALQQVIRF

SEQ ID NO: 1143 - DNA, 1630 bp, Corynebacterium glutamicum
  CDS (101)..(1630): FRXA02398
gtgtccaatgaatgcgttcaataaatgccctctttaagcatattctctgagtgcattcattacaggcgttaattaaatgcgttcatagaagaacttgaaagtggttgaagtgaagaagcgtaatctcctcgtagctcccctcactgcttccctggtgttctgtaacttggctgttgcagcaaacgccgttgaagttgaggccgaatcaccagttgtcatcaatgaagttgaatccaacagcgacccagttggtgactgggtggagttggctaacaccgacaacaacaactccatcgacatttccggttggtccttagtcgatgacaaggaagacctggaaaatgccctcgtccttcctgaaggcactgagattgagtccggtggatactttgttatctacaccgactctgctgattacgtgcctaccaacaacacctttggtggccaggaatacttcggcctcggcaaagatgacactgttactctgcgcaacgctgaaggcgaagtagttgctacctattcctggaaggatctgggcgagcacgcagaaaacacctatggtcgcatcccagatatgactggtgatttcgcaaacaccggcgttccaaccccaggtgcaaagaatgttgctgctgaaggctccggcgaagaagaaggcgttgttgcaaacgcccagcttccattccacaacgttgaaatcaccccaattcacctcggtggagatttcaccggtgaagatatgtccggcgttgatttcgatgcaaacagcaccgcatggatcgccaacaatgacattggaaagatctactccctcgcccacgacatagctaacaacacctacaagctgactggcgaatgggaaaccggctacccagaaggcggcggagagccagacgctgaaggcatcgtcgcagctaccaacggtgacatctacctgtccaccgagcgcaacaacgctgacaagaacgtctctcgcccatccatcctgcgttttgctaccccaactggcaagactggcgtacaaaacgcagttcaggaatgggacctgtctgagttcgtcggcgacattcagcccaatggtggtcttgaggcaatcgcgcagctcgaggacaacatcttcgttgtcggtgtcgaagagacaggtgatgtcatcgttgttgatctttccgctgaccagccagttctggttcaaaggtacgaatcttccttcgacggtgtcatgtcgcttgattacaacgcagcaaccaagcagctcagcgttgtgtgcgacgaagcatgtgacggcttgtctgaaatcctcgaatgggatggcgagaagctgtacaagtccgacgacaagatctacgagcgtccagcaaacctgggcaactgggctaacgaaggcttcggcacctacacctcagagcttaaatgcgagaacggcaacaccgtttctgtcaccagctacctctgggctgacgatgcagcaaccaacgaaggcacctccctcaactccgcacaggtcatcaacggagattgcggcgacgtcaacatccctggagagtcctcttccgacaattcctcttctgactttgcaaccggcagcatcgcaggcgcctttgcaaccgcagtgctcgcagtcgtaggcatt

SEQ ID NO: 1144 - protein, 510 aa, Corynebacterium glutamicum
VVEVKKRNLLVAPLTASLVFCNLAVAANAVEVEAESPVVINEVESNSDPVGDWVELANTDNNNSIDISGWSLVDDKEDLENALVLPEGTEIESGGYFVIYTDSADYVPTNNTFGGQEYFGLGKDDTVTLRNAEGEVVATYSWKDLGEHAENTYGRIPDMTGDFANTGVPTPGAKNVAAEGSGEEEGVVANAQLPFHNVEITPIHLGGDFTGEDMSGVDFDANSTAWIANNDIGKIYSLAHDIANNTYKLTGEWETGYPEGGGEPDAEGIVAATNGDIYLSTERNNADKNVSRPSILRFATPTGKTGVQNAVQEWDLSEFVGDIQPNGGLEAIAQLEDNIFVVGVEETGDVIVVDLSADQPVLVQRYESSFDGVMSLDYNAATKQLSVVCDEACDGLSEILEWDGEKLYKSDDKIYERPANLGNWANEGFGTYTSELKCENGNTVSVTSYLWADDAATNEGTSLNSAQVINGDCGDVNIPGESSSDNSSSDFATGSIAGAFATAVLAVVGI

SEQ ID NO: 1145 - DNA, 672 bp, Corynebacterium glutamicum
  CDS (101)..(649): RXN02406
cactctgatagccttttctctgaaattgtaccgagcatttgattttgttcccctatcaatgctggttttggtgacaaaaactcggcggaaggaccaccgaatggaaacccttgcagcacaagcgcgcaccctgctagaaaaatggggcgtcgcgccgacgcacgcatctttcgtcgaatccattgcaaaggccatcccgattctgtcgatcctgctgacgctgattgtcaccgtgaatggaatttcaagcggaaatccggtccagccaccagcactggaacaggtacggaccgatgtagtgaacaagatcaactacgaacgcaacctaaagggcctcgtctcgatcagcccggagcttgaattacacacggcagcccaaacaattgcgcagcgaaatgcagactcagattccgaagaaaaagtaccggatccagagggcaacctggtggttctgcaacagaatctgccctatgcaaatgccaacgccgataccatcgttgatcggttcttaaactctcctgatcatgtcaaactactgcttgcaaacgattatgaagccatcggagttggtgtggcctacaagggtgatcatgcgtggatagtggtggagttcactgtagctcccgctgattccgtagaatcaacagagtgaataccaatccgtctgaattc

SEQ ID NO: 1146 - protein, 183 aa, Corynebacterium glutamicum
METLAAQARTLLEKWGVAPTHASFVESIAKAIPILSILLTLIVTVNGISSGNPVQPPALEQVRTDVVNKINYERNLKGLVSISPELELHTAAQTIAQRNADSDSEEKVPDPEGNLVVLQQNLPYANANADTIVDRFLNSPDHVKLLLANDYEAIGVGVAYKGDHAWIVVEFTVAPADSVESTE

SEQ ID NO: 1147 - DNA, 672 bp, Corynebacterium glutamicum
  CDS (101)..(649): FRXA02406
cactctgatagccttttctctgaaattgtaccgagcatttgattttgttcccctatcaatgctggttttggtgacaaaaactcggcggaaggaccaccgaatggaaacccttgcagcacaagcgcgcaccctgctagaaaaatggggcgtcgcgccgacgcacgcatctttcgtcgaatccattgcaaaggccatcccgattctgtcgatcctgctgacgctgattgtcaccgtgaatggaatttcaagcggaaatccggtccagccaccagcactggaacaggtacggaccgatgtagtgaacaagatcaactacgaacgcaacctaaagggcctcgtctcgatcagcccggagcttgaattacacacggcagcccaaacaattgcgcagcgaaatgcagactcagattccgaagaaaaagtaccggatccagagggaaccttggtggttctgcaacagaatctgccctatgcaaatgccaacgccgataccatcgttgatcggttcttaaactctcctgatcatgtcaaactactgcttgcaaacgattatgaagccatcggagttggtgtggcctacaagggtgatcatgcgtggatagtggtggagttcactgtagctcccgctgattccgtagaatcaacagagtgaataccaatccgtctgaattc

SEQ ID NO: 1148 - protein, 183 aa, Corynebacterium glutamicum
METLAAQARTLLEKWGVAPTHASFVESIAKAIPILSILLTLIVTVNGISSGNPVQPPALEQVRTDVVNKINYERNLKGLVSISPELELHTAAQTIAQRNADSDSEEKVPDPEGTLVVLQQNLPYANANADTIVDRFLNSPDHVKLLLANDYEAIGVGVAYKGDHAWIVVEFTVAPADSVESTE

SEQ ID NO: 1149 - DNA, 495 bp, Corynebacterium glutamicum
  CDS (101)..(472): RXN02407
ggataaaaatttggatgacatatcacctaagcttgcaatttctactggaatagcgcgactactctgcaccaacgcatagttgttgactaggctatttgtcatgaataggcaaaaccaacttcactacccgcaggaagtgaaggcagtggaaagtgtggaatcaagcttgaacatgtcgtcaccttctgcaccgcttgccacgccagatgttgagcttgatgtgcacacgttgtcgagcgaaaacctgccttggttgtgcatcgtgtgggatgatccggtcaatttgatgagctatgtcacctacgtttttcagactgtgttgggcttcagtaagaagagggccactgagctgatgatgcaggtgcacaccgaaggtaaagccgtggtgagttctggcgagaaggacaaagtggagggtgatgtgaagaaactccacaccgcagggctgtgggcgacaatgcagcaggcagggtaggggagaattttcatgcagca

SEQ ID NO: 1150 - protein, 124 aa, Corynebacterium glutamicum
MNRQNQLHYPQEVKAVESVESSLNMSSPSAPLATPDVELDVHTLSSENLPWLCIVWDDPVNLMSYVTYVFQTVLGFSKKRATELMMQVHTEGKAVVSSGEKDKVEGDVKKLHTAGLWATMQQAG

SEQ ID NO: 1151 - DNA, 406 bp, Corynebacterium glutamicum
  CDS (101)..(406): FRXA02407
ggataaaaatttggatgacatatcacctaagcttgcaatttctactggaatagcgcgactactctgcaccaacgcatagttgttgactaggctatttgtcatgaataggcaaaaccaacttcactacccgcaggaagtgaaggcagtggaaagtgtggaatcaagcttgaacatgtcgtcaccttctgcaccgcttgccacgccagatgttgagcttgatgtgcacacgttgtcgagcgaaaacctgccttggttgtgcatcgtgtgggatgatccggtcaatttgatgagctatgtcacctacgtttttcagactgtgttgggcttcagtaagaagagggccactgagctgatgatgcaggtgcacaccgaaggtaaagccgtggtgagttctggcgagaaggac

SEQ ID NO: 1152 - protein, 102 aa, Corynebacterium glutamicum
MNRQNQLHYPQEVKAVESVESSLNMSSPSAPLATPDVELDVHTLSSENLPWLCIVWDDPVNLMSYVTYVFQTVLGFSKKRATELMMQVHTEGKAVVSSGEKD

SEQ ID NO: 1153 - DNA, 1035 bp, Corynebacterium glutamicum
  CDS (101)..(1012): RXN02408
gtgatgtacgcggcggggaagccgccgaggaagaccgcgaaaacctcgtgcagtggcttgcctacaatcaagagtccttgctggaagcgatgatgaattaatgcttatcgacgtcgcgggcttccttttaggccacgtcacgaagggggatacgggttgctcagtggtcattgcacctaacggtgcatttgcgggcgtcgatgtccgtgggggaggcccaggcaccagggaaaccgaccttctagaaccacacaattctgtgcagcaagcacatgccgtggtgttgtgtggcggttcggcgttcgggttggctgctgccgatggagtgatgacagccctagaaaaccgcggtattggtttccctgtccgtcccgaagggcctatcgtgccaatcgttccaggcgctgtgatttttgatttgttggtgggcgatcccaaaaacaggcccacggcagctgatggggaacaagcagttgaaaacgctttcgctggtacacacaacggttcgggcagcgtcggtgcaggaacgggtgctacagcaggtcggctgcgtggcggttttggccaaagctcgcgccgggtcggaaagtacaccatcgcggcaggggtcgtggcgaatcctgttggggaagtcgtggacctaacaactggagctttgtttggtaggcccgaagtgatgggggtgggcgtcgataagctaaaaagcgcggcagagacgctgaacacgaccatcggcgtcgtggcaactgacgcgccggtgacaaaagcccaagcgaagcgcttggcgctggtggcccatgatggtttggcgagggcagtgcggccgtcgcattcaccgatggacggtgacacatttttcgccatgtcatcgggtgatggtagtggcgttaccccggttgagctggcggaattgtcggctcatgctgcagattgcgtacaggacgctatcatcgacgccatacttaccgcgagtccgggactcgggctcaaaagcttcagggaacttttaccatgagttacaacagcccgtataac

SEQ ID NO: 1154 - protein, 304 aa, Corynebacterium glutamicum
MLIDVAGFLLGHVTKGDTGCSVVIAPNGAFAGVDVRGGGPGTRETDLLEPHNSVQQAHAVVLCGGSAFGLAAADGVMTALENRGIGFPVRPEGPIVPIVPGAVIFDLLVGDPKNRPTAADGEQAVENAFAGTHNGSGSVGAGTGATAGRLRGGFGQSSRRVGKYTIAAGVVANPVGEVVDLTTGALFGRPEVMGVGVDKLKSAAETLNTTIGVVATDAPVTKAQAKRLALVAHDGLARAVRPSHSPMDGDTFFAMSSGDGSGVTPVELAELSAHAADCVQDAIIDAILTASPGLGLKSFRELLP

SEQ ID NO: 1155 - DNA, 928 bp, Corynebacterium glutamicum
  CDS (101)..(928): FRXA02408
gtgatgtacgcggcggggaagccgccgaggaagaccgcgaaaacctcgtgcagtggcttgcctacaatcaagagtccttgctggaagcgatgatgaattaatgcttatcgacgtcgcgggcttccttttaggccacgtcacgaagggggatacgggttgctcagtggtcattgcacctaacggtgcatttgcgggcgtcgatgtccgtgggggaggcccaggcaccagggaaaccgaccttctagaaccacacaattctgtgcagcaagcacatgccgtggtgttgtgtggcggttcggcgttcgggttggctgctgccgatggagtgatgacagccctagaaaaccgcggtattggtttccctgtccgtcccgaagggcctatcgtgccaatcgttccaggcgctgtgatttttgatttgttggtgggcgatcccaaaaacaggcccacggcagctgatggggaacaagcagttgaaaacgctttcgctggtacacacaacggttcgggcagcgtcggtgcaggaacgggtgctacagcaggtcggctgcgtggcggttttggccaaagctcgcgccgggtcggaaagtacaccatcgcggcaggggtcgtggcgaatcctgttggggaagtcgtggacctaacaactggagctttgtttggtaggcccgaagtgatgggggtgggcgtcgataagctaaaaagcgcggcagagacgctgaacacgaccatcggcgtcgtggcaactgacgcgccggtgacaaaagcccaagcgaagcgcttggcgctggtggcccatgatggtttggcgagggcagtgcggccgtcgcattcaccgatggacggtgacacatttttcgccatgtcatcgggtgatggtagtggcgttaccccggttgagctgggggaattgtcggctcatgctgca

SEQ ID NO: 1156 - protein, 276 aa, Corynebacterium glutamicum
MLIDVAGFLLGHVTKGDTGCSVVIAPNGAFAGVDVRGGGPGTRETDLLEPHNSVQQAHAVVLCGGSAFGLAAADGVMTALENRGIGFPVRPEGPIVPIVPGAVIFDLLVGDPKNRPTAADGEQAVENAFAGTHNGSGSVGAGTGATAGRLRGGFGQSSRRVGKYTIAAGVVANPVGEVVDLTTGALFGRPEVMGVGVDKLKSAAETLNTTIGVVATDAPVTKAQAKRLALVAHDGLARAVRPSHSPMDGDTFFAMSSGDGSGVTPVELGELSAHAA

SEQ ID NO: 1157 - DNA, 660 bp, Corynebacterium glutamicum
  CDS (101)..(637): RXN02409
gagttctggcgagaaggacaaagtggagggtgatgtgaagaaactccacaccgcagggctgtgggcgacaatgcagcaggcagggtaggggagaattttcatgcagcagtggaagaagaaaaaagggctgatgcgccaggctcgttacgcggtggtttttgagccgatggagcgggaagtgttgggtgatttgtcagctgcggtcagtgaggcgttgattcagcgtgcacagtctgtgccgaaggatcctctggcagagatgaccggcatgacaagtggacacaaagaagcaccaaccgatccggcgcttgcgcgtttgctccctgattttcagcacgagggcgatgaggaatacgacggcgataattctttcctccgttcactccatgaaggcgacatcacccgagcaaaactggaaaatctgcgcgtgattaacgatgcgctgggacccgacggaaatgttgcggtcaccgcctctgaggaggaagcgcacgcttggttggctgcgctcaatgacatccgcctgtacgttgcctccggtgatgtacgcggcggggaagccgccgaggaagaccgcgaaaacctcgtgcagtggcttgcctacaatcaagagtccttgctggaagcgatgatgaattaatgcttatcgacgtcgcgggc

SEQ ID NO: 1158 - protein, 179 aa, Corynebacterium glutamicum
MQQWKKKKGLMRQARYAVVFEPMEREVLGDLSAAVSEALIQRAQSVPKDPLAEMTGMTSGHKEAPTDPALARLLPDFQHEGDEEYDGDNSFLRSLHEGDITRAKLENLRVINDALGPDGNVAVTASEEEAHAWLAALNDIRLYVASGDVRGGEAAEEDRENLVQWLAYNQESLLEAMMN

SEQ ID NO: 1159 - DNA, 437 bp, Corynebacterium glutamicum
  CDS (1)..(414): FRXA02409
cgtgcacagtctgtgccgaaggatcctctggcagagatgaccggcatgacaagtggacacaaagaagcaccaaccgatccggcgcttgcgcgtttgctccctgattttcagcacgagggcgatgaggaatacgacggcgataattctttcctccgttcactccatgaaggcgacatcacccgagcaaaactggaaaatctgcgcgtgattaacgatgcgctgggacccgacggaaatgttgcggtcaccgcctctgaggaggaagcgcacgcttggttggctgcgctcaatgacatccgcctgtacgttgcctccggtgatgtacgcggcggggaagccgccgaggaagaccgcgaaaacctcgtgcagtggcttgcctacaatcaagagtccttgctggaagcgatgatgaattaatgcttatcgacgtcgcgggc

SEQ ID NO: 1160 - protein, 138 aa, Corynebacterium glutamicum
RAQSVPKDPLAEMTGMTSGHKEAPTDPALARLLPDFQHEGDEEYDGDNSFLRSLHEGDITRAKLENLRVINDALGPDGNVAVTASEEEAHAWLAALNDIRLYVASGDVRGGEAAEEDRENLVQWLAYNQESLLEAMMN

SEQ ID NO: 1161 - DNA, 1257 bp, Corynebacterium glutamicum
  CDS (101)..(1234): RXN02428
cgaaagatatgcataaagtgatgatgaaatagctttgtcgaaaggtttgctcccggtgcattcagttagcgtgaaggtgccatcatcacaagggttgatgatggccgcgacgttagatcttccagatacagatcccattgcctatgcaatgtttgcccactgtttcaccggctcacggttcacgccagccgccgcgcgagtcagtaaaacactcgcagaatccggcgtcgcctgcctgcgtttcgatttcccaggactgagccaatcagaaggtgacttctccaaaaccaccttcaactccaatgtggacgatatcgtggcggcctcgcagtggttgacggaacactactccgctccacagttgctcattggacactccttgggtggtgcagcatcactgaaagctgccaccaaaatctcctgcctcaaagcagtagcaacgataggtgcaccttttgatcctgcgcacgcagtcctgcactttgctgatcgcatatgtgatgtagatgatcaaggtgctgtcactctgcagctcggaggccgggatgtcaccatttcccgcgaattcctcgaagaccttgcagaggtcaaccccgaagatcacctccgcaggctccgcaaaccactgcttttactgcattcccccaccgaccaaaccgtcggcgtggacaacgcgcagctcatcttcagagtcactcgctaccctaaatccttgatgactttggacaaggcagatcacctgctcaccaaagatggcaccgcacagcgtgcagcccggatcatcgcgaactgggtcgagccctacctggttccagaaaacgtctgtgaggatcttccggagtttgtcgccgaagcctcaaccatcaaagccagcaaatacggcgcagccatccgcaccggtggtcacaatttcatcaccgaccgcgacaaatcccagggtggcaaaaacctcggcttcacccctacttccctgctggtttccgcgcttgctgctgcaaactctcaaacgatcaaacaagcagccatcgacaaccgcatcaaaggccttgacgatgtcaaagtgacgatctcccaggaacaatcagccgaccacggccagatcaaactccgccgaaagatctctttgatcggcaacctcagcgatgctgacagtgcttcacttcgggccgcatctaattcctgctcgattacccaactgctcgcgcagggaatcgtcatcgacgacgaggtgaactagcgtggattttgagttgggta

SEQ ID NO: 1162 - protein, 378 aa, Corynebacterium glutamicum
MAATLDLPDTDPIAYAMFAHCFTGSRFTPAAARVSKTLAESGVACLRFDFPGLSQSEGDFSKTTFNSNVDDIVAASQWLTEHYSAPQLLIGHSLGGAASLKAATKISCLKAVATIGAPFDPAHAVLHFADRICDVDDQGAVTLQLGGRDVTISREFLEDLAEVNPEDHLRRLRKPLLLLHSPTDQTVGVDNAQLIFRVTRYPKSLMTLDKADHLLTKDGTAQRAARIIANWVEPYLVPENVCEDLPEFVAEASTIKASKYGAAIRTGGHNFITDRDKSQGGKNLGFTPTSLLVSALAAANSQTIKQAAIDNRIKGLDDVKVTISQEQSADHGQIKLRRKISLIGNLSDADSASLRAASNSCSITQLLAQGIVIDDEVN

SEQ ID NO: 1163 - DNA, 1257 bp, Corynebacterium glutamicum; identical to SEQ ID NO: 1161
  CDS (101)..(1234): FRXA02428

SEQ ID NO: 1164 - protein, 378 aa, Corynebacterium glutamicum; identical to SEQ ID NO: 1162

SEQ ID NO: 1165 - DNA, 1365 bp, Corynebacterium glutamicum
  CDS (101)..(1342): RXN02454
ggcaagcgcctcccttaagcccgcgtaccggctaccccgaggcacgtaatgagtagggcagttctagccataatcagcagaaaaggtggagtgattcgccatgaaagagtccatgagcatcacctcgtcgacgtacgcgtcggcactgctgacactgccctggggtacacccctggaacagtggcccgataatctcatcgccgcgctgcccaggggtatttcccggcacatcgtgcgtttcgtggggatcaaccgtggcatcgtcgcggtcaaagaaattggtgcgcgtaccgcccaccacgagtacaagatgctgcgtgaactgcagcgccttggtgcccccagtgtgcgccccgtagccgtgatcaccggacgccatccggcagaggaagactacggggagctcaccgcagctttggtgaccgagcacttggagttttccctgccctatcgcgagatcttttctcggcacctcacggtcgtggaatcggagaagctcatccgcgccctgtccgtgctgttggtgcggatgcatctgctcaacttctactggggagatgtgtcactgtctaatactctctttcgtcgcgatgctgaaacctattccgcctatctcgtcgatgccgaaaccggggagttccagcccaacctctctgaatcacgcaggctttacgacgtcgacatcgcccgcgtcaacatcattggcgaactcatggacctacaggcgggtgaatgcctagataagtccatcgatgtcatcgccctaggaggccttgtcgaaagctcttatcttgaattgtggacggagctcaccgcggaggaatccgtcgatgccagtgaatattggcgcctctctgagagaattgaccggctcaatcaactgggctttgacgtaggggagctcaaggtcacgaaggacgattcgcggcaggttgtgcgcattcgccctgtagtggtggatccgggccactatcgtgcagagctattgagcttaaccgggctgagcgtcgaggaacaccaggcccaacgcctattgggctcgatccaggcctatcaggccgtcgaatgcggaccgcatgtaggtcttacccaagccgcgcatctctggatgacgaatgaatacgaaccgactatcgccgccgtccccgtggagatgttagacaagctggagccagcacaaatcttccacgaaatcgtcgaccaccgctggttcctcgcccaagaaaggggaggggctgtcaccctcccagaggccacggcatcctatcttgaatccgtgcttccggcccgccgcgacgaggctcgcctcctcagcacaaacccttcagacgaagacttgtcataacctctcgcgtgccccaacgg

SEQ ID NO: 1166 - protein, 414 aa, Corynebacterium glutamicum
MKESMSITSSTYASALLTLPWGTPLEQWPDNLIAALPRGISRHIVRFVGINRGIVAVKEIGARTAHHEYKMLRELQRLGAPSVRPVAVITGRHPAEEDYGELTAALVTEHLEFSLPYREIFSRHLTVVESEKLIRALSVLLVRMHLLNFYWGDVSLSNTLFRRDAETYSAYLVDAETGEFQPNLSESRRLYDVDIARVNIIGELMDLQAGECLDKSIDVIALGGLVESSYLELWTELTAEESVDASEYWRLSERIDRLNQLGFDVGELKVTKDDSRQVVRIRPVVVDPGHYRAELLSLTGLSVEEHQAQRLLGSIQAYQAVECGPHVGLTQAAHLWMTNEYEPTIAAVPVEMLDKLEPAQIFHEIVDHRWFLAQERGGAVTLPEATASYLESVLPARRDEARLLSTNPSDEDLS

SEQ ID NO: 1167 - DNA, 836 bp, Corynebacterium glutamicum
  CDS (1)..(813): FRXA02454
atgcatctgctcaacttctactggggagatgtgtcactgtctaatactctctttcgtcgcgatgctgaaacctattccgcctatctcgtcgatgccgaaaccggggagttccagcccaacctctctgaatcacgcaggctttacgacgtcgacatcgcccgcgtcaacatcattggcgaactcatggacctacaggcgggtgaatgcctagataagtccatcgatgtcatcgccctaggaggccttgtcgaaagctcttatcttgaattgtggacggagctcaccgcggaggaatccgtcgatgccagtgaatattggcgcctctctgagagaattgaccggctcaatcaactgggctttgacgtaggggagctcaaggtcacgaaggacgattcgcggcaggttgtgcgcattcgccctgtagtggtggatccgggccactatcgtgcagagctattgagcttaaccgggctgagcgtcgaggaacaccaggcccaacgcctattgggctcgatccaggcctatcaggccgtcgaatgcggaccgcatgtaggtcttacccaagccgcgcatctctggatgacgaatgaatacgaaccgactatcgccgccgtccccgtggagatgttagacaagctggagccagcacaaatcttccacgaaatcgtcgaccaccgctggttcctcgcccaagaaaggggaggggctgtcaccctcccagaggccacggcatcctatcttgaatccgtgcttccggcccgccgcgacgaggctcgcctcctcagcacaaacccttcagacgaagacttgtcataacctctcgcgtgccccaacgg

SEQ ID NO: 1168 - protein, 271 aa, Corynebacterium glutamicum
MHLLNFYWGDVSLSNTLFRRDAETYSAYLVDAETGEFQPNLSESRRLYDVDIARVNIIGELMDLQAGECLDKSIDVIALGGLVESSYLELWTELTAEESVDASEYWRLSERIDRLNQLGFDVGELKVTKDDSRQVVRIRPVVVDPGHYRAELLSLTGLSVEEHQAQRLLGSIQAYQAVECGPHVGLTQAAHLWMTNEYEPTIAAVPVEMLDKLEPAQIFHEIVDHRWFLAQERGGAVTLPEATASYLESVLPARRDEARLLSTNPSDEDLS

SEQ ID NO: 1169 - DNA, 1233 bp, Corynebacterium glutamicum
  CDS (101)..(1210): RXN02457
ctgtaaagccacgtgagctgttgcttagactttactctacccccgcgtgtccaccacatcagttagaacatatgtaccacttcaaatctagggggaaacaatgttctacttcaccgtcaataatccgcaggatcctttaagcaccgaaattgttgagactaatcgccgtgacctcgcattttggcatcgattacgccccaaagatgacgatgatttagccacagccatcaacaaaatatgcgtgcgcacaggcttatcccgcaaactgatcgccgcttgtttatttagcatctgcttcctgccgtacttacccaacttccacaaactcgtcgaaaagcttggtcatctcgacatggcgcgcatcaacgcgatcactaaagctggcgaaaaagtgccaagcgagaagagagagcttttcgacgcctacctcgtcgattacctgacgcctcgagcggaggctcagtgcttgccccaggcaagctcaatttccgcaatgatgcggaaatttatcgcacaacactgccccgacgacaaggcctcctcagccaccaatgatggctccatccgctaccgcagaaacaacaaaggcgggatcagtatcaccgtcgatgccaccgccagcgaagtaacagaaatcaaagctgccctggaacaaatgtccaaagataaggactgcacaccaggcacttccctactccacatcattcgtggcctgccgacaaaagtcgtactcaacacctacggcaccaaagacagccctgaatacttagaaggaggaacctggctgtcaaaggaacagtctgagttctggaaaacccgaaccacgtccagtcgggatatggacgccgcccacttctcttacaccaccgcctacgctccaacccgagaaatgcgcgtctacatcaaaggtctacgcaccacctgtagcgtccctggctgcagtgtagcggtcgaaaactgccaactggaccacatcatcccctggggtgaaggagggccgacaacaccgtggaatattcatcccctgtgtgtcttccaccacatccagaagactgaagggaggctccagtgctatccactaccggacggcaccgtcctattcctagtggatggaataccggtgttctccatccccgacgggcctttatctaaatcgaataaaacctgggggacaaagttcggcaaatacatggagcgtcgaatcgccgcctaatccagcaagccagcgtgatc

SEQ ID NO: 1170 - protein, 370 aa, Corynebacterium glutamicum
MFYFTVNNPQDPLSTEIVETNRRDLAFWHRLRPKDDDDLATAINKICVRTGLSRKLIAACLFSICFLPYLPNFHKLVEKLGHLDMARINAITKAGEKVPSEKRELFDAYLVDYLTPRAEAQCLPQASSISAMMRKFIAQHCPDDKASSATNDGSIRYRRNNKGGISITVDATASEVTEIKAALEQMSKDKDCTPGTSLLHIIRGLPTKVVLNTYGTKDSPEYLEGGTWLSKEQSEFWKTRTTSSRDMDAAHFSYTTAYAPTREMRVYIKGLRTTCSVPGCSVAVENCQLDHIIPWGEGGPTTPWNIHPLCVFHHIQKTEGRLQCYPLPDGTVLFLVDGIPVFSIPDGPLSKSNKTWGTKFGKYMERRIAA

SEQ ID NO: 1171 - DNA, 1233 bp, Corynebacterium glutamicum; identical to SEQ ID NO: 1169
  CDS (101)..(1210): FRXA02457

SEQ ID NO: 1172 - protein, 370 aa, Corynebacterium glutamicum; identical to SEQ ID NO: 1170

SEQ ID NO: 1173 - DNA, 627 bp, Corynebacterium glutamicum
  CDS (101)..(604): RXN02460
gcgccgtcgaagccggactcgtaggcgtctactaccagcaatttgaccgtgcagtcgtcgaaatcgtcggactgttcgggctagaaggagaattctaatcttgcgcgtctacatcccagcaacgttttccacactccgcggactcaatgaatcccgcgtcatcacagcacgctccggatacggtttcgcagtcaccccagcactccttgacttctacaccgacggtgacgaagaagaaatcgcacatgcagccttccaagacgccgcagaagcctccatccgactcctcgcaatcggcgacgaagaaacatttccctaccgcagagtcgtcgtctcagtagatgttgacgactccgtggtgacctaccagcctgaaaacggcgaatccgtagtcaaactcagcccagcgcacatcaacctcgacgacgtggcagcaatccacatcgacgttgaagcctccgaagcagacaccaaaaaagctatcgaagtcatcgacgaatccgacctcggcgaagaagacgccgaactcaccgtcggagacgcccaagacaacttcatggcctggtacgacccagaagagctccccttcctagtcgagctcctctagatcacatatcccacgcgtcg

SEQ ID NO: 1174 - protein, 168 aa, Corynebacterium glutamicum
LRVYIPATFSTLRGLNESRVITARSGYGFAVTPALLDFYTDGDEEEIAHAAFQDAAEASIRLLAIGDEETFPYRRVVVSVDVDDSVVTYQPENGESVVKLSPAHINLDDVAAIHIDVEASEADTKKAIEVIDESDLGEEDAELTVGDAQDNFMAWYDPEELPFLVELL

SEQ ID NO: 1175 - DNA, 627 bp, Corynebacterium glutamicum; identical to SEQ ID NO: 1173
  CDS (101)..(604): FRXA02460

SEQ ID NO: 1176 - protein, 168 aa, Corynebacterium glutamicum; identical to SEQ ID NO: 1174

SEQ ID NO: 1177 - DNA, 1323 bp, Corynebacterium glutamicum
  CDS (101)..(1300): RXN02464
actcgacatcccagaaggtgtcaccgaacgagtcggaccaccaaccaaagttctaggcggaacagccccacgaccaccacgccgcacccggaaataacttatggcagcaaagcttcaaccactcaaacgcaccaaaaaagacctcatcgcaaccggtgtcatcacagcactagcagtcattggcgtcggcacggtctgggcaaccgcaccaatacgaggatctgaactcacccccgccgacgaaccattcattggctcaaccacactggacgccatccccgaaacactcagcgaacattggcgagccaccgacaccttaacaaaccacaaacccctcatcaccggcggagtcatcttcaccgccgacggcaacaccattaagacctacacccccgacggcgccctcctgtggagctacgaacgcgacaaagaactctgcagcctctccgtaggattcgacgccgccgtcgccacctacaaaaccggaatcggatgtggcgacgtcaccgccatcaacgccaacgacggccaataccaagcaacacgcagcgcaatctccagcgaccacgtagcaccgatctcctcgaacgatcggatcggtgttctcgggacagaacgcttggagctttggcgatccgatctggtgcgaaccatcgaatacggcgatgtggaagctcctcaagaatctgggcaacaaccacatccggaatgctcgattacgtccgccatgacacgcaaagatctattggctatcaccgaggattgccctgacggatcttcttacttgaggttcatgggcacaacaccagacgattcccgaactcctgaaatcacccaagacatagaaataaccgatggcaggatcgttgccatcggtcaatcagtggctgcggtgtatacaaacgatccttcgcctcgaatcgtctcctacaacgatgatggtgaactagttggagaacaagcagtcgatgaggttgagttcccggatccgccgtttcaaagcgcgaccgctgatcttccacaccatatgagttggttcaacggagacagcctcgtactgttctctcccactcagctcaatgtacgacaaagcttcaatgatgctttaggaaccggcattgcgttgaacggaagtctcctctaccccaccgctgagggcatcacggtagctaattgggacaccggagaggtgcagcgcaccattccggtggaccgtgcgggctacgacggtgaagttgcgctcggcgttgtagggcaggtgatcgtcgaaaagcgtggctctgagatcgttgctctaggctagatctcgttgttagcccaaag

SEQ ID NO: 1178 - protein, 400 aa, Corynebacterium glutamicum
MAAKLQPLKRTKKDLIATGVITALAVIGVGTVWATAPIRGSELTPADEPFIGSTTLDAIPETLSEHWRATDTLTNHKPLITGGVIFTADGNTIKTYTPDGALLWSYERDKELCSLSVGFDAAVATYKTGIGCGDVTAINANDGQYQATRSAISSDHVAPISSNDRIGVLGTERLELWRSDLVRTIEYGDVEAPQESGQQPHPECSITSAMTRKDLLAITEDCPDGSSYLRFMGTTPDDSRTPEITQDIEITDGRIVAIGQSVAAVYTNDPSPRIVSYNDDGELVGEQAVDEVEFPDPPFQSATADLPHHMSWFNGDSLVLFSPTQLNVRQSFNDALGTGIALNGSLLYPTAEGITVANWDTGEVQRTIPVDRAGYDGEVALGVVGQVIVEKRGSEIVALG

SEQ ID NO: 1179 - DNA, 630 bp, Corynebacterium glutamicum
  CDS (101)..(607): FRXA02464
acaaccacatccggaatgctcgattacgtccgccatgacacgcaaagatctattggctatcaccgaggattgccctgacggatcttcttacttgaggttcatgggcacaacaccagacgattcccgaactcctgaaatcacccaagacatagaaataaccgatggcaggatcgttgccatcggtcaatcagtggctgcggtgtatacaaacgatccttcgcctcgaatcgtctcctacaacgatgatggtgaactagttggagaacaagcagtcgatgaggttgagttcccggatccgccgtttcaaagcgcgaccgctgatcttccacaccatatgagttggttcaacggagacagcctcgtactgttctctcccactcagctcaatgtacgacaaagcttcaatgatgctttaggaaccggcattgcgttgaacggaagtctcctctaccccaccgctgagggcatcacggtagctaattgggacaccggagaggtgcagcgcaccattccggtggaccgtgcgggctacgacggtgaagttgcgctcggcgttgtagggcaggtgatcgtcgaaaagcgtggctctgagatcgttgctctaggctagatctcgttgttagcccaaag

SEQ ID NO: 1180 - protein, 169 aa, Corynebacterium glutamicum
MGTTPDDSRTPEITQDIEITDGRIVAIGQSVAAVYTNDPSPRIVSYNDDGELVGEQAVDEVEFPDPPFQSATADLPHHMSWFNGDSLVLFSPTQLNVRQSFNDALGTGIALNGSLLYPTAEGITVANWDTGEVQRTIPVDRAGYDGEVALGVVGQVIVEKRGSEIVALG

SEQ ID NO: 1181 - DNA, 522 bp, Corynebacterium glutamicum
  CDS (101)..(499): RXN02465
ctggtgcaatataaaagttaaccaaccagtcatccaatatgtcgcctaagtagtcttcccaaagttaacagctagaatcatggccgtgacttctccgaacatgcctgcatcaattcgctggggcggcatcgtcgccctcattcaatccaccatcggattcggttacgcctttttccttatttacagggaagctacgggcgagacggatccaagcatcgtctacgaaaccgataacgccaacacgtgggttggctacggtaccgctgcattcttcatcattgtgttcggaacggttgttgcaggcgcaatcaacatgatgaaggggcatcgctggggacgcggagctgtcgtcatgctgaatattattttgttgccggctgcgtattacatgtttatcgaaggccgattctcctgggcgatcgtcacaggaatctcagctctcttcgttttgggcgcactgtttaataagcgcgccgtcctttgggctaacaacgagatctagcctagagcaacgatctcaga

SEQ ID NO: 1182 - protein, 133 aa, Corynebacterium glutamicum
MPASIRWGGIVALIQSTIGFGYAFFLIYREATGETDPSIVYETDNANTWVGYGTAAFFIIVFGTVVAGAINMMKGHRWGRGAVVMLNIILLPAAYYMFIEGRFSWAIVTGISALFVLGALFNKRAVLWANNEI

SEQ ID NO: 1183 - DNA, 522 bp, Corynebacterium glutamicum; identical to SEQ ID NO: 1181
  CDS (101)..(499): FRXA02465

SEQ ID NO: 1184 - protein, 133 aa, Corynebacterium glutamicum; identical to SEQ ID NO: 1182

SEQ ID NO: 1185 - DNA, 187 bp, Corynebacterium glutamicum
  CDS (101)..(187): RXN02466
cgaaccgcaaagcgttccgctgacggaactgccgcctggcggcagctacaccgaaaccggtgctggcactttccgccaggtcggcgctgctcttcctcgcgtgggcgaggggcaggaacaaacttttacgtacgtcattgagattgaggatggcgtcaacacggccgcttatggtggcgacgatgcg

SEQ ID NO: 1186 - protein, 29 aa, Corynebacterium glutamicum
VGEGQEQTFTYVIEIEDGVNTAAYGGDDA

SEQ ID NO: 1187 - DNA, 187 bp, Corynebacterium glutamicum; identical to SEQ ID NO: 1185
  CDS (101)..(187): FRXA02466

SEQ ID NO: 1188 - protein, 29 aa, Corynebacterium glutamicum
VGEGQEQTFTYVIEIEDGVNTAAYGGDDA

SEQ ID NO: 1189 - DNA, 294 bp, Corynebacterium glutamicum
  CDS (101)..(271): RXN02505
tcggaaagcaatccggaacattcaggttgtagacaatgtcatcagttcagttgaccgtcccattaagcgcactggtcgtttgcgtattccgggggtctttgtggctggcactcatgcgtatgtcaatgaaactctttcggaaaatgagttcagcatgtgccgaaagaatgaacctggtttggtcattgagctggagaacatcagcatcgatcgcattgtcatttccacaccagatgcccaccgctatgcggatgagctcatggcggctgtttagaactcagtttccgtcaataa

SEQ ID NO: 1190 - protein, 57 aa, Corynebacterium glutamicum
VAGTHAYVNETLSENEFSMCRKNEPGLVIELENISIDRIVISTPDAHRYADELMAAV

SEQ ID NO: 1191 - DNA, 294 bp, Corynebacterium glutamicum; identical to SEQ ID NO: 1189
  CDS (101)..(271): FRXA02505

SEQ ID NO: 1192 - protein, 57 aa, Corynebacterium glutamicum; identical to SEQ ID NO: 1190

SEQ ID NO: 1193 - DNA, 759 bp, Corynebacterium glutamicum
  CDS (101)..(736): RXN02510
cccgtcgatgaggcaatcgctgtgatttcttcctggattggtgaccgcatcaatgatcagccgagcgaggactccattgcagctcgcaggtagccctgagatggactcatctgacagccacgttggtcaggatgtatatgttgatcaaggtctaggggagcccgacagactggaacgtctgtgggcgccctaccggatgagctacatcaacactcgatctggcggtaagcaatcaactaccgccaagcgggaccccttcattgaggttcccaaaatgagtgatgaggacggcctgatcgttgcgcggggtgagctggtgtattgcgtactcaacttgtatccctacaacgctggacacatgatggtgatcccattccgtaaggaaaagaatctagaggatttgagcttggcagaatctgcggagttgatgctctttacccaaacggccatcaaggcgctgaagcaggtgtcaaaccctgatgctgtcaatgttggtttaaaccttggcaaagcatcgggtggctcagtgggagatcaccttcatgtccatgtggtgcctaggtggtcgggtgatgctaatttcatgactgtgattgacggtgtcaaagtgctaccgcagaccctgcgtcaaaccagggccatgcttgcgcaagcatggggcaccattgatggggcaccaggcactgtcgacccaacgctgacttcagcgatccgtaccgcagcaccgaaggagcactgatgctgggacttcatggacgt

SEQ ID NO: 1194 - protein, 212 aa, Corynebacterium glutamicum
MDSSDSHVGQDVYVDQGLGEPDRLERLWAPYRMSYINTRSGGKQSTTAKRDPFIEVPKMSDEDGLIVARGELVYCVLNLYPYNAGHMMVIPFRKEKNLEDLSLAESAELMLFTQTAIKALKQVSNPDAVNVGLNLGKASGGSVGDHLHVHVVPRWSGDANFMTVIDGVKVLPQTLRQTRAMLAQAWGTIDGAPGTVDPTLTSAIRTAAPKEH

SEQ ID NO: 1195 - DNA, 759 bp, Corynebacterium glutamicum; identical to SEQ ID NO: 1193
  CDS (101)..(736): FRXA02510

SEQ ID NO: 1196 - protein, 212 aa, Corynebacterium glutamicum; identical to SEQ ID NO: 1194

SEQ ID NO: 1197 - DNA, 1752 bp, Corynebacterium glutamicum
  CDS (101)..(1729): RXN02519
aaacagaaaatggtttcctcgggcacctcgtcccctacgccaatttctcgacactttgccgcgcatcggcaccgctggttccagatcagcgaccctccacgtggaagacgagcagagccctttaggggcaacgcttttcgacgtcgcgaccggcgcgagctccatcaacgaccgcgataccgacgcctcagggcttgagcctgaaaagattcgccgatttgcatggctgcgcctgatcggcaccatgggtgcgttaatgatcgcgtttggtgcgctgggcgcgggtgcacttccggtggtgaataatccgtatgtggatttccctggcggaaacttcatgagccgaatgctgcagacctcttccatgatcgtgctcatcggcgtgggatttttggtgctggcgtgggtgttaatggcaccgctggtgggtattccttttaaacgcagcggaaacagaacagccagcgtgagtttgtccatgctgcgccgcacatttggcgcctgggtagcgcccatcatgctcaccgccccactgtttactcaagacatttattcttatctggcacaaggctctgtgaccgcgcagggaatggatgcctacgccggtggaccgcttgaactattggggcccgataatcatctggcacggtccgtgccctttatttgggcccagtcgccctcgccctacggccctgttgcgctgagcatcgcggcgtcgataagcgttattactaatgacagcatcgttggaggcgtgctggcgcaccgtattgcgtcgctgctgggcgttgtggctgcaggctgggcgatcaccatgctggccaggcgctgtcgggtatctgaagaagcgtccttttacctgggcgtacttaatccgctgctgattctgcacctgatcggcggtattcacaacgaatccatcctgctgggatttttacttgttggcctggaactcggactgcgtggcaccgaccggattcaaacagggctgtgggggcctgcgtggacatatattgcactgagtggcgtattgatttcttgcgcaggcctggtcaaggtgaccggctttattgggctcggttttgtgggcatggccttggccagggcgtttcatgcacgtggacatcgacacgtcgttgcgatcggcgttgcaggcctcgttcaagtagcagccctggtgatcaccgtggttgttctcagtgtgattaccggaatcagtttggggtggatcacaggtcaaggtggcgctgcgacgatccgaagctggatgtctatgaccaccaacattggcgttatttctggattcatcggaatgaatttggggctaggcgaccacaccgcagccatgctcgttgtgacccgtgcagccggaatcgcggtagctgccgccttcatggttcgtatgttgtttgccacatatagaggtcacattcacgctgtgggcggactgggcgtggcgactttcgtcctcgttatcctcttccccgtggtgcatccgtggtacatgctgtgggctatcgtgccgctagcttcctgggcaaatagactgttcttccagctcggagtgattgcctactccactgccttcagtttctttgtgctgcctcgcgggcttgcacttccagtcggaactgtcttttccatctacttcggcgcagcgctcggattcagcattctcctattagttggatggtggagtttgaggcggaatccaacctttggtttacactgatcaactgtgactactgattt

SEQ ID NO: 1198 - protein, 543 aa, Corynebacterium glutamicum
VEDEQSPLGATLFDVATGASSINDRDTDASGLEPEKIRRFAWLRLIGTMGALMIAFGALGAGALPVVNNPYVDFPGGNFMSRMLQTSSMIVLIGVGFLVLAWVLMAPLVGIPFKRSGNRTASVSLSMLRRTFGAWVAPIMLTAPLFTQDIYSYLAQGSVTAQGMDAYAGGPLELLGPDNHLARSVPFIWAQSPSPYGPVALSIAASISVITNDSIVGGVLAHRIASLLGVVAAGWAITMLARRCRVSEEASFYLGVLNPLLILHLIGGIHNESILLGFLLVGLELGLRGTDRIQTGLWGPAWTYIALSGVLISCAGLVKVTGFIGLGFVGMALARAFHARGHRHVVAIGVAGLVQVAALVITVVVLSVITGISLGWITGQGGAATIRSWMSMTTNIGVISGFIGMNLGLGDHTAAMLVVTRAAGIAVAAAFMVRMLFATYRGHIHAVGGLGVATFVLVILFPVVHPWYMLWAIVPLASWANRLFFQLGVIAYSTAFSFFVLPRGLALPVGTVFSIYFGAALGFSILLLVGWWSLRRNPTFGLH

SEQ ID NO: 1199 - DNA, 1929 bp, Corynebacterium glutamicum
  CDS (101)..(1906): FRXA02519
tgttttaaaacttcattccaattaccgaaaatgaatataatttgagatttagctcacactatcccccttcgggtcaccaccagactctgatgcgaggtaaatgttctccgctcccttgcgtagaatgatgcgagtgacgaaggacgagcagattcaacccaattcgaacgcccctgaaaacagaaaatggtttcctcgggcacctcgtcccctacgccaatttctcgacactttgccgcgcatcggcaccgctggttccagatcagcgaccctccacgtggaagacgagcagagccctttaggggcaacgcttttcgacgtcgcgaccggcgcgagctccatcaacgaccgcgataccgacgcctcagggcttgagcctgaaaagattcgccgatttgcatggctgcgcctgatcggcaccatgggtgcgttaatgatcgcgtttggtgcgctgggcgcgggtgcacttccggtggtgaataatccgtatgtggatttccctggcggaaacttcatgagccgaatgctgcagacctcttccatgatcgtgctcatcggcgtgggatttttggtgctggcgtgggtgttaatggcaccgctggtgggtattccttttaaacgcagcggaaacagaacagccagcgtgagtttgtccatgctgcgccgcacatttggcgcctgggtagcgcccatcatgctcaccgccccactgtttactcaagacatttattcttatctggcacaaggctctgtgaccgcgcagggaatggatgcctacgccggtggaccgcttgaactattggggcccgataatcatctggcacggtccgtgccctttatttgggcccagtcgccctcgccctacggccctgttgcgctgagcatcgcggcgtcgataagcgttattactaatgacagcatcgttggaggcgtgctggcgcaccgtattgcgtcgctgctgggcgttgtggctgcaggctgggcgatcaccatgctggccaggcgctgtcgggtatctgaagaagcgtccttttacctgggcgtacttaatccgctgctgattctgcacctgatcggcggtattcacaacgaatccatcctgctgggatttttacttgttggcctggaactcggactgcgtggcaccgaccggattcaaacagggctgtgggggcctgcgtggacatatattgcactgagtggcgtattgatttcttgcgcaggcctggtcaaggtgaccggctttattgggctcggttttgtgggcatggccttggccagggcgtttcatgcacgtggacatcgacacgtcgttgcgatcggcgttgcaggcctcgttcaagtagcagccctggtgatcaccgtggttgttctcagtgtgattaccggaatcagtttggggtggatcacaggtcaaggtggcgctgcgacgatccgaagctggatgtctatgaccaccaacattggcgttatttctggattcatcggaatgaatttggggctaggcgaccacaccgcagccatgctcgttgtgacccgtgcagccggaatcgcggtagctgccgccttcatggttcgtatgttgtttgccacatatagaggtcacattcacgctgtgggcggactgggcgtggcgactttcgtcctcgttatcctcttccccgtggtgcatccgtggtacatgctgtgggctatcgtgccgctagcttcctgggcaaatagactgttcttccagctcggagtgattgcctactccactgccttcagtttctttgtgctgcctcgcgggcttgcacttccagtcggaactgtcttttccatctacttcggcgcagcgctcggattcagcattctcctattagttggatggtggagtttgaggcggaatccaacctttggtttacactgatcaactgtgactactgattt

SEQ ID NO: 1200 - protein, 602 aa, Corynebacterium glutamicum
MFSAPLRRMMRVTKDEQIQPNSNAPENRKWFPRAPRPLRQFLDTLPRIGTAGSRSATLHVEDEQSPLGATLFDVATGASSINDRDTDASGLEPEKIRRFAWLRLIGTMGALMIAFGALGAGALPVVNNPYVDFPGGNFMSRMLQTSSMIVLIGVGFLVLAWVLMAPLVGIPFKRSGNRTASVSLSMLRRTFGAWVAPIMLTAPLFTQDIYSYLAQGSVTAQGMDAYAGGPLELLGPDNHLARSVPFIWAQSPSPYGPVALSIAASISVITNDSIVGGVLAHRIASLLGVVAAGWAITMLARRCRVSEEASFYLGVLNPLLILHLIGGIHNESILLGFLLVGLELGLRGTDRIQTGLWGPAWTYIALSGVLISCAGLVKVTGFIGLGFVGMALARAFHARGHRHVVAIGVAGLVQVAALVITVVVLSVITGISLGWITGQGGAATIRSWMSMTTNIGVISGFIGMNLGLGDHTAAMLVVTRAAGIAVAAAFMVRMLFATYRGHIHAVGGLGVATFVLVILFPVVHPWYMLWAIVPLASWANRLFFQLGVIAYSTAFSFFVLPRGLALPVGTVFSIYFGAALGFSILLLVGWWSLRRNPTFGLH

SEQ ID NO: 1201 - DNA, 807 bp, Corynebacterium glutamicum
  CDS (101)..(784): RXN02520
tttgcgctggtaggggggaagggattggacacgggaatggaattagggaacacttgtgttgtctaaaggtgaaagctaaatcaagcaggaggtgacaccagtgggagatgttgtaaaaggcaacgacgcgcacaccggagacggtgatacgcgccgaaaaattcttctcatcctgttggaacgtgcaccggtgatcgcttcagatattgctgaacagcttcagctttcaactgtgggagtgcgcaggcacctagacaacttggttgaagaaaatctggcggaggcggcaaatccgcgccagaacccatatgagcccaaaatgcgcggtaggccagcaaaaacttatcggcttactgataaaggtcgctcaatcttcggccacgaatatgattcccttgctgcggcagctctagccactcttcgagaggtcggcggagatgatgcagtaaggcaatttgctagaaagcggatcgaaacaattgttgagggtattaccccagcagatgtcacagatcaatcaatcgaagatacagccaaatctttagttgaagcttttagtcggcatggttatgcagcaactgtcgatgccactcgaaacgggttgcaactctgccagcatcactgtccaatatctacagtcgccacggaatttccggaactgtgtgaggcagagcatcaagcagtctcagaacttttggggcagcacacgcaaccattggcaacaatcgcggacggccacggcatctgcacaacaaatattgcattgacacccatcaaacactcctgatgaaaggagcggatcatgac

SEQ ID NO: 1202 - protein, 228 aa, Corynebacterium glutamicum
VGDVVKGNDAHTGDGDTRRKILLILLERAPVIASDIAEQLQLSTVGVRRHLDNLVEENLAEAANPRQNPYEPKMRGRPAKTYRLTDKGRSIFGHEYDSLAAAALATLREVGGDDAVRQFARKRIETIVEGITPADVTDQSIEDTAKSLVEAFSRHGYAATVDATRNGLQLCQHHCPISTVATEFPELCEAEHQAVSELLGQHTQPLATIADGHGICTTNIALTPIKHS

SEQ ID NO: 1203 - DNA, 807 bp, Corynebacterium glutamicum; identical to SEQ ID NO: 1201
  CDS (101)..(784): FRXA02520

SEQ ID NO: 1204 - protein, 228 aa, Corynebacterium glutamicum; identical to SEQ ID NO: 1202

SEQ ID NO: 1205 - DNA, 927 bp, Corynebacterium glutamicum
  CDS (101)..(904): RXN02534
ttaccagtaatctatgcagatttactgtccgttggggatccgcgcctatcggaagttgcctacattataaaaactcagattcaggaatacacagaccatgatgaattcaccgaacgcggacattattttagtagttaacaagctgtccaagtttattgatatcgaaaatattatgctcgttggagcacgatgtagagacattcaccagcaaaaatatcgcgatcaaacagcgggtagaagaactaaggatgttgacttcgctttagctttagaaagctgggacgacttcaatctattaaagcaacaattctcaccgactggtaacgcatggcaaggaatcaccattggaaatattccagtagatctcgtgccattcggaaatattgaaaacccacccggtgaagtcttgtccagaaaaggtcatctacttaatgtcgctgggttcaaggaagtattcgagcaagctgagctatatcccctaaatgatgcgatagacattaagttgtctacagttcccggacttactgcgctaaagctacatgcatggctcgaccgtaaagaaaataacatcaaagatgcaagcgatctagcattaatcttgtcgtggtacgaagaggatgtagaaactttatggaatcgctattttgccctggaaaatcaaggatacataggtgaaccagaggcaatggcagctgaattactaggacttgacactggaagaatactcggccacaaggaaactcaagccctccttgatcgatttaatgaacagtctcctcctgagctaaaccaatttgctgaatcacttgaagcccctcctgaacacagtcacccattagaacggcgtcgtatccaggtcgaggcactgttaggtggacttagagattccctcggttacgatgaatagcttccaatcccgcattgttc

SEQ ID NO: 1206 - protein, 268 aa, Corynebacterium glutamicum
MNSPNADIILVVNKLSKFIDIENIMLVGARCRDIHQQKYRDQTAGRRTKDVDFALALESWDDFNLLKQQFSPTGNAWQGITIGNIPVDLVPFGNIENPPGEVLSRKGHLLNVAGFKEVFEQAELYPLNDAIDIKLSTVPGLTALKLHAWLDRKENNIKDASDLALILSWYEEDVETLWNRYFALENQGYIGEPEAMAAELLGLDTGRILGHKETQALLDRFNEQSPPELNQFAESLEAPPEHSHPLERRRIQVEALLGGLRDSLGYDE

SEQ ID NO: 1207 - DNA, 927 bp, Corynebacterium glutamicum; identical to SEQ ID NO: 1205
  CDS (101)..(904): FRXA02534

SEQ ID NO: 1208 - protein, 268 aa, Corynebacterium glutamicum; identical to SEQ ID NO: 1206

SEQ ID NO: 1209 - DNA, 585 bp, Corynebacterium glutamicum
  CDS (101)..(562): RXN02537
acctccatctcaacaatcatctttccgatatgcgcactgtcagcgagcagatgctcaacatagacgtcgatcttggccacacactgaataagttgcactgatgctcgccctcaaaagttcagaattagaaggcatagccacatcactcaccgccgtggcgggtgcgctccacgaatcaaacactgaccggttgcagtcctggcagcagctcgaaacgatgacctctgccagctcccttatccagggctttatcaagcttgtcgattacaaccgacccacagtgaatatcgtggaacaaatgcacaaaaccgcatccacgcttttcaacaccgctgatttcctacgcactttggaaggctatgttgatgtactggaaaaacaagccgataaatctataacgctcaccgtcatgcttcgatatattgccagcttgagtagccttttagacctcatgtgtgcacgcgagatcaacgcgttgtgcacagcgattactccagaaccattgaagcatctgggcgattttggcactctaccgcctcagcaatccacgagtttcatttggtgaatgccccaccagaaatccgt

SEQ ID NO: 1210 - protein, 154 aa, Corynebacterium glutamicum
MLALKSSELEGIATSLTAVAGALHESNTDRLQSWQQLETMTSASSLIQGFIKLVDYNRPTVNIVEQMHKTASTLFNTADFLRTLEGYVDVLEKQADKSITLTVMLRYIASLSSLLDLMCAREINALCTAITPEPLKHLGDFGTLPPQQSTSFIW

SEQ ID NO: 1211 - DNA, 585 bp, Corynebacterium glutamicum; identical to SEQ ID NO: 1209
  CDS (101)..(562): FRXA02537

SEQ ID NO: 1212 - protein, 154 aa, Corynebacterium glutamicum; identical to SEQ ID NO: 1210

SEQ ID NO: 1213 - DNA, 795 bp, Corynebacterium glutamicum
  CDS (101)..(772): RXN02538
gcgagatcaacgcgttgtgcacagcgattactccagaaccattgaagcatctgggcgattttggcactctaccgcctcagcaatccacgagtttcatttggtgaatgccccaccagaaatccgtgccttagccgaagcccatcccgatatgcagatcctagaagccggcgatggttcattggtagcatcgtttggggatattgatagggctacgaccgtgaccaccatcgtggcaggtgtgggttcctccaacccagaagggtggaatacatatgttgaccgtgcccgcacagtatctgcttccaccggttccgcaacggtgttgtggctgggatatcaagcacccgcttcgattcctgctgcggtatccggcgcggcagcgaatcgcgctgccgcggatctccagaggtttcaagcggcactacagtcccgcaatccccaccaaagaaaagtagtgatgggctacagctacggttccacagtggtgggaaaagctgcgtcttccggcgagctcagtgccgatgcgttggtattggttggcagtcccggcgcgggtgtctcgcactcttcccagcttggcgcacctgtgtatgcggtaacagggtctgctgatcccatcggttttgccggcacccaatatgacggcatccacggcactgatcccaccgctgccctattcggtgcaacagtgtgggattcgccctcaacgcattccggttattggaatgaccaggagttcctgggcaatgtggcggaggtggttcgcggcaaatagaaaagccgccgcacactgga

SEQ ID NO: 1214 - protein, 224 aa, Corynebacterium glutamicum
VNAPPEIRALAEAHPDMQILEAGDGSLVASFGDIDRATTVTTIVAGVGSSNPEGWNTYVDRARTVSASTGSATVLWLGYQAPASIPAAVSGAAANRAAADLQRFQAALQSRNPHQRKVVMGYSYGSTVVGKAASSGELSADALVLVGSPGAGVSHSSQLGAPVYAVTGSADPIGFAGTQYDGIHGTDPTAALFGATVWDSPSTHSGYWNDQEFLGNVAEVVRGK

SEQ ID NO: 1215 - DNA, 795 bp, Corynebacterium glutamicum; identical to SEQ ID NO: 1213
  CDS (101)..(772): FRXA02538

SEQ ID NO: 1216 - protein, 224 aa, Corynebacterium glutamicum; identical to SEQ ID NO: 1214

SEQ ID NO: 1217 - DNA, 726 bp, Corynebacterium glutamicum
  CDS (101)..(703): RXN02555
gttttatcgctatttaatacaggcctacccccactacccccattcagttcagggaatccccggatttaaaacaattaaaaaccctctagaatgagacattatgggcgaacaatttccaggcgataaaaacatccgagtcagcgacaccgaaagatcagcagcactagcagcactcggccagttctacgcagaaggtcgcctctccctagaagaaaccgacgaccgctgcgaagccgtcgccgacgccaaaacccgcggcgacctcaacgccatcttctacgatctgcccaaccaacaaatcgcagtcgtcgaccgctccgaacaaacctacacagccaccgaagttgccgaactccaccgcaaaggcgcacgcccacgcgccggaatcctcggactcaccacagttttagccatcaccggtaccgctgctttcgccagcaccacagcttttgcaacagtacttttagccctgattccgatcgtgttcatcatgctgtacgtgatgaaaattggtcctgaatcctggcacgcaccaacacctcgccaacttcagcgaaagcgcatgatcgaactgcgtgaaaaggaaaaactccgcgacatggagctcaaagcccagcgcaaggaacgcacccacgcattaaccaaccgcgcgttggatgctgctgaaactgctttcaacaccaagccctggaagaagaacaaatagggcttttgaagtgtgtcgcg

SEQ ID NO: 1218 - protein, 201 aa, Corynebacterium glutamicum
MGEQFPGDKNIRVSDTERSAALAALGQFYAEGRLSLEETDDRCEAVADAKTRGDLNAIFYDLPNQQIAVVDRSEQTYTATEVAELHRKGARPRAGILGLTTVLAITGTAAFASTTAFATVLLALIPIVFIMLYVMKIGPESWHAPTPRQLQRKRMIELREKEKLRDMELKAQRKERTHALTNRALDAAETAFNTKPWKKNK

SEQ ID NO: 1219 - DNA, 726 bp, Corynebacterium glutamicum; identical to SEQ ID NO: 1217
  CDS (101)..(703): FRXA02555

SEQ ID NO: 1220 - protein, 201 aa, Corynebacterium glutamicum; identical to SEQ ID NO: 1218

SEQ ID NO: 1221 - DNA, 1125 bp, Corynebacterium glutamicum
  CDS (101)..(1102): RXN02564
acaccacagtgaagcggtgacgtgaatcacccaagcacttaggcatcaaacattcaagagcttgttgtccaaaagtccgaccgagagggattcccccaaaatggccgaagtaggagcagaacccgcagggtctgcacaatccaaaactaaacaatttgttgtaggtaccgcagcggtggtcatcactgcaatcgctgcgtttttctccatccagtctgcatccggtggcgaggatattcgttccaacatgacgctgattgctcctgcagctgcaggtggaggttgggatactttccaacgtgagcagcagcagtctatgcgcgtgaataagatcgtgaacaatattcaggtggtcaacatccctggagctggtggaaccattgcacttggcaaactgtctaccatgactgcaccgaacaccttgatggtgggtggaacggggcatatcgcagcacaaattcaattcgatacccctgcgaaaatccaggatgtcaccccaattgctcgtgtggtggaagagttcgacatcatcaccgtgccagcggattctccatacaacacccttgaagagctcattgaaggttggaaggcagatccagcaggagtgtcctggaccggtggtggttcctttgaccagcttgttatgacagaaattgcactgtctgcaggtatagatcctaagcaaaccacctttattccttctgatggtggtggcgaagcgattcaggcgctactgaacggaaccgcaaaggcatcaactggtggttttgctgatatgtatccgcaggtagaagccggtcgattgaaggttttgggaattgctgcagaagaacgccttccaggttctgacattccaacgctagtggaacaaggctatgacgtgaccttgaccaactggcgtgccatgttcgctcctcctggtttgagcgatgatcaaattgcggaacttcgagcaatcgttgcggagtctgtggagactgctgaatggcagtccgcggtggaacgaaactactggatgaacgcctcacttgaaggcgaagaactcgaccagtttgttgaagatgaaattgaccgaattgatcagctattcaaggagatgggctagtgaacgtcactgaacaatcc

SEQ ID NO: 1222 - protein, 334 aa, Corynebacterium glutamicum
MAEVGAEPAGSAQSKTKQFVVGTAAVVITAIAAFFSIQSASGGEDIRSNMTLIAPAAAGGGWDTFQREQQQSMRVNKIVNNIQVVNIPGAGGTIALGKLSTMTAPNTLMVGGTGHIAAQIQFDTPAKIQDVTPIARVVEEFDIITVPADSPYNTLEELIEGWKADPAGVSWTGGGSFDQLVMTEIALSAGIDPKQTTFIPSDGGGEAIQALLNGTAKASTGGFADMYPQVEAGRLKVLGIAAEERLPGSDIPTLVEQGYDVTLTNWRAMFAPPGLSDDQIAELRAIVAESVETAEWQSAVERNYWMNASLEGEELDQFVEDEIDRIDQLFKEMG

SEQ ID NO: 1223 - DNA, 775 bp, Corynebacterium glutamicum
  CDS (101)..(775): FRXA02564
acaccacagtgaagcggtgacgtgaatcacccaagcacttaggcatcaaacattcaagagcttgttgtccaaaagtccgaccgagagggattcccccaaaatggccgaagtaggagcagaacccgcagggtctgcacaatccaaaactaaacaatttgttgtaggtaccgcagcggtggtcatcactgcaatcgctgcgtttttctccatccagtctgcatccggtggcgaggatattcgttccaacatgacgctgattgctcctgcagctgcaggtggaggttgggatactttccaacgtgagcagcagcagtctatgcgcgtgaataagatcgtgaacaatattcaggtggtcaacatccctggagctggtggaaccattgcacttggcaaactgtctaccatgactgcaccgaacaccttgatggtgggtggaacggggcatatcgcagcacaaattcaattcgatacccctgcgaaaatccaggatgtcaccccaattgctcgtgtggtggaagagttcgacatcatcaccgtgccagcggattctccatacaacacccttgaagagctcattgaaggttggaaggcagatccagcaggagtgtcctggaccggtggtggttcctttgaccagcttgttatgacagaaattgcactgtctgcaggtatagatcctaagcaaaccacctttattccttctgatggtggtggcgaagcgattcaggcgctactgaacggaaccgcaaaggcatcaactggtggttttgctgat

SEQ ID NO: 1224 - protein, 225 aa, Corynebacterium glutamicum
MAEVGAEPAGSAQSKTKQFVVGTAAVVITAIAAFFSIQSASGGEDIRSNMTLIAPAAAGGGWDTFQREQQQSMRVNKIVNNIQVVNIPGAGGTIALGKLSTMTAPNTLMVGGTGHIAAQIQFDTPAKIQDVTPIARVVEEFDIITVPADSPYNTLEELIEGWKADPAGVSWTGGGSFDQLVMTEIALSAGIDPKQTTFIPSDGGGEAIQALLNGTAKASTGGFAD

SEQ ID NO: 1225 - DNA, 1753 bp, Corynebacterium glutamicum
  CDS (101)..(1753): RXN02568
ccagctacgatatggaatttcaccaaatgcgaactaccctaaataccaaagacagacagtgacagccccttcgagaatgcagcaagagacgacacctcctatggacggcacctcgccacagaacaaaatttccaccactcccccagcgccaggaaatgctattcctgcacctggaggcgccattcctacaccagcgaaaactgagcaggacgcagtacctccaactgtggcggcgaaactacccgtacctggaagttctattccagcacccggtagagcattgccaactccagtggctccgggaggttccgtcccagctccgagagcgtccgcacctgcggttcctaacgttcctgcagctcccggcgctgctgttccagctccgggaatctcgatcccggcagcacctagtgccccaggcagtgcaattccaacaccaggcacagcaatccctgtgcctggaagtgcaactcctgtcccagcacctggggttagtgcacctggcgcaagcgttccaagcattccagtaccaggatctgtcaccccacctgcaccaggaatttccgcacctggcggtgcacttccgactcctggcagtgcgcccccaacacctggcggtgcccttccgactccaggtgaggcacttcccgttcccggagcacctggtgcacccggagcatccggaatcccaagtcctggccttccaaccccaggtgtcccaactcccggagcttccttaccagtcccaggagcaccagacgcacctggaaccccaagcattcccgcagctcccggcattcaagcaccaggaattccagcagcaccaggagcccctgcccaagctgctgctcacgcaaagccagtattccaagatgcagagaaacgacctcgcacagatgaagctggaaatgcgaagaaggaactgccgctgagagttcggttggcgcagccaattacacgtaagcagtgggcaatgactcttggtgtcctggttctcggagcaattgtcgtggctgcaatcgcggtggtccttgccaaatgggcgtttaccacggagtggttgcaggacttcgtcgagaagtatccgggtaaatatgacaaccccgaaggtgcgccagtaggaattccaacgtggctgagttggcagcacttcttcaacatgttcttcatggtgttgattatcaagacgggcattgagatcaatagaacccgcaggccaaagggttattggacgccgaaaaagggtggcaagaagatctccttgacgttgtggatccacctggttttggatttgttgtggatcatcaacggtgcggtgttcatcattttgttgttcgcgacgggtcagtggatgcgcattgttccaaccagttgggatgtgttcccgaacgcgctgagtgctggtttgcagtatgtgtcgttggattggccgactgagaatggttgggcgaattacaacagtttgcaggagctgacgtacttcttcactgtctttattgcggcaccgttgtcgattgtgtctggtttccggatgtcgagttactggcctaagaacaatgcgacgatgaataagttgatccccatcgggtttgctcgtgcgctgcacatgccagtgatggtgtattacatcgtgttcatttgtatccacgtgttcttggtgttggcgaccggcgcgttgcgcaatttcaaccatatgtatgcaggtcaagacgttgtgaactgggttggttttggttggttcgtggcgtcgttg

SEQ ID NO: 1226 - protein, 551 aa, Corynebacterium glutamicum
MDGTSPQNKISTTPPAPGNAIPAPGGAIPTPAKTEQDAVPPTVAAKLPVPGSSIPAPGRALPTPVAPGGSVPAPRASAPAVPNVPAAPGAAVPAPGISIPAAPSAPGSAIPTPGTAIPVPGSATPVPAPGVSAPGASVPSIPVPGSVTPPAPGISAPGGALPTPGSAPPTPGGALPTPGEALPVPGAPGAPGASGIPSPGLPTPGVPTPGASLPVPGAPDAPGTPSIPAAPGIQAPGIPAAPGAPAQAAAHAKPVFQDAEKRPRTDEAGNAKKELPLRVRLAQPITRKQWAMTLGVLVLGAIVVAAIAVVLAKWAFTTEWLQDFVEKYPGKYDNPEGAPVGIPTWLSWQHFFNMFFMVLIIKTGIEINRTRRPKGYWTPKKGGKKISLTLWIHLVLDLLWIINGAVFIILLFATGQWMRIVPTSWDVFPNALSAGLQYVSLDWPTENGWANYNSLQELTYFFTVFIAAPLSIVSGFRMSSYWPKNNATMNKLIPIGFARALHMPVMVYYIVFICIHVFLVLATGALRNFNHMYAGQDVVNWVGFGWFVASL

SEQ ID NO: 1227 - DNA, 1359 bp, Corynebacterium glutamicum
  CDS (1)..(1359): FRXA02568
atcccggcagcacctagtgccccaggcagtgcaattccaacaccaggcacagcaatccctgtgcctggaagtgcaactcctgtcccagcacctggggttagtgcacctggcgcaagcgttccaagcattccagtaccaggatctgtcaccccacctgcaccaggaatttccgcacctggcggtgcacttccgactcctggcagtgcgcccccaacacctggcggtgcccttccgactccaggtgaggcacttcccgttcccggagcacctggtgcacccggagcatccggaatcccaagtcctggccttccaaccccaggtgtcccaactcccggagcttccttaccagtcccaggagcaccagacgcacctggaaccccaagcattcccgcagctcccggcattcaagcaccaggaattccagcagcaccaggagcccctgcccaagctgctgctcacgcaaagccagtattccaagatgcagagaaacgacctcgcacagatgaagctggaaatgcgaagaaggaactgccgctgagagttcggttggcgcagccaattacacgtaagcagtgggcaatgactcttggtgtcctggttctcggagcaattgtcgtggctgcaatcgcggtggtccttgccaaatgggcgtttaccacggagtggttgcaggacttcgtcgagaagtatccgggtaaatatgacaaccccgaaggtgcgccagtaggaattccaacgtggctgagttggcagcacttcttcaacatgttcttcatggtgttgattatcaagacgggcattgagatcaatagaacccgcaggccaaagggttattggacgccgaaaaagggtggcaagaagatctccttgacgttgtggatccacctggttttggatttgttgtggatcatcaacggtgcggtgttcatcattttgttgttcgcgacgggtcagtggatgcgcattgttccaaccagttgggatgtgttcccgaacgcgctgagtgctggtttgcagtatgtgtcgttggattggccgactgagaatggttgggcgaattacaacagtttgcaggagctgacgtacttcttcactgtctttattgcggcaccgttgtcgattgtgtctggtttccggatgtcgagttactggcctaagaacaatgcgacgatgaataagttgatccccatcgggtttgctcgtgcgctgcacatgccagtgatggtgtattacatcgtgttcatttgtatccacgtgttcttggtgttggcgaccggcgcgttgcgcaatttcaaccatatgtatgcaggtcaagacgttgtgaactgggttggttttggttggttcgtggcgtcgttg

SEQ ID NO: 1228 - protein, 453 aa, Corynebacterium glutamicum
IPAAPSAPGSAIPTPGTAIPVPGSATPVPAPGVSAPGASVPSIPVPGSVTPPAPGISAPGGALPTPGSAPPTPGGALPTPGEALPVPGAPGAPGASGIPSPGLPTPGVPTPGASLPVPGAPDAPGTPSIPAAPGIQAPGIPAAPGAPAQAAAHAKPVFQDAEKRPRTDEAGNAKKELPLRVRLAQPITRKQWAMTLGVLVLGAIVVAAIAVVLAKWAFTTEWLQDFVEKYPGKYDNPEGAPVGIPTWLSWQHFFNMFFMVLIIKTGIEINRTRRPKGYWTPKKGGKKISLTLWIHLVLDLLWIINGAVFIILLFATGQWMRIVPTSWDVFPNALSAGLQYVSLDWPTENGWANYNSLQELTYFFTVFIAAPLSIVSGFRMSSYWPKNNATMNKLIPIGFARALHMPVMVYYIVFICIHVFLVLATGALRNFNHMYAGQDVVNWVGFGWFVASL

SEQ ID NO: 1229 - DNA, 720 bp, Corynebacterium glutamicum
  CDS (101)..(697): RXN02593
gcgttcacttccgccaccttgaggatgagtggtatcacgccagcacaacaaaaggatcttcatagggttattcagtctagctgcttttaaacaagccataatggaagccatggccacaacgatcaccgttttctctcccacccactcccccgcacaaatccgcgaaaccatcctcagcgccgcgaaagaagacgacgtggacttcctcggagtcccctttacccaccccagaaacgtcaccatcgaagtcgacgacgaactgatcaacgactgcttaggctggctcgacgacgtggcactcgcctccggcctgggcatccaatacaacgacgaagtgctccgctacggcgacgaagacatttcctttaccgtccaaaccaaaaatgacgatgacgcccgcatcggcgcctcccgccttggactcgagcaccagttgaacgtcattgccgggggctctggagattccggggattccggggattatttgaagattgcacacttcgacctagacaaccccgccgacgagtcctcctacatcttcgcgcgcagcctcgcagaagtagacggctggaccctagaattcggcgtcgcaggagtaaaaaacaccaccattgtttcctccatcgacgatgccatcaccaccattttgcgatggatgaacggcgaagacatccgcgacctcaactggacccgcgcataaatggcctcatttccggagct

SEQ ID NO: 1230 - protein, 199 aa, Corynebacterium glutamicum
MEAMATTITVFSPTHSPAQIRETILSAAKEDDVDFLGVPFTHPRNVTIEVDDELINDCLGWLDDVALASGLGIQYNDEVLRYGDEDISFTVQTKNDDDARIGASRLGLEHQLNVIAGGSGDSGDSGDYLKIAHFDLDNPADESSYIFARSLAEVDGWTLEFGVAGVKNTTIVSSIDDAITTILRWMNGEDIRDLNWTRA

SEQ ID NO: 1231 - DNA, 336 bp, Corynebacterium glutamicum
  CDS (101)..(313): FRXA02593
tgacgatgacgcccgcatcggcgcctcccgccttggactctagcaccagttgaacgtcattgccgggggctctggagattccggggattccggggattatttgaagattgcacacttcgacctagacaaccccgccgacgagtcctcctacatcttcgcgcgcagcctcgcagaagtagacggctggaccctagaattcggcgtcgcaggagtaaaaaacaccaccattgtttcctccatcgacgatgccatcaccaccattttgcgatggatgaacggcgaagacatccgcgacctcaactggacccgcgcataaatggcctcatttccggagct

SEQ ID NO: 1232 - protein, 71 aa, Corynebacterium glutamicum
LKIAHFDLDNPADESSYIFARSLAEVDGWTLEFGVAGVKNTTIVSSIDDAITTILRWMNGEDIRDLNWTRA

SEQ ID NO: 1233 - DNA, 447 bp, Corynebacterium glutamicum
  CDS (101)..(424): FRXA02594
gcgttcacttccgccaccttgaggatgagtggtatcacgccagcacaacaaaaggatcttcatagggttattcagtctagctgcttttaaacaagccataatggaagccatggccacaacgatcaccgttttctctcccacccactcccccgcacaaatccgcgaaaccatcctcagcgccgcgaaagaagacgacgtggacttcctcggagtcccctttacccaccccagaaacgtcaccatcgaagtcgacgacgaactgatcaacgactgcttaggctggctcgacgacgtggcactcgcctccggcctgggcatccaatacaacgacgaagtgctccgctacggcgacgaagacatttcctttaccgtccaaaccaaaaatgacgatgacgcccgcatcggcgcctcccgccttggactctagcaccagttgaacgtcattgc

SEQ ID NO: 1234 - protein, 108 aa, Corynebacterium glutamicum
MEAMATTITVFSPTHSPAQIRETILSAAKEDDVDFLGVPFTHPRNVTIEVDDELINDCLGWLDDVALASGLGIQYNDEVLRYGDEDISFTVQTKNDDDARIGASRLGL

SEQ ID NO: 1235 - DNA, 1494 bp, Corynebacterium glutamicum
  CDS (101)..(1471): RXN02606
agggcgcggatcacttcggatctgtggataacttttaaggcccttgttttccccttgaagcttcggttgtgtggaaaacagaaaaggaggggaaaacaaaatgcaagaaatccacaccatcatgaaacacatggacgcgctcatcgccgacccgtccgccgccgcattcaaagcaacactccccttcgccgaactcctcgaaaagctccacaacaaaaaagcgcttttcgacgccgccctcgccaaatccgccgagcgcgccgatgccggacgcatcatcggaaaaacctcccacatcgatgccctcgcgtaccttctcgacatctccaaatccgaagcattccgacgcacaaaacgcgccgaagaacactacggcaacccaagcccggaacccagttcagaagaactcgcgaaagaaacccccgaagagaagctagccagagaagaaaaagagaaacaagacctagccgaacaagcagaagccaaccgcatcgcccgcgaacacggcatctccgccgaaaaacaagacaccatccgctacgaactagaaaaactcaacgacaacacatccctatcccgagcctcactccgcaaactagcaatgcaggaagccaccagccgaacccccgaagacctacgcaactggacccgcaacaaagttatccgcataaaccccaccgccaaagacccactcgccgcagtaaagaaacgctccttaagcatcggacgccaagaccacgacggcggagccaaagcatccctctatttagatgccaaaggtctagccctgctcaaatcactgatgtctaaagccaagccggggcatttgcttgaagactctttggcggaggataaacgtacgaaaccgcaacgccaatacgatgccttcgccgacatcctccaccgcgcacacagcgatctcctccccgcacgatccggagtgggcaccatcctcgtctccctctccgccaaagacgtaacaaacctcaaagcatcgggccccgaccaccgctaccccaccagcaccggcataaaactcacaccgcttgagatcctgcgactcggtgcagccaaatatgacttcgtgaccgtcctcgactccgaatccggccgtccgctgcacctggcacgcactcaacgcaccgccagcctgtatcaacgcctagccctcttcgcctccgaactcgtctgcacccgcgaaggctgcgactcccccttcgaagacaacgaaatacaccacatcagatcctggctagacggcggccccacagacatagaaaacatcaccaacatctgcccccacgaccacggaaacaacaacgaccaacgcgacggcaaagacaacatggggcacatgaacatagatcccacaaccgggcgcgtcggatatcaacccgccgaccgccgaaaacccatgcggtttaacaacaccgcagccgcagcagaatcaggaggagcacaggccaggacctaagtttttagcgcgccaaaaag

SEQ ID NO: 1236 - protein, 457 aa, Corynebacterium glutamicum
MQEIHTIMKHMDALIADPSAAAFKATLPFAELLEKLHNKKALFDAALAKSAERADAGRIIGKTSHIDALAYLLDISKSEAFRRTKRAEEHYGNPSPEPSSEELAKETPEEKLAREEKEKQDLAEQAEANRIAREHGISAEKQDTIRYELEKLNDNTSLSRASLRKLAMQEATSRTPEDLRNWTRNKVIRINPTAKDPLAAVKKRSLSIGRQDHDGGAKASLYLDAKGLALLKSLMSKAKPGHLLEDSLAEDKRTKPQRQYDAFADILHRAHSDLLPARSGVGTILVSLSAKDVTNLKASGPDHRYPTSTGIKLTPLEILRLGAAKYDFVTVLDSESGRPLHLARTQRTASLYQRLALFASELVCTREGCDSPFEDNEIHHIRSWLDGGPTDIENITNICPHDHGNNNDQRDGKDNMGHMNIDPTTGRVGYQPADRRKPMRFNNTAAAAESGGAQART

SEQ ID NO: 1237 - DNA, 1494 bp, Corynebacterium glutamicum; identical to SEQ ID NO: 1235
  CDS (101)..(1471): FRXA02606

SEQ ID NO: 1238 - protein, 457 aa, Corynebacterium glutamicum; identical to SEQ ID NO: 1236

SEQ ID NO: 1239 - DNA, 1050 bp, Corynebacterium glutamicum
  CDS (101)..(1027): RXN02610
ccagctcatcgtgcagggacgcaccagcgtgaaggaagatcaagcagcggaaatttctacgctgctgaaggaatctgcggatcggacgtattgttaaccgatgaggaaaaccatcaccgttattgctgtattgatcgtcctcgccttaatcggcgtgggcatcgtgcagtatgtgaacacatccgatgactcagatttcattggccagcctggcgagccaaccggtaccgaaaccacggaaccaccggttcaacctgattggtgccctgcggtagaagtcattgccgcgccgggtacgtgggagtcggctgctaatgatgatccgatcaacccgaccgctaatccgctgtcattcatgttgagcatcactcagccactgcaggagcgttattctgcggatgacgtcaaggtgtggacgctgccgtacactgcgcagttccgcaacatcaactcgcaaaatgagatgtcctatgatgattcgcgcaatgaaggcaccgcgaagatgaatgaggaactgatcaacactcacaatgagtgccctgccacggagttcatcatcgttggtttctcccagggtgcggtcattgcgggcgatgtggctgctcagatcggttcagagcaaggtgttattccagctgacagcgtcaggggtgtcgccctgatcgctgacggtcgccgggagcctggtgtgggccagttcccaggcacgtttgtggatggcatcggcgcggaggttactctgcagcctttgaacttgctggtgcagccgattgttccgggcgcaaccatgcgtggcgggcgcgcgggcggtttcggtgtgctcaacgaccgggtgcaggatatttgtgctccaaatgatgcgatctgtgatgctccggtgaatgtcggcaacgcccttgatcgtgcgttggccatggtctccgccaacggtgtgcacgcgctctacgccaccaatccggatgttttcccaggcacaaccaccaatgcgtgggttgtggattgggcgaccaacctcatcgacaacggataaagctttttcgcttttcgacg

SEQ ID NO: 1240 - protein, 309 aa, Corynebacterium glutamicum
MRKTITVIAVLIVLALIGVGIVQYVNTSDDSDFIGQPGEPTGTETTEPPVQPDWCPAVEVIAAPGTWESAANDDPINPTANPLSFMLSITQPLQERYSADDVKVWTLPYTAQFRNINSQNEMSYDDSRNEGTAKMNEELINTHNECPATEFIIVGFSQGAVIAGDVAAQIGSEQGVIPADSVRGVALIADGRREPGVGQFPGTFVDGIGAEVTLQPLNLLVQPIVPGATMRGGRAGGFGVLNDRVQDICAPNDAICDAPVNVGNALDRALAMVSANGVHALYATNPDVFPGTTTNAWVVDWATNLIDNG

SEQ ID NO: 1241 - DNA, 1050 bp, Corynebacterium glutamicum; identical to SEQ ID NO: 1239
  CDS (101)..(1027): FRXA02610

SEQ ID NO: 1242 - protein, 309 aa, Corynebacterium glutamicum; identical to SEQ ID NO: 1240

SEQ ID NO: 1243 - DNA, 1419 bp, Corynebacterium glutamicum
  CDS (101)..(1396): RXN02624
acccggtcagatccgacgtcgccggccaaaaccgcaagcacctgcgcaaacgccacagaaggcagctcagcaatcaaagttgctgcgtttccttccaaccgtgctgattccgcatggcgtggcggtgcttttggttattattctcgccgtagcctccctaatgttcaccaattcttcaatggtgaatctttcggcaacgattgcacagctgtggctttccctaaatctcggtgcggtggacggcagtggggaagtgatctcagtactgcccacgcttcccggctttatattcctctgggccatcgccgcgcgcatccaccgcgcagtcaaagatcgtgtcagcatcgccgacttaggcgtcctcgcagcactcgtcctcggcatcccgcttgcgctcaccgccatcgcagcgttcatgcttttcgacgcctccagcgtcctcaacgtcgaggtcccgccaatcacgcgcctcctacgcgtgatgttgttccacctcagcgccctcttcctcggcatggggccacgcctgtggcaggcgttggcgcgccgctacggtgctccagaatggcttatcgacgccatcacccaagctttccgcttcctcatcgcatttggaacagtctccttggtttccgtgctcgtgatgaccgcgatcaaccacagtgcattcaccgcgaccatgcagggttacgacgactccgcctctgttgtggccttgatcgtcctgagcattctgtatctgcccaacatgatgatctttgcgatgggcaatctgatcggctcacccctttacttcggtgacgcctccatcagcgtcttcagcgtgcattccgttccattgccaccgcttcccatcctcgcagctctccccagcgaagccctctcatgggcagtggccttactggtcatccctgcaattattgccacctgggtctgcgtgagaaaccccatgcgccttgccgtgaacacaacagcagcagtcatttcagcactgtgtttcctcgtcctggcagttttcgccggcggaaccttgggcgtatacaactacgtcggactcaacctcctggcgtcagttggcctagttttcgtctatttcgccctcgttggactcctcatcgccggaatcgacaagctgcgcaaccctgtagaagttaagtctgttaaggctgtggctgttgtggagcccgagcctgaagaagttgaagaggacgaagaggagcatgttgaagaagaagtagatgaggaggaagaggaagttgaggaaggggtagaagaggtcgaagaagacgacgcagaggatcctgaagagaatcctgaagaggaagaatccgacgaagaaattgagacagaaactgaggctgaagaaaccaatgatggttccgaggccgaagaccgttaacatatctgttgtgaattctg

SEQ ID NO: 1244 - protein, 432 aa, Corynebacterium glutamicum
VLIPHGVAVLLVIILAVASLMFTNSSMVNLSATIAQLWLSLNLGAVDGSGEVISVLPTLPGFIFLWAIAARIHRAVKDRVSIADLGVLAALVLGIPLALTAIAAFMLFDASSVLNVEVPPITRLLRVMLFHLSALFLGMGPRLWQALARRYGAPEWLIDAITQAFRFLIAFGTVSLVSVLVMTAINHSAFTATMQGYDDSASVVALIVLSILYLPNMMIFAMGNLIGSPLYFGDASISVFSVHSVPLPPLPILAALPSEALSWAVALLVIPAIIATWVCVRNPMRLAVNTTAAVISALCFLVLAVFAGGTLGVYNYVGLNLLASVGLVFVYFALVGLLIAGIDKLRNPVEVKSVKAVAVVEPEPEEVEEDEEEHVEEEVDEEEEEVEEGVEEVEEDDAEDPEENPEEEESDEEIETETEAEETNDGSEAEDR

SEQ ID NO: 1245 - DNA, 737 bp, Corynebacterium glutamicum
  CDS (1)..(714): FRXA02624
cagggctacgacgactccgcctctgttgtggccttgatcgtcctgagcattctgtatctgcccaacatgatgatctttgcgatgggcaatctgatcggctcacccctttacttcggtgacgcctccatcagcgtcttcagcgtgcattccgttccattgccaccgcttcccatcctcgcagctctccccagcgaagccctctcatgggcagtggccttactggtcatccctgcaattattgccacctgggtctgcgtgagaaaccccatgcgccttgccgtgaacacaacagcagcagtcatttcagcactgtgtttcctcgtcctggcagttttcgccggcggaaccttgggcgtatacaactacgtcggactcaacctcctggcgtcagttggcctagttttcgtctatttcgccctcgttggactcctcatcgccggaatcgacaagctgcgcaaccctgtagaagttaagtctgttaaggctgtggctgttgtggagcccgagcctgaagaagttgaagaggacgaagaggagcatgttgaagaagaagtagatgaggaggaagaggaagttgaggaaggggtagaagaggtcgaagaagacgacgcagaggatcctgaagagaatcctgaagaggaagaatccgacgaagaaattgagacagaaactgaggctgaagaaaccaatgatggttccgaggccgaagaccgttaacatatctgttgtgaattctg

SEQ ID NO: 1246 - protein, 238 aa, Corynebacterium glutamicum
QGYDDSASVVALIVLSILYLPNMMIFAMGNLIGSPLYFGDASISVFSVHSVPLPPLPILAALPSEALSWAVALLVIPAIIATWVCVRNPMRLAVNTTAAVISALCFLVLAVFAGGTLGVYNYVGLNLLASVGLVFVYFALVGLLIAGIDKLRNPVEVKSVKAVAVVEPEPEEVEEDEEEHVEEEVDEEEEEVEEGVEEVEEDDAEDPEENPEEEESDEEIETETEAEETNDGSEAEDR

SEQ ID NO: 1247 - DNA, 1128 bp, Corynebacterium glutamicum
  CDS (101)..(1105): RXN02626
gtagcggtcgaattatttgcctgtgggcataattttgagacaaaataatagaaacgtctcagatgttgggaagttcttcacgctatcagttagggagcacatgagtactcaagttgaactcaaaacaccgaaatcggaagaccgggcagcatatatcgctgcattgggattcccggtcttggtcatcattggcggcatcatcggattcacagcctcggatgttgtgctcaatatttcttcgtgggtcaatcctttgctgggcatcatcatgttctccatgggcctgaccttgaagccagttgacttcgcccttgttgctaaacgcccactcccagttcttatcggcgtgatcgcccagtttgtcatcatgcccctgatcgcattgctggtggtctgggttttgcagctgcctgcggaaattgcggccggtgtcatcttggttggttgtgcacctggcggaacttcctccaacgtggtgtcttacctgtcccgtggtgatgttgcgctgtctgtcaccatgacttccatctccacgctgcttgctccaattttcactccactgcttaccctgtggctggcggggcaatacatgccacttaatgccgctgatatggctgtatccatcgtccaagttgtgctgatcccagtcgtgggcggacttgttgtgcggttgatcttcccgacactcattggcaaggttttgcctcttttgccatggatttcagtcattgcgatttcattgatcgttgccatcgtggtcgctggttcaagggataaaatcctcgaagcaggactgctcgtgctggctgccgtgattattcacaacaccctcggctactccctgggatacctcgctgcgaaattcactgggcagcctgctgcagctcgacgcactaccgcgattgaggtcggtatgcaaaactccggcctcgcagatggactcgcatcccagtacatgtcaccaatgtctgctctgccaggcgctatcttctctgtctggcacaacctttccggagcacttcttgctgcattgtgcagggcgtccgataagagggctgcggagaaggtggcttcagaaaaggctgcctcggagaaggccgcttcctaaaaggcttcgctcctaaaact

SEQ ID NO: 1248 - protein, 335 aa, Corynebacterium glutamicum
MSTQVELKTPKSEDRAAYIAALGFPVLVIIGGIIGFTASDVVLNISSWVNPLLGIIMFSMGLTLKPVDFALVAKRPLPVLIGVIAQFVIMPLIALLVVWVLQLPAEIAAGVILVGCAPGGTSSNVVSYLSRGDVALSVTMTSISTLLAPIFTPLLTLWLAGQYMPLNAADMAVSIVQVVLIPVVGGLVVRLIFPTLIGKVLPLLPWISVIAISLIVAIVVAGSRDKILEAGLLVLAAVIIHNTLGYSLGYLAAKFTGQPAAARRTTAIEVGMQNSGLADGLASQYMSPMSALPGAIFSVWHNLSGALLAALCRASDKRAAEKVASEKAASEKAAS

SEQ ID NO: 1249 - DNA, 963 bp, Corynebacterium glutamicum
  CDS (101)..(940): RXN02656
gccatgtgggacagtctagccatctccttacacccgtgaaactcctatttcattaacgcattgatctcggcttttctaacctaggtataaggtaacagctatgattttcggcgtactcgcatacttgggatggggcatgttcccggcctttttcccactacttcttccggcaggaccgttcgaaattttagcgcatcggatcctatggactgctgtattaatgatgattatcattagtttcacgtcgggatggaaagagcttaagtccgctgatcgcggtacatggttacgcattatattgtcatcgttgtttattgccgggaactggctgatctatgtcatcgctgtcaattctgggcaagttactgaagccgctctcggatactttattaaccccctgttaagtgtcgtgcttggcattgtgttcttcaaagaacagttacgaaaactgcaaattagtgcggtggttattgctgctgcgggggttttggtactaacatttctaggtgataagccaccgtatttagcgataacactagcatttacattcggcatctatggagcgttgaaaaaacaagtcaagatgtctgctgctagttctttgtgcgctgaaactttagtactgctgcccatcgcagtcatatacctgattgggctcgaagcttccggtcacagtacctttttcaacaatggcagtgggcacatggcgttattaatctgctcgggtttggtcacagccgtcccgctgttgatgtttgcattggccgccaaggcaatacctctttccactgtcggcatgctgcaatatctgaccccaacgatgcagatgctgtgggcattgtttgtggtcaacgaatcagtagaaccaatgcgttggttcggattcgttttcatttggatcgcagttactatttacatcacagatagcctacttaagaagtaggtaatagcagtattgatatg

SEQ ID NO: 1250 - protein, 280 aa, Corynebacterium glutamicum
MIFGVLAYLGWGMFPAFFPLLLPAGPFEILAHRILWTAVLMMIIISFTSGWKELKSADRGTWLRIILSSLFIAGNWLIYVIAVNSGQVTEAALGYFINPLLSVVLGIVFFKEQLRKLQISAVVIAAAGVLVLTFLGDKPPYLAITLAFTFGIYGALKKQVKMSAASSLCAETLVLLPIAVIYLIGLEASGHSTFFNNGSGHMALLICSGLVTAVPLLMFALAAKAIPLSTVGMLQYLTPTMQMLWALFVVNESVEPMRWFGFVFIWIAVTIYITDSLLKK

SEQ ID NO: 1251 - DNA, 756 bp, Corynebacterium glutamicum
  CDS (101)..(733): RXN02673
acgcccaaaacgctaatccgctgaacaggccgatgaaagtaatagagtgttctgtgtgggaacgccgagacataatgaagtcatttacaagcgccgccgcatggcagcgctcctagttctgctcgtcgtgattgccttgattatctgggcagtcgtcgcgcttcgaggtggatcatcggagcctgaggaagagcagccaaataatgctgtagtgacctcctcaatggaatcttccgcgacgtctagttcttcttctaaagaatccacgactgaagccaccacagaagaagagacttccagtgctgaaccaaccgcaacatcctccgttgcagcagatgcaaaaaagacctgtgagcttagtgacttggtgatttccgcaagcactaatcagccgactttctcaggttctgcgcagccagaattatttatggctgtgcataatccgactgctgttgattgcgaaattgacctcgaggagaacaaactccgtttcgaggtatacaatctcgcgaccaacgcacgaatctggtctgatgtcgactgcaaccctgcagttgaagacggcacgagcgtgttccctgccggcgaggatcgctacttccaggcaacatggtctcgtaccacttcagcgccaaaccagtgcaacaaccgcactgatgtccccgccggtggctactacttgcacactgtggtcggtaataacccttcaccagcggtgacctttaacctaacttaaacggccaagtccgtcggtga

SEQ ID NO: 1252 - protein, 211 aa, Corynebacterium glutamicum
MAALLVLLVVIALIIWAVVALRGGSSEPEEEQPNNAVVTSSMESSATSSSSSKESTTEATTEEETSSAEPTATSSVAADAKKTCELSDLVISASTNQPTFSGSAQPELFMAVHNPTAVDCEIDLEENKLRFEVYNLATNARIWSDVDCNPAVEDGTSVFPAGEDRYFQATWSRTTSAPNQCNNRTDVPAGGYYLHTVVGNNPSPAVTFNLT

SEQ ID NO: 1253 - DNA, 756 bp, Corynebacterium glutamicum; identical to SEQ ID NO: 1251
  CDS (101)..(733): FRXA02673

SEQ ID NO: 1254 - protein, 211 aa, Corynebacterium glutamicum; identical to SEQ ID NO: 1252

SEQ ID NO: 1255 - DNA, 1407 bp, Corynebacterium glutamicum
  CDS (101)..(1384): RXN02680
aataccaggtcaacacacacaggaaccgttcagaaaccttccagattgctcactttttaatttcacttttttgagaagttttacttttatattagttctcatgcgcctcaacaaacgactcccagcggcactctccggactgctgctctctgctgcccttcttgccggatgctccacttctggaaccgccgagaccacgacaacaaccgtttcatctgctgcggcatcaacaaccacttccacctcctctgcttcgtcttcctcttcctcctcctcttcctcctcttcctccgactcaagcaccaccgccgaaaccatctccaacaccgcggaagctgcccaagctttcttgtccaccctgtccaccgaagaacaagacgccgtactctacgactacgacgccgaagaaaagtccaccggctggtctaacttcccagtcaccttcgtgcagcgttccggcgtgaacctcaccgacctcactgaggaacagcaagcagctgccctcaacgtgctgaagaacctgctcaacgacgacgcctaccaaatgatcgaagacatcatggctagcgatcagtacctcaacgacgaaagcaacaccaccgaggattccctcggccagtactacatcgcattcttcggcgatccaagcagcgactccgactggtccatccaattcggcggacaccacatcggcatcaacaccaccttctccgacggtgccatcaccttcgccccaacccaccttggcacccagccttccgagtggaccaacgaggacggcgaaaccgttgcagcactaagcaacatgtacgaaaccgccttcgccttctacgacagcctcgccgaagagcagcaagcacagctctaccagggtgaagagttggattccatggtgtgcgcaccgggcagcacgtgcgactacccaaccggcaccggcttgaaaggctctgacctcaccgatgagcaaaaagaattgctcatcgatgtcatcgcaaactgggttggcctcgccgatgaggaaaccaccgaaactgaactcgatgccatccgcgaaaccctggatgacacctacatcaactggtccggcgccaccgagtacgacacctccaccggcgacggcatctacttccagatcagtggcccaaaggtctacattgagttcgctaaccagcaaggttctgcaggtgccgacatcgacggtgtcatcaccgctggatggggccacattcacaccatctaccgcgacccaaccaatgactacgctaactccgtaactcaggaagcagccagcggaatgatgggcggcggccctggtggtaatggtggcgagatgcctagcggtgacatgcctactggtgagatgccttctggcgctccatcaaactaacgccatttaagaggccgaac

SEQ ID NO: 1256 - protein, 428 aa, Corynebacterium glutamicum
MRLNKRLPAALSGLLLSAALLAGCSTSGTAETTTTTVSSAAASTTTSTSSASSSSSSSSSSSSSDSSTTAETISNTAEAAQAFLSTLSTEEQDAVLYDYDAEEKSTGWSNFPVTFVQRSGVNLTDLTEEQQAAALNVLKNLLNDDAYQMIEDIMASDQYLNDESNTTEDSLGQYYIAFFGDPSSDSDWSIQFGGHHIGINTTFSDGAITFAPTHLGTQPSEWTNEDGETVAALSNMYETAFAFYDSLAEEQQAQLYQGEELDSMVCAPGSTCDYPTGTGLKGSDLTDEQKELLIDVIANWVGLADEETTETELDAIRETLDDTYINWSGATEYDTSTGDGIYFQISGPKVYIEFANQQGSAGADIDGVITAGWGHIHTIYRDPTNDYANSVTQEAASGMMGGGPGGNGGEMPSGDMPTGEMPSGAPSN

SEQ ID NO: 1257 - DNA, 1407 bp, Corynebacterium glutamicum; identical to SEQ ID NO: 1255
  CDS (101)..(1384): FRXA02680

SEQ ID NO: 1258 - protein, 428 aa, Corynebacterium glutamicum; identical to SEQ ID NO: 1256

SEQ ID NO: 1259 - DNA, 549 bp, Corynebacterium glutamicum
  CDS (101)..(526): FRXA02679
caccattaccaccagggccgccgcccatcattccgctggctgcttcctgagttacggagttagcgtagtcattggttgggtcgcggtagatggtgtgaatgtggccccatccagcggtgatgacaccgtcgatgtcggcacctgcagaaccttgctggttagcgaactcaatgtagacctttgggccactgatctggaagtagatgccgtcgccggtggaggtgtcgtactcggtggcgccggaccagttgatgtaggtgtcatccagggtttcgcggatggcatcgagttcagtttcggtggtttcctcatcggcgaggccaacccagtttgcgatgacatcgatgagcaattctttttgctcatcggtgaggtcagagcctttcaagccggtgccggttgggtagtcgcacgtgctgcccggtgcgcacaccatggaatccaactcttcaccctggtagagctgtgcttgctgctcttcggcgaggctgtcgtagaaggcgaaggcggtttcgtacatgttgcttagtgctgcaacggtttcgccgt

SEQ ID NO: 1260 - protein, 142 aa, Corynebacterium glutamicum
VAPSSGDDTVDVGTCRTLLVSELNVDLWATDLEVDAVAGGGVVLGGAGPVDVGVIQGFADGIEFSFGGFLIGEANPVCDDIDEQFFLLIGEVRAFQAGAGWVVARAARCAHHGIQLFTLVELCLLLFGEAVVEGEGGFVHVA

SEQ ID NO: 1261 - DNA, 567 bp, Corynebacterium glutamicum
  CDS (101)..(544): FRXA02681
cgaggctgtcgtagaaggcgaaggcggtttcgtacatgttgcttagtgctgcaacggtttcgccgtcctcgttggtccactcggaaggctgggtgccaaggtgggttggggcgaaggtgatggcaccgtcggagaaggtggtgttgatgccgatgtggtgtccgccgaattggatggaccagtcggagtcgctgcttggatcgccgaagaatgcgatgtagtactggccgagggaatcctcggtggtgttgctttcgtcgttgaggtactgatcgctagccatgatgtcttcgatcatttggtaggcgtcgtcgttgagcaggttcttcagcacgttgagggcagctgcttgctgttcctcagtgaggtcggtgaggttcacgccggaacgctgcacgaaggtgactgggaagttagaccagccggtggacttttcttcggcgtcgtagtcgtagagtacggcgtcttgttcttcggtggacagggtggacaagaaagcttgggcagcttccgcggtgttggagatggtttcggcggtggtgcttgagtcggaggaagaggaggaag

SEQ ID NO: 1262 - protein, 148 aa, Corynebacterium glutamicum
VGWGEGDGTVGEGGVDADVVSAELDGPVGVAAWIAEECDVVLAEGILGGVAFVVEVLIASHDVFDHLVGVVVEQVLQHVEGSCLLFLSEVGEVHAGTLHEGDWEVRPAGGLFFGVVVVEYGVLFFGGQGGQESLGSFRGVGDGFGGGA

SEQ ID NO: 1263 - DNA, 1899 bp, Corynebacterium glutamicum
  CDS (101)..(1876): RXN02693
cagaccaagtgttatttttgttgaaaaaatcacattgtaaatcgagcaaaaccaacctatgccctgcagaattgtgcatgctctgccaagatgactcaatatggtttcgctccccagactagcgtctctgctcaccactcgcctggcaacgcttaaacccgcactaaaacctgccacccacctcgcctccctcggcgcgcaggtcattgcagagctagttccggggatccgaatgtcgccaaaccgcaggcgaatcctccctgcaaatatgggcgctggctttatcggagcggaaatcgcaatgtggtgggctctctcgccgtcattgttgccgaaaccgtggtgggttacggctgctaacctggctgttttacaagcggtggggcatgcggcagcgacgggaatccactcgatcctccccagaaccaaccggcgggtatccaggaaaatttacaacgccacccacatcgcaactggtgccatcacgttgaccaccacggttgtgggattgatcaggcatcgcacccaaatccggctgattgggcagaagaattttggaccgaaggagacgatcgcgggcattagtgtcggcaccttggggtacggcgcgctgctgatcaccggcgaattaacccagcacagtattaatgaggtcaagctcctaattgagaggtttttaccgccgtggataagtttcatcgcagcggtttcggtcattacattgaccactttgaccttggccgatcgcgttttgttgcggcgcatcttgcataattctgcaattcaagcagcgcaccttaatcgcatggtgttcccaggaactgagcagccgtgggagccggagcgttcgggtagcccgtggtcgtatgaaaaatggggtgcggtgggttcgcagggccgtgcagtgttgtcgggaggcccacgcaaagatgacatcatcacggtaaccaggctttctgacacggaaacacatgaaccgattcgtatttttatcggtatggttccgggacgatccttaagcgatcaggtggatcttgtcattcatgaaatgcgccgcacgggagccctgcgccgcgaccacatcgtgatcaacaattccacgggcaccggctggatcaccgattggtccgcccacacctttgagttcctcaccggcggaaactgcgtgacaatttccatgcaatattcttatcttcccagtgcactgagctggtacaaggacaacgacggccccattaatgcggcgagaatgcttatcgacgccgtcctccacgagctagaccagcttcccaccgggagtcgcccaaagctgttcctcgcgggagagtcactgggggcgtatgggttggctgaggtgtggggagacgtcgaaaagcttcttggaaccgctgacggcgtgctgctcagtggggcgccgcgtttttcggacgccatgaatgcgttgcgcacccggcgcgatgcgagcagctccgagcggctgcccgtgattgatagcgggcggcacatccgttttgcgggcgagcctgagcaccttgatatgccggctacctggcagtttccgcgcatgatcgtggcgcagcacgcctctgatccaattgtgtggtggaacgcggagctgtttattcggcggccggaatggttgaaaactcccaagcaagaccaccaagatgtctttccccgcttgcgatggatgccgtttgtaaccggctggcaggtggctttggatttgttcacttcaacctccgttcccggcgggcacgggcacaattatcacgaggagtttattgattattgggcagctcttttggaccgcgaagtcacccccgagctgcgccacagcattgcttattggatccgcgcgaaccacatcaaacgctagagtgattccatgacgcatgc

SEQ ID NO: 1264 - protein, 592 aa, Corynebacterium glutamicum
MVSLPRLASLLTTRLATLKPALKPATHLASLGAQVIAELVPGIRMSPNRRRILPANMGAGFIGAEIAMWWALSPSLLPKPWWVTAANLAVLQAVGHAAATGIHSILPRTNRRVSRKIYNATHIATGAITLTTTVVGLIRHRTQIRLIGQKNFGPKETIAGISVGTLGYGALLITGELTQHSINEVKLLIERFLPPWISFIAAVSVITLTTLTLADRVLLRRILHNSAIQAAHLNRMVFPGTEQPWEPERSGSPWSYEKWGAVGSQGRAVLSGGPRKDDIITVTRLSDTETHEPIRIFIGMVPGRSLSDQVDLVIHEMRRTGALRRDHIVINNSTGTGWITDWSAHTFEFLTGGNCVTISMQYSYLPSALSWYKDNDGPINAARMLIDAVLHELDQLPTGSRPKLFLAGESLGAYGLAEVWGDVEKLLGTADGVLLSGAPRFSDAMNALRTRRDASSSERLPVIDSGRHIRFAGEPEHLDMPATWQFPRMIVAQHASDPIVWWNAELFIRRPEWLKTPKQDHQDVFPRLRWMPFVTGWQVALDLFTSTSVPGGHGHNYHEEFIDYWAALLDREVTPELRHSIAYWIRANHIKR

SEQ ID NO: 1265 - DNA, 1747 bp, Corynebacterium glutamicum
  CDS (101)..(1747): FRXA02693
cagaccaagtgttatttttgttgaaaaaatcacattgtaaatcgagcaaaaccaacctatgccctgcagaattgtgcatgctctgccaagatgactcaatatggtttcgctccccagactagcgtctctgctcaccactcgcctggcaacgcttaaacccgcactaaaacctgccacccacctcgcctccctcggcgcgcaggtcattgcagagctagttccggggatccgaatgtcgccaaaccgcaggcgaatcctccctgcaaatatgggcgctggctttatcggagcggaaatcgcaatgtggtgggctctctcgccgtcattgttgccgaaaccgtggtgggttacggctgctaacctggctgttttacaagcggtggggcatgcggcagcgacgggaatccactcgatcctccccagaaccaaccggcgggtatccaggaaaatttacaacgccacccacatcgcaactggtgccatcacgttgaccaccacggttgtgggattgatcaggcatcgcacccaaatccggctgattgggcagaagaattttggaccgaaggagacgatcgcgggcattagtgtcggcaccttggggtacggcgcgctgctgatcaccggcgaattaacccagcacagtattaatgaggtcaagctcctaattgagaggtttttaccgccgtggataagtttcatcgcagcggtttcggtcattacattgaccactttgaccttggccgatcgcgttttgttgcggcgcatcttgcataattctgcaattcaagcagcgcaccttaatcgcatggtgttcccaggaactgagcagccgtgggagccggagcgttcgggtagcccgtggtcgtatgaaaaatggggtgcggtgggttcgcagggccgtgcagtgttgtcgggaggcccacgcaaagatgacatcatcacggtaaccaggctttctgacacggaaacacatgaaccgattcgtatttttatcggtatggttccgggacgatccttaagcgatcaggtggatcttgtcattcatgaaatgcgccgcacgggagccctgcgccgcgaccacatcgtgatcaacaattccacgggcaccggctggatcaccgattggtccgcccacacctttgagttcctcaccggcggaaactgcgtgacaatttccatgcaatattcttatcttcccagtgcactgagctggtacaaggacaacgacggccccattaatgcggcgagaatgcttatcgacgccgtcctccacgagctagaccagcttcccaccgggagtcgcccaaagctgttcctcgcgggagagtcactgggggcgtatgggttggctgaggtgtggggagacgtcgaaaagcttcttggaaccgctgacggcgtgctgctcagtggggcgccgcgtttttcggacgccatgaatgcgttgcgcacccggcgcgatgcgagcagctccgagcggctgcccgtgattgatagcgggcggcacatccgttttgcgggcgagcctgagcaccttgatatgccggctacctggcagtttccgcgcatgatcgtggcgcagcacgcctctgatccaattgtgtggtggaacgcggagctgtttattcggcggccggaatggttgaaaactcccaagcaagaccaccaagatgtctttaaccgcttgcgatggatgccgtttgttgccggctggcaggtggctttggatttgttcacttcaacctccgtt

SEQ ID NO: 1266 - protein, 549 aa, Corynebacterium glutamicum
MVSLPRLASLLTTRLATLKPALKPATHLASLGAQVIAELVPGIRMSPNRRRILPANMGAGFIGAEIAMWWALSPSLLPKPWWVTAANLAVLQAVGHAAATGIHSILPRTNRRVSRKIYNATHIATGAITLTTTVVGLIRHRTQIRLIGQKNFGPKETIAGISVGTLGYGALLITGELTQHSINEVKLLIERFLPPWISFIAAVSVITLTTLTLADRVLLRRILHNSAIQAAHLNRMVFPGTEQPWEPERSGSPWSYEKWGAVGSQGRAVLSGGPRKDDIITVTRLSDTETHEPIRIFIGMVPGRSLSDQVDLVIHEMRRTGALRRDHIVINNSTGTGWITDWSAHTFEFLTGGNCVTISMQYSYLPSALSWYKDNDGPINAARMLIDAVLHELDQLPTGSRPKLFLAGESLGAYGLAEVWGDVEKLLGTADGVLLSGAPRFSDAMNALRTRRDASSSERLPVIDSGRHIRFAGEPEHLDMPATWQFPRMIVAQHASDPIVWWNAELFIRRPEWLKTPKQDHQDVFNRLRWMPFVAGWQVALDLFTSTSV

SEQ ID NO: 1267 - DNA, 579 bp, Corynebacterium glutamicum
  CDS (101)..(556): RXN02696
cttgggaaccgaccgctagcgtagaaaatcaagttaagggtgtgacgagcaccccagctgcacatgaaatttaagacattccaggtgaagggaaactgccatgtccatgctcaagaagactaaagaattcttcggactcgctccatacgaagcggagcacgaggatgcttactatgcagatgaaccacgttacgagggcaccgctgcgtacgcacctgaataccgtgagcgtgactacggctatgcaccagaggcaccagcccctgttgctccatcgccagcacctcgctcttaccagtccaccatcgttccagtagagcttcattcctttgaagacgctcaggttattggtggagcatttcgcgacggcgacgcagttgttttcgacatgagcttgctttcccgtgaggaagcacgccgcattgtggacttcgctgcaggcctgtgcttcgcattgcgtggcaagatgcagaagattgacagcgtcaccttcgctgtcgttccagagctgtccaacatcagcacttccgagctcgagcgcgccgcacgcatccgctaaacacaccctcgtggtgtgga

SEQ ID NO: 1268 - protein, 152 aa, Corynebacterium glutamicum
MSMLKKTKEFFGLAPYEAEHEDAYYADEPRYEGTAAYAPEYRERDYGYAPEAPAPVAPSPAPRSYQSTIVPVELHSFEDAQVIGGAFRDGDAVVFDMSLLSREEARRIVDFAAGLCFALRGKMQKIDSVTFAVVPELSNISTSELERAARIR

SEQ ID NO: 1269 - DNA, 578 bp, Corynebacterium glutamicum
  CDS (100)..(555): FRXA02696
  misc_feature 1, 6, 22, 32, 37, 39, 70, 80, 87, 94: n = a, t, c, or g
ngcttnaagaaataaagccctncccagttaanggtgngnatgggtaccagccctgtggacgctgtacatntaagtcattnctggttnaggtganctgccatgtccatgctcaagaagactaaagaattcttcggactcgctccatacgaagcggagcacgaggatgcttactatgcagatgaaccacgttacgagggcaccgctgcgtacgcacctgaataccgtgagcgtgactacggctatgcaccagaggcaccagcccctgttgctccatcgccagcacctcgctcttaccagtccaccatcgttccagtagagcttcattcctttgaagacgctcaggttattggtggagcatttcgcgacggcgacgcagttgttttcgacatgagcttgctttcccgtgaggaagcacgccgcattgtggacttcgctgcaggcctgtgcttcgcattgcgtggcaagatgcagaagattgacagcgtcaccttcgctgtcgttccagagctgtccaacatcagcacttccgagctcgagcgcgccgcacgcatccgctaaacacaccctcgtggtgtgga

SEQ ID NO: 1270 - protein, 152 aa, Corynebacterium glutamicum; identical to SEQ ID NO: 1268

SEQ ID NO: 1271 - DNA, 1650 bp, Corynebacterium glutamicum
  CDS (101)..(1627): RXN02697
tttggctcacctcgatgatgtagacatccccgatgaggtgcgcgcacagttgcgggcactggctatccgctcaaccgaacgtcggatgtagtagacgcgtatgacactttttcaacgtttaaccaaccctgtagtgctcggcggcctagcaggtgttttgcttctgctcggctctttcggtggcggtgccattcggtaccgtggcggagtgctcgatgcgttggggcttaacttccttgcttttggccacgcgcagggtatttccaataccgtgttgtgggttgggcagctgctgctgattggcgcgtgggttcaccttggacgtcggttgttcaagaaaaaagtcgctgatgacaccgcagacgctgctgacttaggtcttgtaaagcgcacgttgtatgccatggtggtgcccctcatttttgcggcaccaatgatgtcgcgtgatgtttattcctatctcatgcagggcgcgatgctgcgtgatggcttcgatccctacactgagggcgctgcggtaaaccctggccccatgttgcttgaggtctctcatgattggcgcaacaccacgacgccgtatggtccactacacctgtggattggagacatgatcaccacggttgtgggcgataatgtcaccttgggcgtcgtcgcttacaagatcttgtcgatcattggccttgctgtgacaggctggagcattgtccgcattgcacaacattttggagccaacccagcaattgcattgtggattggtgtggccaatcctgtgatgatcatccacatgatcggcggcatgcacaatgaatccctcatggtgggattggtcagcgtcggcttgttgctagcactgaagaagcgtttcgtggcaggtgtggcactcattgcagtggctgtgtcgctgaaagctacagcggcgattgcacttccttttgtggtgtggatcggcatgcatcatttcgcaggattcttagccaccaaaaagggcaaagactcccctacccttaagcaacaggtccccgcgttctttgccactggagctgcaggtgttgctgtcactggtgttgttgtcagtgcgatcacttgggcgtctggcgcttcgtggggctggatcagtgagatcagtggcaacagcaaggtaatcaacccgctggctttcccttctttggtggccagtgtgatcaccatggtggctgaagtgttcgttgacgatttcgactacaacgcagtggttaatgttgtgcgctcaatctccatgctgatcatgcttggcgggttggtcgtatgttggtggctgttccgccagaacgaacgcagggcggtcactggtacagcagcggcttatgccgtggcttttgtgttcaattctgtgaccttgccgtggtactacgccagcttgatctctttgctcggcacatttaaaccaccgatgtggttgattcgcttcgcagcgggtgcttcggtgtttatcgcgctgatgtttaccggaagtggaaaccaccagctgtacaacatcgttacggtgatcatcgcagcaattatcgcgtggcttgccaccgtggtgatctttgatgacactgaccctgcaacaacggccacggagaaaccctccccgcataccgtttcctagttgcataaggtaaaccgcca

SEQ ID NO: 1272 - protein, 509 aa, Corynebacterium glutamicum
MTLFQRLTNPVVLGGLAGVLLLLGSFGGGAIRYRGGVLDALGLNFLAFGHAQGISNTVLWVGQLLLIGAWVHLGRRLFKKKVADDTADAADLGLVKRTLYAMVVPLIFAAPMMSRDVYSYLMQGAMLRDGFDPYTEGAAVNPGPMLLEVSHDWRNTTTPYGPLHLWIGDMITTVVGDNVTLGVVAYKILSIIGLAVTGWSIVRIAQHFGANPAIALWIGVANPVMIIHMIGGMHNESLMVGLVSVGLLLALKKRFVAGVALIAVAVSLKATAAIALPFVVWIGMHHFAGFLATKKGKDSPTLKQQVPAFFATGAAGVAVTGVVVSAITWASGASWGWISEISGNSKVINPLAFPSLVASVITMVAEVFVDDFDYNAVVNVVRSISMLIMLGGLVVCWWLFRQNERRAVTGTAAAYAVAFVFNSVTLPWYYASLISLLGTFKPPMWLIRFAAGASVFIALMFTGSGNHQLYNIVTVIIAAIIAWLATVVIFDDTDPATTATEKPSPHTVS

SEQ ID NO: 1273 - DNA, 722 bp, Corynebacterium glutamicum
  CDS (1)..(699): FRXA02697
ccttttgtggtgtggatcggcatgcatcatttcgcaggattcttagccaccaaaaagggcaaagactcccctacccttaagcaacaggtccccgcgttctttgccactggagctgcaggtgttgctgtcactggtgttgttgtcagtgcgatcacttgggcgtctggcgcttcgtggggctggatcagtgagatcagtggcaacagcaaggtaatcaacccgctggctttcccttctttggtggccagtgtgatcaccatggtggctgaagtgttcgttgacgatttcgactacaacgcagtggttaatgttgtgcgctcaatctccatgctgatcatgcttggcgggttggtcgtatgttggtggctgttccgccagaacgaacgcagggcggtcactggtacagcggcggcttatgccgtggcttttgtgttcaattctgtgaccttgccgtggtactacgccagcttgatctctttgctcggcacatttaaaccaccgatgtggttgattcgcttcgcagcgggtgcttcggtgtttatcgcgctgatgtttaccggaagtggaaaccaccagctgtacaacatcgttacggtgatcatcgcagcaattatcgcgtggcttgccaccgtggtgatctttgatgacactgaccctgcaacaacggccacggagaaaccctccccgcataccgtttcctagttgcataaggtaaaccgcca

SEQ ID NO: 1274 - protein, 233 aa, Corynebacterium glutamicum
PFVVWIGMHHFAGFLATKKGKDSPTLKQQVPAFFATGAAGVAVTGVVVSAITWASGASWGWISEISGNSKVINPLAFPSLVASVITMVAEVFVDDFDYNAVVNVVRSISMLIMLGGLVVCWWLFRQNERRAVTGTAAAYAVAFVFNSVTLPWYYASLISLLGTFKPPMWLIRFAAGASVFIALMFTGSGNHQLYNIVTVIIAAIIAWLATVVIFDDTDPATTATEKPSPHTVS

SEQ ID NO: 1275 - DNA, 748 bp, Corynebacterium glutamicum
  CDS (101)..(748): FRXA02719
tttggctcacctcgatgatgtagacatccccgatgaggtgcgcgcacagttgcgggcactggctatccgctcaaccgaacgtcggatgtagtagacgcgtatgacactttttcaacgtttaaccaaccctgtagtgctcggcggcctagcaggtgttttgcttctgctcggctctttcggtggcggtgccattcggtaccgtggcggagtgctcgatgcgttggggcttaacttccttgcttttggccacgcgcagggtatttccaataccgtgttgtgggttgggcagctgctgctgattggcgcgtgggttcaccttggacgtcggttgttcaagaaaaaagtcgctgatgacaccgcagacgctgctgacttaggtcttgtaaagcgcacgttgtatgccatggtggtgcccctcatttttgcggcaccaatgatgtcgcgtgatgtttattcctatctcatgcagggcgcgatgctgcgtgatggcttcgatccctacactgagggcgctgcggtaaaccctggccccatgttgcttgaggtctctcatgattggcgcaacaccacgacgccgtatggtccactacacctgtggattggagacatgatcaccacggttgtgggcgataatgtcaccttgggcgtcgtcgcttacaagatcttgtcgatcattggccttgctgtgacaggctggagcattgtccgcattgcacaacattttggagccaacccagcaattgcattg

SEQ ID NO: 1276 - protein, 216 aa, Corynebacterium glutamicum
MTLFQRLTNPVVLGGLAGVLLLLGSFGGGAIRYRGGVLDALGLNFLAFGHAQGISNTVLWVGQLLLIGAWVHLGRRLFKKKVADDTADAADLGLVKRTLYAMVVPLIFAAPMMSRDVYSYLMQGAMLRDGFDPYTEGAAVNPGPMLLEVSHDWRNTTTPYGPLHLWIGDMITTVVGDNVTLGVVAYKILSIIGLAVTGWSIVRIAQHFGANPAIAL

SEQ ID NO: 1277 - DNA, 825 bp, Corynebacterium glutamicum
  CDS (101)..(802): RXN02720
ccacgctgcaccatcgaagacgaagatctgttttcttaccgccgcgaaggcacgacaggccgccaggccggcgtggtgtggctgccaaaggaggcataaattggagcgccgcgaagagctgcaggtacgactgcagcaggtgcaagcgcgtatcgacgcgaccctcaacgaacacaaccgccccgagggcagtgtacgtctgttgccggtcaccaaattccaccccgtggaagacatcaagatcttacaagagtttggtgtcaccgcagtgggagagaaccgcgaacaagaagcacgcgccaaagcactcgaacttcccgacatggactttcatatgattggccaaatccaatcaaagaaagccaactcgatcgccaggtgggcagctgcagtgcactccgttgatagcgagaaaatcgccgaagcattgggcaggggagtagcccttgcattggatagaggcgaccgcaccagtgacgagcttccgtgttttattcaactgagtttggatggtgacccgagccgaggtggaactccattgagccaggtcacacaacttgccgattgcatcagtgacaccacacatctgcgttttgagggcctcatgtgcgtcccaccgcttggttggggccctgaaaaagctttttcccaggcaagagacgtactttcaggtttagaggaacactttgacaggtctttggaattttcggcaggtatgtctggagacctagttgctgcgattaaacacggctcaacaatcgtgcgtgtcggaactgaaattcttgggaaccgaccgctagcgtagaaaatcaagttaagggtgtg

SEQ ID NO: 1278 - protein, 234 aa, Corynebacterium glutamicum
LERREELQVRLQQVQARIDATLNEHNRPEGSVRLLPVTKFHPVEDIKILQEFGVTAVGENREQEARAKALELPDMDFHMIGQIQSKKANSIARWAAAVHSVDSEKIAEALGRGVALALDRGDRTSDELPCFIQLSLDGDPSRGGTPLSQVTQLADCISDTTHLRFEGLMCVPPLGWGPEKAFSQARDVLSGLEEHFDRSLEFSAGMSGDLVAAIKHGSTIVRVGTEILGNRPLA

SEQ ID NO: 1279 - DNA, 727 bp, Corynebacterium glutamicum
  CDS (101)..(727): FRXA02720
ccacgctgcaccatcgaagacgaagatctgttttcttaccgccgcgaaggcacgacaggccgccaggccggcgtggtgtggctgccaaaggaggcataaattggagcgccgcgaagagctgcaggtacgactgcagcaggtgcaagcgcgtatcgacgcgaccctcaacgaacacaaccgccccgagggcagtgtacgtctgttgccggtcaccaaattccaccccgtggaagacatcaagatcttacaagagtttggtgtcaccgcagtgggagagaaccgcgaacaagaagcacgcgccaaagcactcgaacttcccgacatggactttcatatgattggccaaatccaatcaaagaaagccaactcgatcgccaggtgggcagctgcagtgcactccgttgatagcgagaaaatcgccgaagcattgggcaggggagtagcccttgcattggatagaggcgaccgcaccagtgacgagcttccgtgttttattcaactgagtttggatggtgacccgagccgaggtggaactccattgagccaggtcacacaacttgccgattgcatcagtgacaccacacatctgcgttttgagggcctcatgtgcgtcccaccgcttggttggggccctgaaaaagctttttcccaggcaagagacgtactttcaggtttagaggaacactttgacaggtctttggaattttcggcaggtatgtctggagac

SEQ ID NO: 1280 - protein, 209 aa, Corynebacterium glutamicum
LERREELQVRLQQVQARIDATLNEHNRPEGSVRLLPVTKFHPVEDIKILQEFGVTAVGENREQEARAKALELPDMDFHMIGQIQSKKANSIARWAAAVHSVDSEKIAEALGRGVALALDRGDRTSDELPCFIQLSLDGDPSRGGTPLSQVTQLADCISDTTHLRFEGLMCVPPLGWGPEKAFSQARDVLSGLEEHFDRSLEFSAGMSGD

SEQ ID NO: 1281 - DNA, 927 bp, Corynebacterium glutamicum
  CDS (101)..(904): RXN02744
gccaaaacgtcatgattcgctctttggatacgggacaccgctcattggaagatgtcttcctggacatcaccggaaaagaactgaggagttaacgcacaccatgtctaaaccttttgaaaactctgcgctccgcggttcttctcgattcccagctggaacgttcacccctgctcccaaacgagccaccccggcaaaaatgttggctgctcagggcaagatggaatccctgctgtttcttcgccacggcgaacagcaactgctcagcatcatcattcccttggtcgcgctcatcgcactagcgaattttgatttcatccctggtgagaactccctcgacaagactttccccttcgcgctggccacagcagccatgagcgctggttttacaggtcaagccatcagcctagcttttgaccgccgctatggtgccctcaagcgcaccggcgccagcggtgttcccgcctggacgattatttttggcaaagtcatcgcagtcattgcagtcaccattgtgcagatcatctttctcggtgtgactgcactgctgttgggctggtccgcacctgtcggtggtgtgctctttggcatcgtgaccctatttgtgggtgtttccagcttcaccgcgctcggcatgctgatgggcggaacgttgtcctccgaattggtattggcactggctaacttgatttggattgtactgtccggccttgcagcatgggcggtcttttccccttccgtcaacgctgaaggagtgctgtccatcatcccatccgttgcgctgtcccaaggtatggttgacgcattcaacggcgaacttccgtggctccagctaggaattttggtgggctggctaattatcaccggcgtggccgcaaacaagctatttaacttctctgcgagccgctagatatacccttagtcggaaaa

SEQ ID NO: 1282 - protein, 268 aa, Corynebacterium glutamicum
MSKPFENSALRGSSRFPAGTFTPAPKRATPAKMLAAQGKMESLLFLRHGEQQLLSIIIPLVALIALANFDFIPGENSLDKTFPFALATAAMSAGFTGQAISLAFDRRYGALKRTGASGVPAWTIIFGKVIAVIAVTIVQIIFLGVTALLLGWSAPVGGVLFGIVTLFVGVSSFTALGMLMGGTLSSELVLALANLIWIVLSGLAAWAVFSPSVNAEGVLSIIPSVALSQGMVDAFNGELPWLQLGILVGWLIITGVAANKLFNFSASR

SEQ ID NO: 1283 - DNA, 927 bp, Corynebacterium glutamicum; identical to SEQ ID NO: 1281
  CDS (101)..(904): FRXA02744

SEQ ID NO: 1284 - protein, 268 aa, Corynebacterium glutamicum; identical to SEQ ID NO: 1282

SEQ ID NO: 1285 - DNA, 1689 bp, Corynebacterium glutamicum
  CDS (101)..(1666): RXN02770
tcgccggggcaaaaaccgtataattacagtcctattacgattcggggaaaggctgggtacttcacacatgttgtttcggaagtcacgcagcgcggtaatcatgttggttgcagcgttagtgatgacaagctgtggtgatggggaaccggaaccaaccagccaccaaacaagccttttcggctacgcagttaactcttcgctggctacaaccaacgcggcgtcgctgttgggagtggctaatgatgctggtcttttggctgccagagtgtatccgggtgtgtatgttcagggtccttctgggcagatgattcccaacactgatcttgcttccacgcaggtattgccgggtattaaccgccaggtgatttacactatcaatgaagatgccacctactcagatggtcagcctgtggtgtgtgatgattttctgctctctgcgacagctgggcagatgccggaactgttccagtcccatgtgccattgacctcgcagattgagcgagtggactgtgtatctggttctaaagtagccaccgtggtgttcaaggaagacctcggtgagcgttggcgttatctttttgagcagggcgatttgttgccagcccatgccgttgcttccaaagcaggtatgaccttggaggagcttaatcaggcgttgaaggataaggatcctgaagcgttgactgaacctgctcgtgtgtggagcgaaggtttccagctgtcccagtttgatccagagctgcagacggcttttggcccgtacaaggtggattctgtgggtgaattcggcgaagtcaagctggtacgcaatgagttttacagtggcgaccaggcggttgaagcagaaatcacgatgtggcctaaaggctcggatctcagcgccattgcggataatggaaaccttcagatcgcacatgttgtggcgtgggagagcgagccgtgggtaaatcgcgatgacccattgaatccttatgacattaaggaagaggtcggtgttttgactgagcagctcaccttggccagtgccggtgtgttttacgctgcggaggcccggcaggcgtttgcggcctgcgttgaccaggaagcggtggctgcggcgtcgtcaagcatctctggaatcgatgtgcctgccgtaggtgtgcactcggtgcgtcaccaaaatccggtcgtgcaccaaatcggtgatctgccagcacagcacatggcggtggatattaatgccgcatcagcgttggcgggtcaatccatccgcattggctacgacggacccgatgagcgcaaggctgcaatggtggaggcgattcgccaaagttgtgagcctgccggtatcaccgttatcgatgcgtcgcaggaggctgttagtcttaatgatctcagtcgaaccgaagtcagtgaatggggctatgagcagtacttcgaagggacacttgacgctgttctgcgtacagtggatccacatcgggagtatgaaaatgccaataccattggaactgatgcggagtcgacgaggcgcactgaagaacaattgtgggctgaagtcccatcaattccactagcagcgcaaccccgagtgtttgtgatagatcgcacagtcggtaacgttgttgttaatacagacctagccggtatcggatggaacatggaccgttggtccagaagtgaggaataagtagtgagcgaacaagctct

SEQ ID NO: 1286 - protein, 522 aa, Corynebacterium glutamicum
MLVAALVMTSCGDGEPEPTSHQTSLFGYAVNSSLATTNAASLLGVANDAGLLAARVYPGVYVQGPSGQMIPNTDLASTQVLPGINRQVIYTINEDATYSDGQPVVCDDFLLSATAGQMPELFQSHVPLTSQIERVDCVSGSKVATVVFKEDLGERWRYLFEQGDLLPAHAVASKAGMTLEELNQALKDKDPEALTEPARVWSEGFQLSQFDPELQTAFGPYKVDSVGEFGEVKLVRNEFYSGDQAVEAEITMWPKGSDLSAIADNGNLQIAHVVAWESEPWVNRDDPLNPYDIKEEVGVLTEQLTLASAGVFYAAEARQAFAACVDQEAVAAASSSISGIDVPAVGVHSVRHQNPVVHQIGDLPAQHMAVDINAASALAGQSIRIGYDGPDERKAAMVEAIRQSCEPAGITVIDASQEAVSLNDLSRTEVSEWGYEQYFEGTLDAVLRTVDPHREYENANTIGTDAESTRRTEEQLWAEVPSIPLAAQPRVFVIDRTVGNVVVNTDLAGIGWNMDRWSRSEE

SEQ ID NO: 1287 - DNA, 1343 bp, Corynebacterium glutamicum
  CDS (1)..(1320): FRXA02770
ggtattaaccgccaggtgatttacactatcaatgaagatgccacctactcagatggtcagcctgtggtgtgtgatgattttctgctctctgcgacagctgggcagatgccggaactgttccagtcccatgtgccattgacctcgcagattgagcgagtggactgtgtatctggttctaaagtagccaccgtggtgttcaaggaagacctcggtgagcgttggcgttatctttttgagcagggcgatttgttgccagcccatgccgttgcttccaaagcaggtatgaccttggaggagcttaatcaggcgttgaaggataaggatcctgaagcgttgactgaacctgctcgtgtgtggagcgaaggtttccagctgtcccagtttgatccagagctgcagacggcttttggcccgtacaaggtggattctgtgggtgaattcggcgaagtcaagctggtacgcaatgagttttacagtggcgaccaggcggttgaagcagaaatcacgatgtggcctaaaggctcggatctcagcgccattgcggataatggaaaccttcagatcgcacatgttgtggcgtgggagagcgagccgtgggtaaatcgcgatgacccattgaatccttatgacattaaggaagaggtcggtgttttgactgagcagctcaccttggccagtgccggtgtgttttacgctgcggaggcccggcaggcgtttgcggcctgcgttgaccaggaagcggtggctgcggcgtcgtcaagcatctctggaatcgatgtgcctgccgtaggtgtgcactcggtgcgtcaccaaaatccggtcgtgcaccaaatcggtgatctgccagcacagcacatggcggtggatattaatgccgcatcagcgttggcgggtcaatccatccgcattggctacgacggacccgatgagcgcaaggctgcaatggtggaggcgattcgccaaagttgtgagcctgccggtatcaccgttatcgatgcgtcgcaggaggctgttagtcttaatgatctcagtcgaaccgaagtcagtgaatggggctatgagcagtacttcgaagggacacttgacgctgttctgcgtacagtggatccacatcgggagtatgaaaatgccaataccattggaactgatgcggagtcgacgaggcgcactgaagaacaattgtgggctgaagtcccatcaattccactagcagcgcaaccccgagtgtttgtgatagatcgcacagtcggtaacgttgttgttaatacagacctagccggtatcggatggaacatggaccgttggtccagaagtgaggaataagtagtgagcgaacaagctct

SEQ ID NO: 1288 - protein, 440 aa, Corynebacterium glutamicum
GINRQVIYTINEDATYSDGQPVVCDDFLLSATAGQMPELFQSHVPLTSQIERVDCVSGSKVATVVFKEDLGERWRYLFEQGDLLPAHAVASKAGMTLEELNQALKDKDPEALTEPARVWSEGFQLSQFDPELQTAFGPYKVDSVGEFGEVKLVRNEFYSGDQAVEAEITMWPKGSDLSAIADNGNLQIAHVVAWESEPWVNRDDPLNPYDIKEEVGVLTEQLTLASAGVFYAAEARQAFAACVDQEAVAAASSSISGIDVPAVGVHSVRHQNPVVHQIGDLPAQHMAVDINAASALAGQSIRIGYDGPDERKAAMVEAIRQSCEPAGITVIDASQEAVSLNDLSRTEVSEWGYEQYFEGTLDAVLRTVDPHREYENANTIGTDAESTRRTEEQLWAEVPSIPLAAQPRVFVIDRTVGNVVVNTDLAGIGWNMDRWSRSEE

SEQ ID NO: 1289 - DNA, 1314 bp, Corynebacterium glutamicum
  CDS (101)..(1291): RXN02781
ctccgagagtttccgcatccgcggttcgatcccggacgttccccgggagacgcggtgggaccggctgtggcggcccttctgggcgataccggctgccagcgtggtcgcggccctggttttcggtttcctgcttcccacgtgggaacgtgggttgtccgacgccgcgctcaaattcgtttttgagggtgggcctgatgccgcccgcgaggtgctgggcaccatcgccgcctccacgatctcagtgaccggtctcatcttctccatcactctcgttgttctgcagctggtgagcagccagttcagcccgcgaatgctcaacggctttctgcgcaaccgcatcgtgcaggccaccctggcgatgttcctggggacgttcgtgttctccctgacggtcatccggtacgtgtggagcgaggacgaggacatcaccggattcgtcccccgtgcttcagtgtcggttgccttcctgctggtgctcgggtgtctgggactgttcctggcgttcatccggctcatcaccttctcgatgcgggtggccaacgccatctccgagatcggggaggagacgatggctctggccgcacgtatctatcccgtgcagagcgacgacgcaggcccagtccaggggccgggctggtcaccgcggcccggtgacccccgggaagaaatccgggtgggcaaccatggttcgctggtgtggatcgactaccggaagctggtgtcctggtcgacggaacaccaggcggtgatcacggtcgaccggccggtgggggacttcctcgtcgagggccagccgctgctgcgggtctggtgggacggggaactcagcgaccgggaccgacgcgttctgcactcggccatcgaggtgcggaccgagcgggaacttcaccaggatgtggcgttcggactgcgtcaactggtcgacattgccgatcgtgcgttgtccccgggcatcaatgatccggccacggcggcccagtgtgtccaggagatccaccggatcttccgctatttggtcaccgtcatcgagcccagcccctacatcgccgatgacgacggtcgggtccgtgtggtgcaccagccgcaacgtatcgcggacatgctctatgaggtgatccgtgagatccatctctacggggcggattctgcgatgattccgaggctgctgcgcaccatggtcgaggacctggtgacggccgctgccgatcattccctgcctgccgtcgagcgtgcccgcggcatcctggacgatgagacggacgaggaccgcgacagtgacaccgcgaacgtctgatccgggatcaggtggcggtg

SEQ ID NO: 1290 - protein, 397 aa, Corynebacterium glutamicum
VVAALVFGFLLPTWERGLSDAALKFVFEGGPDAAREVLGTIAASTISVTGLIFSITLVVLQLVSSQFSPRMLNGFLRNRIVQATLAMFLGTFVFSLTVIRYVWSEDEDITGFVPRASVSVAFLLVLGCLGLFLAFIRLITFSMRVANAISEIGEETMALAARIYPVQSDDAGPVQGPGWSPRPGDPREEIRVGNHGSLVWIDYRKLVSWSTEHQAVITVDRPVGDFLVEGQPLLRVWWDGELSDRDRRVLHSAIEVRTERELHQDVAFGLRQLVDIADRALSPGINDPATAAQCVQEIHRIFRYLVTVIEPSPYIADDDGRVRVVHQPQRIADMLYEVIREIHLYGADSAMIPRLLRTMVEDLVTAAADHSLPAVERARGILDDETDEDRDSDTANV

SEQ ID NO: 1291 - DNA, 1314 bp, Corynebacterium glutamicum; identical to SEQ ID NO: 1289
  CDS (101)..(1291): FRXA02781

SEQ ID NO: 1292 - protein, 397 aa, Corynebacterium glutamicum; identical to SEQ ID NO: 1290

SEQ ID NO: 1293 - DNA, 1422 bp, Corynebacterium glutamicum
  CDS (101)..(1399): RXN02782
accccacccggtcccccttttttcctcactgacaccggagccgcctcaagcaccacgctgcaatcacagaagctagttgagcatattgtagaatataactatgccaacactgcttattgacacccatccgcatcttgcagcgcaacttcttgaccctggtttaggtgaacttcttacagccggttccaacaaaaaagtgcagtggcagtgccctaagcactccaatcacatctggacggcctcggttaataaccgcaccaatgcaaagaacccgcgctgcccctattgtgccggaacacgagtgttggcaggttttaatgatctcgccaccactcacccgcatcttgctgtacagctggttgaccaagatattgccgtcaccatttccgctggttctggcaaaagacaactgtggcagtgtgtagtaaacccaaaacaccagtggttggctacgccaaataatcgcacgagtactaaatctgcgagttctggttgcccctactgtgccaaccgagcggtattagtcggtgacaatgactttgcaacaacctaccccgaacttgcagcgcaattagtagatcaatctgcagcgacaacctttacagccggccacaacaagcctgttgagtggatctgttgcaagcatgaaccaccatttatctggaaaacctcaccaattttgcgtgtacgacagaacacccagtgccctgtgtgctcagagcgaactgtggcgccggcgcttaatgatcttgcaaccactcaccctaaacttgccgagcaaattgcagatcctcaaccaagtggtgtgagcgccgcggccattatccccaccattagcaggggttcccatacgcaattaacatggcaatgttctaaaaatcatgaccaccaatgggtcgccacagtaaaggatcgtgttcgcggaacagactgccccacctgcgcaaatacaggaacttcacgcaaagaggctgaacttattgaggtcatccgtgcattattcccaaacactgatgtccagcaaggtgcgctcattaatggacgtaccggtaatcaaggtgcatcgccgtcaaccgatgtactcataccgtccaaaaatctcgctatcgagttcaacggcctgtactggcactctgagcttttcatcaaagataagcattatcatgcgaacaaatcagctctcgcagaacaagccggtgtgcagctcattcatgtgtgggaggacgactggaatcttcgccgcgacattgtgatccgcatgatcgcacacaagcttcatgcaacccataacctcagtgctgttttgcctaccgaaactactgactcacgtgtggcaaccaccgctttcgccgtacactcacactgtcggtggtctctggttcacgcgctgctgcattcttgaacagcaaccatattcagggt

SEQ ID NO: 1294 - protein, 433 aa, Corynebacterium glutamicum
MPTLLIDTHPHLAAQLLDPGLGELLTAGSNKKVQWQCPKHSNHIWTASVNNRTNAKNPRCPYCAGTRVLAGFNDLATTHPHLAVQLVDQDIAVTISAGSGKRQLWQCVVNPKHQWLATPNNRTSTKSASSGCPYCANRAVLVGDNDFATTYPELAAQLVDQSAATTFTAGHNKPVEWICCKHEPPFIWKTSPILRVRQNTQCPVCSERTVAPALNDLATTHPKLAEQIADPQPSGVSAAAIIPTISRGSHTQLTWQCSKNHDHQWVATVKDRVRGTDCPTCANTGTSRKEAELIEVIRALFPNTDVQQGALINGRTGNQGASPSTDVLIPSKNLAIEFNGLYWHSELFIKDKHYHANKSALAEQAGVQLIHVWEDDWNLRRDIVIRMIAHKLHATHNLSAVLPTETTDSRVATTAFAVHSHCRWSLVHALLHS

SEQ ID NO: 1295 - DNA, 795 bp, Corynebacterium glutamicum
  CDS (101)..(772): FRXA02782
gtggatctgttgcaagcatgaaccaccatttatctggaaaacctcaccaattttgcgtgtacgacagaacacccagtgccctgtgtgctcagagcgaactgtggcgccggcgcttaatgatcttgcaaccactcaccctaaacttgccgagcaaattgcagatcctcaaccaagtggtgtgagcgccgcggccattatccccaccattagcaggggttcccatacgcaattaacatggcaatgttctaaaaatcatgaccaccaatgggtcgccacagtaaaggatcgtgttcgcggaacagactgccccacctgcgcaaatacaggaacttcacgcaaagaggctgaacttattgaggtcatccgtgcattattcccaaacactgatgtccagcaaggtgcgctcattaatggacgtaccggtaatcaaggtgcatcgccgtcaaccgatgtactcataccgtccaaaaatctcgctatcgagttcaacggcctgtactggcactctgagcttttcatcaaagataagcattatcatgcgaacaaatcagctctcgcagaacaagccggtgtgcagctcattcatgtgtgggaggacgactggaatcttcgccgcgacattgtgatccgcatgatcgcacacaagcttcatgcaacccataacctcagtgctgttttgcctaccgaaactactgactcacgtgtggcaaccaccgctttcgccgtacactcacactgtcggtggtctctggttcacgcgctgctgcattcttgaacagcaaccatattcagggt

SEQ ID NO: 1296 - protein, 224 aa, Corynebacterium glutamicum
VAPALNDLATTHPKLAEQIADPQPSGVSAAAIIPTISRGSHTQLTWQCSKNHDHQWVATVKDRVRGTDCPTCANTGTSRKEAELIEVIRALFPNTDVQQGALINGRTGNQGASPSTDVLIPSKNLAIEFNGLYWHSELFIKDKHYHANKSALAEQAGVQLIHVWEDDWNLRRDIVIRMIAHKLHATHNLSAVLPTETTDSRVATTAFAVHSHCRWSLVHALLHS

SEQ ID NO: 1297 - DNA, 439 bp, Corynebacterium glutamicum
  CDS (101)..(439): RXN02812
cgcaactggagctgccgactcccctgcgtttgccaccgttgaaggagcagaacttccagagggctacacctttgaagcagtagacagcgcagaagtacctgtgtgggctgttgccatcaacgctggaaacggtatctctgaagaccaagcccgcgccgcctctgatttcagtagcttcagcttcgacaccggcaacgccgataactccgcgcttgaaagtgttctcacccaagcttcaagcgaatccgcggcagaaactactgaggcgcaaccaagcgagaccccggtcgagcccgccgctgcttccccatccgataccatcatcaacctggatacctcatccaacatggatcgagttgttgacggcagccaggaaacctaccacacggttacttcccggactctggccaacctcgcccgcgaaactggtgcacagggc

SEQ ID NO: 1298 - protein, 113 aa, Corynebacterium glutamicum
VWAVAINAGNGISEDQARAASDFSSFSFDTGNADNSALESVLTQASSESAAETTEAQPSETPVEPAAASPSDTIINLDTSSNMDRVVDGSQETYHTVTSRTLANLARETGAQG

SEQ ID NO: 1299 - DNA, 567 bp, Corynebacterium glutamicum
  CDS (1)..(567): FRXA02812
gcttcaggcaccgacgcctcaacaatcacccttgaccaggtagctcttcccgttgccactaactccggagcatccgcagccgtagcgctggcgctggctgaaaccccagaagctgccgctgctgcgctcaaccgtgacgccgatgtcaccgcaactggagctgccgactcccctgcgtttgccaccgttgaaggagcagaacttccagagggctacacctttgaagcagtagacagcgcagaagtacctgtgtgggctgttgccatcaacgctggaaacggtatctctgaagaccaagcccgcgccgcctctgatttcagtagcttcagcttcgacaccggcaacgccgataactccgcgcttgaaagtgttctcacccaagcttcaagcgaatccgcggcagaaactactgaggcgcaaccaagcgagaccccggtcgagcccgccgctgcttccccatccgataccatcatcaacctggatacctcatccaacatggatcgagttgttgacggcagccaggaaacctaccacacggttacttcccggactctggccaacctcgcc

SEQ ID NO: 1300 - protein, 189 aa, Corynebacterium glutamicum
ASGTDASTITLDQVALPVATNSGASAAVALALAETPEAAAAALNRDADVTATGAADSPAFATVEGAELPEGYTFEAVDSAEVPVWAVAINAGNGISEDQARAASDFSSFSFDTGNADNSALESVLTQASSESAAETTEAQPSETPVEPAAASPSDTIINLDTSSNMDRVVDGSQETYHTVTSRTLANLA

SEQ ID NO: 1301 - DNA, 499 bp, Corynebacterium glutamicum
  CDS (101)..(499): RXN02817
aaaattcccacccccaaaactcccccacttcggttaaggaatcaggattctcacaaagttcaggcaggctcccgctacttttcagcgctaatcttggctcatgattttaggcgtacccattcaatatttgctctattcattgtggaattggattgtcgataccggttttgatgtagcaattatcctggtcttggcgtttttgattccacgtatcggccgactggccatgcgtattatcaagcgccgagtggagtctgcagccgatgcggacaccactaagaaccagctcgcgttcgccggcgttggcgtttatatcgcgcaaattgtggcgtttttcatgcttgccgtctccgcgatgcaggcttttggtttctctctcgcgggcgctgcgattccggcaaccattgcgtcagctgccattggccttggtgcgcagtcgattgttgcggacttcttggccggatttttcatcctgacggaaaagcaattcggcgtgggt

SEQ ID NO: 1302 - protein, 133 aa, Corynebacterium glutamicum
MILGVPIQYLLYSLWNWIVDTGFDVAIILVLAFLIPRIGRLAMRIIKRRVESAADADTTKNQLAFAGVGVYIAQIVAFFMLAVSAMQAFGFSLAGAAIPATIASAAIGLGAQSIVADFLAGFFILTEKQFGVG

SEQ ID NO: 1303 - DNA, 499 bp, Corynebacterium glutamicum; identical to SEQ ID NO: 1301
  CDS (101)..(499): FRXA02817

SEQ ID NO: 1304 - protein, 133 aa, Corynebacterium glutamicum; identical to SEQ ID NO: 1302

SEQ ID NO: 1305 - DNA, 606 bp, Corynebacterium glutamicum
  CDS (1)..(606): RXN02818
tcctattcccggaagtttttgacccaggtgtggattcgagacaatgtcggcgattataaaggccttaccgatacggcgttccgtaagaagctgcagcgcgatcttgcctacctgcgcagagttggcgttccgattgagcagttcacggtcacctcaggcatagctgaaggccagcaggcgtaccgtctggcccaggattcttataagctccccgaggtcgaattcaccccagatgaggccgccgtgctgggcatggcaggggagatgggccataatcaggaactcggcgccttcgcgcgttcggggtggaccaaattggcggccggcggcgcgcagcgtgatctgtccacgtccacagccttgaccaatgcgggcgatttaggttccttgtctgcaaaaaccctcgatgcgatcatcaaagcccgccaattgggcaagcaaatcagcttcgaataccggcgcgcccccaaagacgccccctcgcttcgacacatggatccttggggtctggtccctgagcgcgaccgcatctacctggtcggattcgacctcgaccgccaagaagcacgcaccttccgcatcacccgcgtccgcaacatcaaactc

SEQ ID NO: 1306 - protein, 202 aa, Corynebacterium glutamicum
SYSRKFLTQVWIRDNVGDYKGLTDTAFRKKLQRDLAYLRRVGVPIEQFTVTSGIAEGQQAYRLAQDSYKLPEVEFTPDEAAVLGMAGEMGHNQELGAFARSGWTKLAAGGAQRDLSTSTALTNAGDLGSLSAKTLDAIIKARQLGKQISFEYRRAPKDAPSLRHMDPWGLVPERDRIYLVGFDLDRQEARTFRITRVRNIKL

SEQ ID NO: 1307 - DNA, 606 bp, Corynebacterium glutamicum; identical to SEQ ID NO: 1305
  CDS (1)..(606): FRXA02818

SEQ ID NO: 1308 - protein, 202 aa, Corynebacterium glutamicum; identical to SEQ ID NO: 1306

SEQ ID NO: 1309 - DNA, 1962 bp, Corynebacterium glutamicum
  CDS (101)..(1939): RXN02825
tggcctgcccctgaaacttttacggctttcagagcgcagggcatcattttcttgtgtcgccaacacttgagaaaaattgcggaaaaggacactgctgttcatgaaacttgcacctcgtatgcggatgaggagccccaaaactttcgcggccctcgcctcacttgctttagtcataggtctcggccaggtaccgatcgcccaagctcaaaccgagtatcgaaccgcctccgacggttccctgaactggggatttaggcaatcgttccgcaattacatccaaaccggcgtggccaaaggttccatcacgcttggcgacggcgcatccgacaacggtggcaacttcgcattcaccccacgcaccaacggcaccaccgtgaccagcgattcccaaggcaccgtggaattcaacggctccgtgcacttcctcggacaccaggcagaggacaaatggatcctggacaccaccatgtctgacatcaaaatggtgttcaacggatcctccgcgcagctagttgtggatttggttgcccgcgaattcaagggcaccacctacgatgacatcggcgaatacatcatctccgacgacatcgtgcttgccgacgtctccctcaactccgccgccgacttctcccaagattccatcgacctgtccggcaccaccgacctcaccgcagctggcgcccaagctttcggaggattctacgaaaccggcgaagccctcgacccgaccggcggcagcctgaccatttcctccaccaccaccgcgccatcgaccagcacgacctccacctctgcctcaacttccggtggaaccgccgactgttcctccggcgcattgggtgttgtcaccaccggaaccaacgacggcatgctgggcaccatccaggaagtaaacaacaccttcgcgatttggaacaacctcatcgtcaacaccgagcgcatgttctgcaacattgataccctcaaggcgcgcttcgacacggatgattccagcgattcagcgacctctgcgacttctgggactactgcgtccaccggcaccaccgctgcaactaccgcgggaaccacgggtaccactggaactgccagcaccgcttccggaacttccggaacttccggaacctccggcaccgcagcaactgtcgctggcaccaccccaactgacaatggcgtttgcaccgcttccggatctttgggcgtgacccaagcatctgcgcagtggggtgtgaaggcgtccttccagaactacattcgcggatcgatcgccaacggtagctggactctcaacggcgttggttttgataatcagcagttccaattctctggaaattccggagcagtcgacgcggaaaacaagaccggcagcatcaatttccctggttccatccacttcacgggtcacggcggaatcttggacatgcagatcgcaaacattgagatcagcttcaacggcaactccggcgagctgattgcggatgtcgtttcctctgacatggatggaaattccaccaactacggtcgcactgtcgtgggcaccctgaacttctctgcgttgaatgtttctgcaacggaagcttccggttccgcttcggtgtccctgtcacagtcgggttcgcaggcgttcgctgatttctacaccccaggcacccagttggatccgatcagtttcagcgcaactttgggcggcgacgccagctgcgccaccggatccacctcgaccacaggcgctgctgccaccgcgaacactgacaacaccgaaggtgttgccggcgaggaatccaccacccccgctaaccaaaacagccagttccaaatccgccaggccgctgcagattccaccggactggataccaccaccacaatgttgctcatcctcgcggcgttcgttgtcgcaggtggctccatgactcgcttcaccgtcggcaacccgactggaaaataaggcttcacatgaataacgct

SEQ ID NO: 1310 - protein, 613 aa, Corynebacterium glutamicum
MKLAPRMRMRSPKTFAALASLALVIGLGQVPIAQAQTEYRTASDGSLNWGFRQSFRNYIQTGVAKGSITLGDGASDNGGNFAFTPRTNGTTVTSDSQGTVEFNGSVHFLGHQAEDKWILDTTMSDIKMVFNGSSAQLVVDLVAREFKGTTYDDIGEYIISDDIVLADVSLNSAADFSQDSIDLSGTTDLTAAGAQAFGGFYETGEALDPTGGSLTISSTTTAPSTSTTSTSASTSGGTADCSSGALGVVTTGTNDGMLGTIQEVNNTFAIWNNLIVNTERMFCNIDTLKARFDTDDSSDSATSATSGTTASTGTTAATTAGTTGTTGTASTASGTSGTSGTSGTAATVAGTTPTDNGVCTASGSLGVTQASAQWGVKASFQNYIRGSIANGSWTLNGVGFDNQQFQFSGNSGAVDAENKTGSINFPGSIHFTGHGGILDMQIANIEISFNGNSGELIADVVSSDMDGNSTNYGRTVVGTLNFSALNVSATEASGSASVSLSQSGSQAFADFYTPGTQLDPISFSATLGGDASCATGSTSTTGAAATANTDNTEGVAGEESTTPANQNSQFQIRQAAADSTGLDTTTTMLLILAAFVVAGGSMTRFTVGNPTGK

SEQ ID NO: 1311 - DNA, 538 bp, Corynebacterium glutamicum
  CDS (101)..(538): FRXA01322
tggcctgcccctgaaacttttacggctttcagagcgcagggcatcattttcttgtgtcgccaacacttgagaaaaattgcggaaaaggacactgctgttcatgaaacttgcacctcgtatgcggatgaggagccccaaaactttcgcggccctcgcctcacttgctttagtcataggtctcggccaggtaccgatcgcccaagctcaaaccgagtatcgaaccgcctccgacggttccctgaactggggatttaggcaatcgttccgcaattacatccaaaccggcgtggccaaaggttccatcacgcttggcgacggcgcatccgacaacggtggcaacttcgcattcaccccacgcaccaacggcaccaccgtgaccagcgattcccaaggcaccgtggaattcaacggctccgtgcacttcctcggacaccaggcagaggacaaatggatcctggacaccaccatgtctgacatcaaaatggtgttcaacggatcctccgcgcagctagttgtggatttggttgcccgcgaattc

SEQ ID NO: 1312 - protein, 146 aa, Corynebacterium glutamicum
MKLAPRMRMRSPKTFAALASLALVIGLGQVPIAQAQTEYRTASDGSLNWGFRQSFRNYIQTGVAKGSITLGDGASDNGGNFAFTPRTNGTTVTSDSQGTVEFNGSVHFLGHQAEDKWILDTTMSDIKMVFNGSSAQLVVDLVAREF

SEQ ID NO: 1313 - DNA, 528 bp, Corynebacterium glutamicum
  CDS (1)..(528): FRXA02824
ttctacgaaaccggcgaagccctcgacccgaccggcgacagcctgaccatttcctccaccaccaccgcgccatcgaccagcacgacctccacctctgcctcaacttccggtggaaccgccgactgttcctccggcgcattgggtgttgtcaccaccggaaccaacgacggcatgctgggcaccatccaggaagtaaacaacaccttcgcgatttggaacaacctcatcgtcaacaccgagcgcatgttctgcaacattgataccctcaaggcgcgcttcgacacggatgattccagcgattcagcgacctctgcgacttctgggactactgcgtccaccggcaccaccgctgcaactaccgcgggaaccacgggtaccactggaactgccagcaccgcttccggaacttccggaacttccggaacctccggcaccgcagcaactgtcgctggcaccaccccaactgacaatggcgtttgcaccgcttccggatctttgggcgtgacccaagcatctgcgcagtggggt

SEQ ID NO: 1314 - protein, 176 aa, Corynebacterium glutamicum
FYETGEALDPTGDSLTISSTTTAPSTSTTSTSASTSGGTADCSSGALGVVTTGTNDGMLGTIQEVNNTFAIWNNLIVNTERMFCNIDTLKARFDTDDSSDSATSATSGTTASTGTTAATTAGTTGTTGTASTASGTSGTSGTSGTAATVAGTTPTDNGVCTASGSLGVTQASAQWG

SEQ ID NO: 1315 - DNA, 407 bp, Corynebacterium glutamicum
  CDS (1)..(384): FRXA02825
aatgtttctgcaacggaagcttccggttccgcttcggtgtccctgtcacagtcgggttcgcaggcgttcgctgatttctacaccccaggcacccagttggatccgatcagtttcagcgcaactttgggcggcgacgccagctgcgccaccggatccacctcgaccacaggcgctgctgccaccgcgaacactgacaacaccgaaggtgttgccggcgaggaatccaccacccccgctaaccaaaacagccagttccaaatccgccaggccgctgcagattccaccggactggataccaccaccacaatgttgctcatcctcgcggcgttcgttgtcgcaggtggctccatgactcgcttcaccgtcggcaacccgactggaaaataaggcttcacatgaataacgct

SEQ ID NO: 1316 - protein, 128 aa, Corynebacterium glutamicum
NVSATEASGSASVSLSQSGSQAFADFYTPGTQLDPISFSATLGGDASCATGSTSTTGAAATANTDNTEGVAGEESTTPANQNSQFQIRQAAADSTGLDTTTTMLLILAAFVVAGGSMTRFTVGNPTGK

SEQ ID NO: 1317 - DNA, 528 bp, Corynebacterium glutamicum
  CDS (1)..(528): RXN02838
aacacgggcaagggcggggggctgacggtgccgctgggcgacgggcaggggcggtatatcgcgaagttcccctcgaccgcgtttgtgggggtgtcggagaacgaatttgccaatctggctttggccgaggcgatcgggatggaggtgcccgcgcgcgagttggtggggcgtgcgcagtttgaaggcgtgccccccgagtttgaggccatgaccgacgggttggttttgctggtgcggcggtttgatcgcgcgggcgatggcgtgcgcgtgcatatggaggatttcgcacaggtgttcggcctataccccgcgcgcaagtatgatggggcggccagtcacgatattgcggcggtgctgggcagtgcggtgtcgatcgcggcggggttggagttcgtgcggcggctggcgctctcggttgtgatgggcaacggcgatatgcatttgaagaactggtcgctgatctatcgcgggcggggcgatgtgccggcgttggcgcctgtgtattatatgatgtcgaccgtgacctat

SEQ ID NO: 1318 - protein, 176 aa, Corynebacterium glutamicum
NTGKGGGLTVPLGDGQGRYIAKFPSTAFVGVSENEFANLALAEAIGMEVPARELVGRAQFEGVPPEFEAMTDGLVLLVRRFDRAGDGVRVHMEDFAQVFGLYPARKYDGAASHDIAAVLGSAVSIAAGLEFVRRLALSVVMGNGDMHLKNWSLIYRGRGDVPALAPVYYMMSTVTY

SEQ ID NO: 1319 - DNA, 462 bp, Corynebacterium glutamicum
  CDS (1)..(462): FRXA02838
accgtgccgctgggcgacgggcaggggcggtatatcgcgaagatcccctcgaccgcgtttgtgggggtgtcggagaacaaatttgccaatctggctttggccgaggcgatcgggatggaggtgcccgcgcgcgagttggtggggcgtgcgcagtttgaaggcgtgccccccgagtttgaggccatgaccgacgggttggttttgctggtgcggcggtttgatcgcgcgggcgatggcgtgcgcgtgcatatggaggatttcgcacaggtgttcggcctataccccgcgcgcaagtatgatggggcggccagtcacgatattgcggcggtgctgggcagtgcggtgtcgatcgcggcggggttggagttcgtgcggcggctggcgctctctgttgtgatgggcaacggcgatatgcatttgaagaactggtcgctgatctatcacgggcggggcgatgtgccg

SEQ ID NO: 1320 - protein, 154 aa, Corynebacterium glutamicum
TVPLGDGQGRYIAKIPSTAFVGVSENKFANLALAEAIGMEVPARELVGRAQFEGVPPEFEAMTDGLVLLVRRFDRAGDGVRVHMEDFAQVFGLYPARKYDGAASHDIAAVLGSAVSIAAGLEFVRRLALSVVMGNGDMHLKNWSLIYHGRGDVP

SEQ ID NO: 1321 - DNA, 273 bp, Corynebacterium glutamicum
  CDS (101)..(250): RXN02840
aagtgaaatcaatcggcttttccagcagcagcactggtcgcgccagcgtgggtgttatggtgaaggcgaatacaccttcagcaccgctgagccggaagagatgacggtaatcagtggcgcgctgaatgtgttactgcctgacgcgaccgactggcaggtgtatgaagccggttcggtgtttaatgttcccggtcacagtgagtttcatctgcaagttgccgaacccacctcttatctgtgccgctatctgtaattcctcgccttccccttgaa

SEQ ID NO: 1322 - protein, 50 aa, Corynebacterium glutamicum
MTVISGALNVLLPDATDWQVYEAGSVFNVPGHSEFHLQVAEPTSYLCRYL

SEQ ID NO: 1323 - DNA, 273 bp, Corynebacterium glutamicum; identical to SEQ ID NO: 1321
  CDS (101)..(250): FRXA02840

SEQ ID NO: 1324 - protein, 50 aa, Corynebacterium glutamicum; identical to SEQ ID NO: 1322

SEQ ID NO: 1325 - DNA, 558 bp, Corynebacterium glutamicum
  CDS (101)..(535): RXN02841
ctcacataactttacgccaccccataccctttaacccctgcactgctcatccacaagcactgtgcaggggttgtgttttctaacaagaaaagagaccaccatgttcacagcttttaaaagcaatcctacgaccattaaaaagctggtttctgagctcattaatggcgacgatgcagcgctcaacgaactagagcgacacgtcactaatgaatcagtccgtgctcgcgaactccctaatgtccagtacaaagccactgcggggcgcaacttcgccatatccaagctggtccaaaatttgcgtcgcatcaacaaggcacaaaacaatccacgtggtgtgcccactcatgccaccgtgattctgcttaaggaagacggcagctacgacggtgaagaacagtggcgcattccagaaaaggcgatcactccgttcgacatgctacgttcgcctgacttcaaccacaacaggctgaagaaccggccgctcatggtcgagtcccaatacccctggggcgtccccggactcattaaaatgaactgatcaatccctgacacagccat

SEQ ID NO: 1326 - protein, 145 aa, Corynebacterium glutamicum
MFTAFKSNPTTIKKLVSELINGDDAALNELERHVTNESVRARELPNVQYKATAGRNFAISKLVQNLRRINKAQNNPRGVPTHATVILLKEDGSYDGEEQWRIPEKAITPFDMLRSPDFNHNRLKNRPLMVESQYPWGVPGLIKMN

SEQ ID NO: 1327 - DNA, 285 bp, Corynebacterium glutamicum
  CDS (7)..(285): FRXA02841
accaccatgttcgcagcttttaaaagcaatcttccgaccattaaaaagctggtttatgaggtcattaatggcgtcgatgcagcgctcaacgaactagagcgacacgtcactaatgaatcagtccgtgctcgcgaactccctaatgtccagtacaaagccactgcggggcgcaacttcgccatatccaagctggtccaaaatttgcgtcgcatcaacaaggcacaaaacaatccacgtggtgtgcccactcatgccaccgtgattctgcttaagggagacggcagc

SEQ ID NO: 1328 - protein, 93 aa, Corynebacterium glutamicum
MFAAFKSNLPTIKKLVYEVINGVDAALNELERHVTNESVRARELPNVQYKATAGRNFAISKLVQNLRRINKAQNNPRGVPTHATVILLKGDGS

SEQ ID NO: 1329 - DNA, 873 bp, Corynebacterium glutamicum
  CDS (101)..(850): RXN02846
tacaagcgctgaacgttgagtttgagtttggtccattgaggggtaaaggcttacctctcgactaggtggggtgggcgtagagcgcctattctgattgatcgtgttaaccatcgctattgtacttctcgcgtcagtcctcatcggtgctcttctccaacgcatgacaggattgggcgtcggtctagttaccggcccagtcctgacttctttgttagggccgctagcaggcgtgaccatggtgaatggtctgtccatcatcaacgcggtgaataatgcgtggtcggtgcgcaaacgcactgactgggccaaattccgaattcttgccggcgctttggtgcttggttctgttcctgctgttgcagtggtgtatttccttaacggaccatggctgttgattttcgttggtgcgatggtgctgctcgcgttgggtgtttccctgttcccaacagagaaattcgcactcaagcaagaagctaaactgcctatggtcatcttcggcatgattggtggattcatgtccactgttgcaggcatcgcagggccatccctgactgtttatgcgcgcctgagccgctgggattaccgcgactttgtggccaccttgcacccagttctactcgtggccaacaccgtatcgttcctgctcaaggttatcttgatcggtggactcgatttcggtggcgcacccgcatggctctggatcggtgccgtagcgatgatctttgtcggtgcttggttgggtgaaatcgtcaacgctaaggtgtccaccccaatggccaagcgcatcgctacgctcctggcagcagctggtgccgcagtggtgttgttccgaggcatcatggaattggtttagcggtcttaattggtgggaag

SEQ ID NO: 1330 - protein, 250 aa, Corynebacterium glutamicum
VLTIAIVLLASVLIGALLQRMTGLGVGLVTGPVLTSLLGPLAGVTMVNGLSIINAVNNAWSVRKRTDWAKFRILAGALVLGSVPAVAVVYFLNGPWLLIFVGAMVLLALGVSLFPTEKFALKQEAKLPMVIFGMIGGFMSTVAGIAGPSLTVYARLSRWDYRDFVATLHPVLLVANTVSFLLKVILIGGLDFGGAPAWLWIGAVAMIFVGAWLGEIVNAKVSTPMAKRIATLLAAAGAAVVLFRGIMELV

SEQ ID NO: 1331 - DNA, 573 bp, Corynebacterium glutamicum
  CDS (1)..(573): FRXA02846
gtgaatggtctgtccatcatcaacgcggtgaataatgcgtggtcggtgcgcaaacgcactgactgggccaaattccgaattcttgccggcgctttggtgcttggttctgttcctgctgttgcagtggtgtatttccttaacggaccatggctgttgattttcgttggtgcgatggtgctgctcgcgttgggtgtttccctgttcccaacagagaaattcgcactcaagcaagaagctaaactgcctatggtcatcttcggcatgattggtggattcatgtccactgttgcaggcatcgcagggccatccctgactgtttatgcgcgcctgagccgctgggattaccgagactttgtggccaccttgcacccagttctactcgtggccaacaccgtatcgttcctgctcaaggttatcttgatcggtggactcgatttcggtggcgcacccgcatggctctggatcggtgccgtagcgatgatctttgtcggtgcttggttgggtgaaatcgtcaacgctaaggtgtccaccccaatggccaagcgcatcgctacgctcctggcagcagctggt

SEQ ID NO: 1332 - protein, 191 aa, Corynebacterium glutamicum
VNGLSIINAVNNAWSVRKRTDWAKFRILAGALVLGSVPAVAVVYFLNGPWLLIFVGAMVLLALGVSLFPTEKFALKQEAKLPMVIFGMIGGFMSTVAGIAGPSLTVYARLSRWDYRDFVATLHPVLLVANTVSFLLKVILIGGLDFGGAPAWLWIGAVAMIFVGAWLGEIVNAKVSTPMAKRIATLLAAAG

SEQ ID NO: 1333 - DNA, 1135 bp, Corynebacterium glutamicum
  CDS (47)..(1135): RXN02847
atatcgcagcagcctcgatggtcaacgcccatatgatgggaagttgttggcgctaaccgccagaggctttctcaattctgaaagaagccagacaaggtggaaaacccacttcaccacccagaaagttccacgctccggctacagatatgacctcgatgggctccgcggcatcgcgatcgccttcgtagttttgttccatgttttcgtcggaaaagtctccggcggtgtggatgtcttcctgctgctgtctggctatttcttcttagggtcgcaattgcgttatgcagatcgtccagattcttccatcaacccctggtggccgatttggcgcacgctacgcagattacttcctgcgttagtgctggtgttgggcgtttccatggtcctcatcttggcgtgggtgcccagactgcaaccaatagaaatagccaaccaagcagtagccagcctcttctatgtccaaaactgggagctcgcatcccaaggtgctgcctacggagcagcctctgcagaagtcagtcctttccagcacttgtggtccatggctgtgcaagggcagttctacctctttgccatcttgttgagcatggcgatcatcctgattcgtcgataccgccccgaatactccgcagtgcgactagcgactcctgtgctggcagtgctcacatccgtatcatttttcagtgcaatcctgtggcatttcattgatcaatcagtcaactactattccaccttcaccaggttctgggagctcggccttggtgcactattggtgctgcatgcgcctcgaattttgatttctgcgaagactaaatcaatactcgcagccgtcggtttgtttatggtgctatccactggattcttcatggatggcgcagagactttccctggattccccgcgctgtatcccatcttgggtgcttgcttagtcatccttggcgacggtaaaatctcggtctttctctcccgaaaatggatgctttggctcggcgatatcgcctacccgctctacttgtggcactggcctctgctgatcattttcaccgctttgttcaaccaagaagagccatccatctggctgggtatcgccgtgattatgctgtcccttggcttggcgcagctgactaacaaatac

SEQ ID NO: 1334 - protein, 363 aa, Corynebacterium glutamicum
LALTARGFLNSERSQTRWKTHFTTQKVPRSGYRYDLDGLRGIAIAFVVLFHVFVGKVSGGVDVFLLLSGYFFLGSQLRYADRPDSSINPWWPIWRTLRRLLPALVLVLGVSMVLILAWVPRLQPIEIANQAVASLFYVQNWELASQGAAYGAASAEVSPFQHLWSMAVQGQFYLFAILLSMAIILIRRYRPEYSAVRLATPVLAVLTSVSFFSAILWHFIDQSVNYYSTFTRFWELGLGALLVLHAPRILISAKTKSILAAVGLFMVLSTGFFMDGAETFPGFPALYPILGACLVILGDGKISVFLSRKWMLWLGDIAYPLYLWHWPLLIIFTALFNQEEPSIWLGIAVIMLSLGLAQLTNKY

SEQ ID NO: 1335 - DNA, 694 bp, Corynebacterium glutamicum
  CDS (101)..(694): FRXA02847
ccagcctcttctatgtccaaaaactgggagctcgcatcccaagggtgctgcctacggagcagcctctgcagaagtcagtcctttccagcacttgtggtccatggctgtgcaagggcagttctacctctttgccatcttgttgagcatggcgatcatcctgattcgtcgataccgccccgaatactccgcagtgcgactagcgactcctgtgctggcagtgctcacatccgtatcatttttcagtgcaatcctgtggcatttcattgatcaatcagtcaactactattccaccttcaccaggttctgggagctcggccttggtgcactattggtgctgcatgcgcctcgaattttgatttctgcgaagactaaatcaatactcgcagccgtcggtttgtttatggtgctatccactggattcttcatggatggcgcagagactttccctggattccccgcgctgtatcccatcttgggtgcttgcttagtcatccttggcgacggtaaaatctcggtctttctctcccgaaaatggatgctttggctcggcgatatcgcctacccgctctacttgtggcactggcctctgctgatcattttcaccgctttgttcaaccaagaagagccatccatctggctgggtatcgccgtgattatgctgtcccttggcttggcgcagctgactaacaaatac

SEQ ID NO: 1336 - protein, 198 aa, Corynebacterium glutamicum
MAVQGQFYLFAILLSMAIILIRRYRPEYSAVRLATPVLAVLTSVSFFSAILWHFIDQSVNYYSTFTRFWELGLGALLVLHAPRILISAKTKSILAAVGLFMVLSTGFFMDGAETFPGFPALYPILGACLVILGDGKISVFLSRKWMLWLGDIAYPLYLWHWPLLIIFTALFNQEEPSIWLGIAVIMLSLGLAQLTNKY

SEQ ID NO: 1337 - DNA, 305 bp, Corynebacterium glutamicum
  CDS (1)..(282): RXN02849
tccccataccccgtcatgatcagcacctctgccgacgcctcaaacgtgaccgtgcgcatcatgggtgtggacaccacctccgtggaatccatcaacaacggacgttggtccaccacccagcccaacacagttcgagtatcgggttcagattgtgtgccatcaaccggtgcaccaggatttaccacctcagacacccgaatcatcagcgatctttctggcaacgaaatcaccagagaaaccgtcaccacggtttacgatccttcaccaaacgtggtctgctcctaaaacaaaatgccccaccagat

SEQ ID NO: 1338 - protein, 94 aa, Corynebacterium glutamicum
SPYPVMISTSADASNVTVRIMGVDTTSVESINNGRWSTTQPNTVRVSGSDCVPSTGAPGFTTSDTRIISDLSGNEITRETVTTVYDPSPNVVCS

SEQ ID NO: 1339 - DNA, 305 bp, Corynebacterium glutamicum
  CDS (1)..(282): FRXA02849
tccccataccccgtcatgatcagcacctctgccgacgcctcaaacgtgaccgtgcgcatcatgggtgtggacaccacctccgtggaatccatcaacaacggacgttggtccaccacccagcccaacacagttcgagtatcgggttcagattgtgtgccatcaaccggtgcaccaggatttaccacctcagacacccgaatcatcagcgatctttctggcaacgaaatcaccagagaacccgtcaccacggtttacgatccttcaccaaacgtggtctgctcctaaaacaaaatgccccaccagat

SEQ ID NO: 1340 - protein, 94 aa, Corynebacterium glutamicum
SPYPVMISTSADASNVTVRIMGVDTTSVESINNGRWSTTQPNTVRVSGSDCVPSTGAPGFTTSDTRIISDLSGNEITREPVTTVYDPSPNVVCS

SEQ ID NO: 1341 - DNA, 582 bp, Corynebacterium glutamicum
  CDS (101)..(559): RXN02911
accgcatacattaacgtgttgatcattgccctagtatgcgcagtagcggctgctctgatcagcagttaccttttccgcggaaatccgaagggagccaataatgcgcactagtaaaaaagagatgattctgcgcacggccatcgattatatcggcgagtacagcctcgagacgctgagttacgattcgctcgccgaggcgaccggtctgtccaagtcgggcttgatttatcatttccccagccgccatgcgctgcttttaggcatgcacgagttgcttgccgacgactgggacaaggaattgcgcgacataacccgcgacccagaggatccacttgagcgattgcgcgccgtcgtggttacgcttgctgaaaacgtttcgcgccccgagctggttttgcttatggacgccccctcccacccgggatttcttaacgcctggcgcactgtaaatcatcaatggatccccgacaccgatgatctggaaaacgatgcccacaaacgcgccgtctactctggtgcagctcgcagccgatggcctcttcgtgcacgattacattcatgatgatgtcctcagcaagtcca

SEQ ID NO: 1342 - protein, 153 aa, Corynebacterium glutamicum
MRTSKKEMILRTAIDYIGEYSLETLSYDSLAEATGLSKSGLIYHFPSRHALLLGMHELLADDWDKELRDITRDPEDPLERLRAVVVTLAENVSRPELVLLMDAPSHPGFLNAWRTVNHQWIPDTDDLENDAHKRAVYSGAARSRWPLRARLHS

SEQ ID NO: 1343 - DNA, 666 bp, Corynebacterium glutamicum
  CDS (101)..(643): RXN02914
tgtggatcgcagcaattgcatcccctgggccagaccttttcagatcatcaggctaagtgccaaaaaccgccgtgatggcgtactgactgccgtaggcatcatggtgggaaactccatctggatcatagccagcctccttgggctctcggcactgatctccacgtatccagcaattttgaacctgttgcagctcgtcggtggcggttatttgacctggatgggcatcggggcggtgaggtcatggtggacgaaacgctccacacagcaagctgcagcggattctcaagctgtagagaatacgttggtgacagccacggctgcatctgtcggagtgtggccagctattcgatctggcattgctaccaacttgtccaaccccaaagctgtgctgttttttggttccgttttcgcccaatttgttagacctgacatgggaatcgggtggagtattttcattggagtcttcctcaccctcactggcctgctgtggtttgtggggttcgccgtcttggtccgcaaactagccgctggcctcacccgaaatggagccatcatcgacctgctaacgggggtgattttcatcgggctgggaatgttcatgatcttcgagggggttgtaggaatcggtggcagggtagtgggttagccccgcccccaggacgtcac

SEQ ID NO: 1344 - protein, 181 aa, Corynebacterium glutamicum
MVGNSIWIIASLLGLSALISTYPAILNLLQLVGGGYLTWMGIGAVRSWWTKRSTQQAAADSQAVENTLVTATAASVGVWPAIRSGIATNLSNPKAVLFFGSVFAQFVRPDMGIGWSIFIGVFLTLTGLLWFVGFAVLVRKLAAGLTRNGAIIDLLTGVIFIGLGMFMIFEGVVGIGGRVVG

SEQ ID NO: 1345 - DNA, 594 bp, Corynebacterium glutamicum
  CDS (101)..(571): RXN02921
tggaaaactgggaagggttgacgttgcggaatctctccgcagcgtcggttcggaccctaaaaaagggtgaggaaccacatgagctgttttaaggaattttgtgtctgcacttgaagagtcgatccgcatcgcgaccatcgcggcgaaagcagcggatgaaaagaaggccgatgacatcgctgtcatcgatgtctctgacatgatcgcaatcaccgattgctttgttgttgcatctgctgacaatgagcgccaggtgggcgccattgttgaggagatcgaagatgagatgaccaaggctggtttcgagcctaagcgccgtgaaggcaaccgcgaaaaccgttgggttctccttgactacggattggttgttatccacgttcagcgacaggcagagcgcgagttctacggactggatcgtctgtaccgcgactgcccactcattgaaattgaaggacttgaaaccttcaagcgtgaatcctcctggtctgatgaggcggatatccgcaacatcgacagcattgatgaactcccacctttgccagctgaatacgagcctggctacgaggacgattaagaggtagtcctgtgactcgt

SEQ ID NO: 1346 - protein, 157 aa, Corynebacterium glutamicum
VSALEESIRIATIAAKAADEKKADDIAVIDVSDMIAITDCFVVASADNERQVGAIVEEIEDEMTKAGFEPKRREGNRENRWVLLDYGLVVIHVQRQAEREFYGLDRLYRDCPLIEIEGLETFKRESSWSDEADIRNIDSIDELPPLPAEYEPGYEDD

SEQ ID NO: 1347 - DNA, 672 bp, Corynebacterium glutamicum
  CDS (101)..(649): RXN02924
ctaggcaggtgtgcgatcaaaccacactgtcagaatcaaatctgctggacgctatgccagcggattgttgatcacgaaaaagcatgtcacagacacctttgtgccttctgtagcatccatctcagagcgcgccacgtttattctcaccgccgatcactttttgcgcagctgctcgaaagtaatttatgtccggggcgaaaatttcaccgccacagcaaccaccagcctgtctgtatttggcacagatctgggtttgatcaaattagacggcaaagcccccaccatgccacttccacttttcgcagataagccacttcgcgtgggcatgaaaaccaccacgttcggattcggcggtctgccatcagccaccgttgctaaagaaatccacgggcgcgttatctctgccatcccccatggcgtatcaagaaaccgcatcacccgagtccatcacggtgccttgatctttaactccccagaaaaggcagtaaagggagactccggcggacctgtgctggttaatggacgagtagccggaatccaatcaatgatctctgaccccggtggatttaacaccggggtcgccactgccgcatcccttatccagcacatgcctgccctagctcaagcgcttgaactgctcgaacatagctagctcgctaggaaccgatcgcc

SEQ ID NO: 1348 - protein, 183 aa, Corynebacterium glutamicum
VPSVASISERATFILTADHFLRSCSKVIYVRGENFTATATTSLSVFGTDLGLIKLDGKAPTMPLPLFADKPLRVGMKTTTFGFGGLPSATVAKEIHGRVISAIPHGVSRNRITRVHHGALIFNSPEKAVKGDSGGPVLVNGRVAGIQSMISDPGGFNTGVATAASLIQHMPALAQALELLEHS

SEQ ID NO: 1349 - DNA, 591 bp, Corynebacterium glutamicum
  CDS (101)..(568): RXN02927
tccgcagttgggcctgcttgacgccagatctcaagtgtaagtttcattacttgtagttccttgtctgcagtgggacagattcgaagaacagtggttctgcgtggcagacgaaggttccattctcgcctggttcccatgcggagacgaagcaccagttttggtcgtcacgttgtgcttcgccatcttcggagaggtggtcgtcgcggaagtgagcgccacaggactcgtcgcggtcgagggcgtcgacacacatgagttcgccgaggtcgatgtagtcggctacgcgtgctgcgtattcgagaacctggttcatctcatcggtgctgccggtgatgcgcatgttcttccagaagtcatcgcggagggcacggatcttgttgatgccatcctggaggtcttctacgtttcgggaaacgccacaggagaagtacaggatatcgccaagctggcggtggtagtactcaggtccgtgaacgttgtcaccgacccactctgggcggttgcccatgaggcggtcaatgcgagcctgtgcacgcgcaatcgctgcctgtgcttctggtgcatcctctgacagacgctcggagccaagca

SEQ ID NO: 1350 - protein, 156 aa, Corynebacterium glutamicum
VADEGSILAWFPCGDEAPVLVVTLCFAIFGEVVVAEVSATGLVAVEGVDTHEFAEVDVVGYACCVFENLVHLIGAAGDAHVLPEVIAEGTDLVDAILEVFYVSGNATGEVQDIAKLAVVVLRSVNVVTDPLWAVAHEAVNASLCTRNRCLCFWCIL

SEQ ID NO: 1351 - DNA, 816 bp, Corynebacterium glutamicum
  CDS (101)..(793): RXN02928
ggtttgcaccgtggtaggtccaggatgcttcgcctgcgcagaacagacctgggagtgacgtcatttcgttgaagtcagtccagaggccacccatggtgaagtggcaggtcggtgcaatacgcattgggctggagtatgggtcctcgccaattgcctcttcgtacatggtgaagaggttggagtaacgctcgcggatggtgtcctgtccgaggcgctcggtggcgtcgcggaagtccaggtatgcagcgttgttcagaggtccaacaccgagaccagcattgatctgctgggagatcgcacgggaagcaacgtcacgtgggacgaggttaccgaatgctgggtagcggcgctccaggaagtagtcgcgctcatcctcagggatggtgtttggatcgcggttatcgttcggttccttaggggaccagatgcggccgtcgttacgcagcgactcggacatcagaatggtcttggactgccaggtggagttcacaggcaggccggttgggtggaactggatgaacgatggggacgcgaagtatgcgccggcttcgtatgcacgcatgatggccgaggcgttggagttcttggccagggtggacatgtggtacacgttgccgtagccaccggttgccaggataacggcatggccggtgtgtgcggtgagctcgccggtgatcaggttgcgcatgatcaggccttcgcagcgcttttcaccgttacgttcggtgacaatgacgtcaaccatttcgttatgggtgaagatttctacggagccgaggtggatctggcgctgtagtgcggatgcggtggagaact

SEQ ID NO: 1352 - protein, 231 aa, Corynebacterium glutamicum
VAGRCNTHWAGVWVLANCLFVHGEEVGVTLADGVLSEALGGVAEVQVCSVVQRSNTETSIDLLGDRTGSNVTWDEVTECWVAALQEVVALILRDGVWIAVIVRFLRGPDAAVVTQRLGHQNGLGLPGGVHRQAGWVELDERWGREVCAGFVCTHDGRGVGVLGQGGHVVHVAVATGCQDNGMAGVCGELAGDQVAHDQAFAALFTVTFGDNDVNHFVMGEDFYGAEVDLAL

SEQ ID NO: 1353 - DNA, 348 bp, Corynebacterium glutamicum
  CDS (101)..(325): RXN02931
gatgggtgcagaaattgaattgaaagaatccgggcacatgtgggtggaatccccgagtgactagtgcggtgtaagagcactagactgttcaactatgagcatgcaaccatacccccgcaacccaatcgaaaaacgtaagcaagaagtacgcaagaactcccgcaacgcagttgtcagtgttggcggtggcatcgtaggcggtgcggctctgtggctagtgttcggctctgcattctttatgggacttggattgatcatcgccgtggtcggcggtttttattactacaacaaggtccaaaagatcattaacgaaaaagaccgttactagttagaaatctatgtcagaca

SEQ ID NO: 1354 - protein, 75 aa, Corynebacterium glutamicum
MQPYPRNPIEKRKQEVRKNSRNAVVSVGGGIVGGAALWLVFGSAFFMGLGLIIAVVGGFYYYNKVQKIINEKDRY

SEQ ID NO: 1355 - DNA, 1095 bp, Corynebacterium glutamicum
  CDS (101)..(1072): RXN02932
cactactgcgttaaggtatgaaagttcgcacaccagcgatttaattctgtgcccaccactagcacgaccatttcagttttaactttcttggagttttctagtgtccaaaacagaagaaggccgttcagcggccataattatttacgcgtttccaactttcattctgctgggcgcgatcattgcgtttatcttcccggaaccattcattccgctgacaaactacattaatatcttcctcacgatcatcatgttcaccatgggtttgaccttgacggtgcccgattttcagatggtgcttaaacgtccactgcctatcttgatcggtgtagtagcgcagtttgtcatcatgccattcctggcgatcgtggttgcgaaaatgttcaacctcaacccagcactcgccgttggccttctcatgctgggatccgttccgggtggcacctcctccaatgtgattgcgtttctcgcccgaggagatgtcgcgctatcggtcaccatgacctctgtgtccaccattgtttccccaatcatgacgcctttcctcatgctcatgctggcaggtactgaaaccgccgtcgatggtggaggcatggcgtggactttggtacaaacagtgctgctgcctgtgatcatcggcctagttctgcgtgtcttcttgaacaagtggatcgacaagattttgccgatccttccttatctctccatcctcggtatcggtggcgtggtgttcggcgcagtcgcagccaacgcggaacgactcgtgtctgtcggactcatcgtgttcgttgcagttatcgtgcacaacgtacttggatacgttgtgggatacctcaccggccgtgtattcaaattcccagaagcagcaaaccgcaccatggcgattgaaatcggaacccaatccgcaggcctcgcatcgggaatggcaggacgattcttcaccccagaagcagcccttccaggtgctgtcgctgccttggtccacaacatcaccggcgcagtttatgttgggctggtacgaaacaggcctttgactaaggcatcaaggaagaaggaatccgtcgcggtttccagctaacttatttgctgcccgttaga

SEQ ID NO: 1356 - protein, 324 aa, Corynebacterium glutamicum
VSKTEEGRSAAIIIYAFPTFILLGAIIAFIFPEPFIPLTNYINIFLTIIMFTMGLTLTVPDFQMVLKRPLPILIGVVAQFVIMPFLAIVVAKMFNLNPALAVGLLMLGSVPGGTSSNVIAFLARGDVALSVTMTSVSTIVSPIMTPFLMLMLAGTETAVDGGGMAWTLVQTVLLPVIIGLVLRVFLNKWIDKILPILPYLSILGIGGVVFGAVAANAERLVSVGLIVFVAVIVHNVLGYVVGYLTGRVFKFPEAANRTMAIEIGTQSAGLASGMAGRFFTPEAALPGAVAALVHNITGAVYVGLVRNRPLTKASRKKESVAVSS

SEQ ID NO: 1357 - DNA, 429 bp, Corynebacterium glutamicum
  CDS (101)..(406): RXN02934
tggatgggccggtggcggtgaccatggtagatgcggattcaagctgccaggcgcgctcattgagtggctggccgtagtagatttctacaactccgccggcgtgggtgcagacgaattcgatttcatctttgagattgatgcgccagaagccggattcgcgctggtcgacgccggtggggtttccttcttcgtcgagtttccacatgcgggattcgaaggagaggtagttttcaccgtcgtgggcgaaggtgatttgctggccgaatgcgtattgtccgtcttctgcggtgtcggcttggccttcgccgcgccagacgccgacgagagggaggagcgcgaggagtccgtcgtggaggttggggccttcgcggaggttagcggtgtcgtcagggataggaaggtcacctaggcctgggatgttgcggtgag

SEQ ID NO: 1358 - protein, 102 aa, Corynebacterium glutamicum
VGADEFDFIFEIDAPEAGFALVDAGGVSFFVEFPHAGFEGEVVFTVVGEGDLLAECVLSVFCGVGLAFAAPDADEREEREESVVEVGAFAEVSGVVRDRKVT

SEQ ID NO: 1359 - DNA, 321 bp, Corynebacterium glutamicum
  CDS (101)..(298): RXN02936
accaagttcagacagctctgggttggacctaccggagtaaaggcgtgccactgacatagcagtttggccgtggcgaagcaacaagaaacgagtgggatctgtggttgcgccgttccagttggtgggtttggtttcggtgcagttgaggtcttctttctctgagcccgcaaccgaagaagcagaagatacagaagcagaatcccctacaacacctaccggcttacctgccgctgcagcatccatcgccacgttggacaatgcgtcagctcgtttgtttttctcacgcggaatccacgtataagaaacggacccgatttcgga

SEQ ID NO: 1360 - protein, 66 aa, Corynebacterium glutamicum
VVAPFQLVGLVSVQLRSSFSEPATEEAEDTEAESPTTPTGLPAAAASIATLDNASARLFFSRGIHV

SEQ ID NO: 1361 - DNA, 1725 bp, Corynebacterium glutamicum
  CDS (101)..(1702): RXN02939
cttcgaagaagacgatatcccctacgaagtcgacgtggatgacttatttatcctcggtggcttagacaacttcataaatccccttggagtgattgagataatgaatctccactccttagagattcgccaaatttcatccggcacaatttcagaacgaaaaacttggatctttcccactgctgctcgctcattcaatcaaaatctagtacacccgcaaagcattgaaatcgatgcacaaaccggcgttattttggctatggaaaaccgactacaacgtaccgaagttgaatcagtagagtacccaacggatcttcctaatcctgcatggacaggtccagccatttcttggccactaaaagacccatcaatcgatttccctgacccgctcccccacagcatttccgaattaccacctcaatccgataatcctcggcatttgcgagtatccatcagcttagatgcagtggaaggtgcttttccgcgctaccggatcggagattcaatacgtattccgcttgtctttgcccgggacacgcccttcatgtccggcttagaaacaacacgtcgcgcctggattgaggcggccacggaaatggacatccataacacatggcccataatcctcaccggtgacggctggactgcactctctcattcagacaaaccaatacgccacgaagccgagttaaagggatggtttttccacagtttgttcggcagtgaaatgcccttgactgatctgaagattgaacgaatctacggaggcctgggtactttcgacagcggagccacccggtggcaagaactcacagacacagatgatgcctacacagaaaatggcagctggctgttggaagttatcgtcgatgccacccttgacggtgcaattccaccaccacttcagccacaacagtttgaagcatccatcactcacatcgtcgatgagcaactatgggtccttgggcagatgcttccagttctacgatgctgggatcttgaaaccggaaaatacctggggcaaacctatgtacctatttcggtttctcatagttctcggcttcagttttcggaagggttgattcacgattatgaaaatgcctggtcgctgaatcctggggtgcgcatgcttgcggagccacagccgtggatagagcctgtcattgaactcgacgttccagcgccatgggaattacaagaaagcttccccgatgggctttactccctaactgatggagagcaaacagcactgggtcgaagcactccagcaggacaattggaaatctgtgtaatcagcaatgacggatccaggatcttaaacgcaggccgagtagaagacctgtactttgtgcaattctggggcatgaccgtctttttgaattccaactttcaagtgcaaagtgccgaagaacatcagcttggtgcgaaacgtgaacgctggattacacaagaaggcgtagctgccaagttcaccgaagaagatgaaatcgtattcctcgatcagatatctgaaagcgaaataaccaggtggaaaacaccagaaggatacttcactgaggtcagaattctgtcaccaaaccacttcaacatactggttactccgcctactggttctgactatctcaaaccagtaccttcctctgtctcagtgtttagagacggtcaatggagcaacattaaattcgaggacgtctctgtagaaatctagggctttcgacgcttgagccc

SEQ ID NO: 1362 - protein, 534 aa, Corynebacterium glutamicum
MNLHSLEIRQISSGTISERKTWIFPTAARSFNQNLVHPQSIEIDAQTGVILAMENRLQRTEVESVEYPTDLPNPAWTGPAISWPLKDPSIDFPDPLPHSISELPPQSDNPRHLRVSISLDAVEGAFPRYRIGDSIRIPLVFARDTPFMSGLETTRRAWIEAATEMDIHNTWPIILTGDGWTALSHSDKPIRHEAELKGWFFHSLFGSEMPLTDLKIERIYGGLGTFDSGATRWQELTDTDDAYTENGSWLLEVIVDATLDGAIPPPLQPQQFEASITHIVDEQLWVLGQMLPVLRCWDLETGKYLGQTYVPISVSHSSRLQFSEGLIHDYENAWSLNPGVRMLAEPQPWIEPVIELDVPAPWELQESFPDGLYSLTDGEQTALGRSTPAGQLEICVISNDGSRILNAGRVEDLYFVQFWGMTVFLNSNFQVQSAEEHQLGAKRERWITQEGVAAKFTEEDEIVFLDQISESEITRWKTPEGYFTEVRILSPNHFNILVTPPTGSDYLKPVPSSVSVFRDGQWSNIKFEDVSVEI

SEQ ID NO: 1363 - DNA, 1243 bp, Corynebacterium glutamicum
  CDS (101)..(1243): FRXA01383
cttcgaagaagacgatatcccctacgaagtcgacgtggatgacttatttatcctcggtggcttagacaacttcataaatccccttggagtgattgagataatgaatctccactccttagagattcgccaaatttcatccggcacaatttcagaacgaaaaacttggatctttcccactgctgctcgctcattcaatcaaaatctagtacacccgcaaagcattgaaatcgatgcacaaaccggcgttattttggctatggaaaaccgactacaacgtaccgaagttgaatcagtagagtacccaacggatcttcctaatcctgcatggacaggtccagccatttcttggccactaaaagacccatcaatcgatttccctgacccgctcccccacagcatttccgaattaccacctcaatccgataatcctcggcatttgcgagtatccatcagcttagatgcagtggaaggtgcttttccgcgctaccggatcggagattcaatacgtattccgcttgtctttgcccgggacacgcccttcatgtccggcttagaaacaacacgtcgcgcctggattgaggcggccacggaaatggacatccataacacatggcccataatcctcaccggtgacggctggactgcactctctcattcagacaaaccaatacgccacgaagccgagttaaagggatggtttttccacagtttgttcggcagtgaaatgcccttgactgatctgaagattgaacgaatctacggaggcctgggtactttcgacagcggagccacccggtggcaagaactcacagacacagatgatgcctacacagaaaatggcagctggctgttggaagttatcgtcgatgccacccttgacggtgcaattccaccaccacttcagccacaacagtttgaagcatccatcactcacatcgtcgatgagcaactatgggtccttgggcagatgcttccagttctacgatgctgggatcttgaaaccggaaaatacctggggcaaacctatgtacctatttcggtttctcatagttctcggcttcagttttcggaagggttgattcacgattatgaaaatgcctggtcgctgaatcctggggtgcgcatgcttgcggagccacagccgtggatagagcctgtcattgaactcgacgttccagcgccatgggaattacaagaaagcttccccgatgggctttacttcctaactgatggcaagcaaaca

SEQ ID NO: 1364 - protein, 381 aa, Corynebacterium glutamicum
MNLHSLEIRQISSGTISERKTWIFPTAARSFNQNLVHPQSIEIDAQTGVILAMENRLQRTEVESVEYPTDLPNPAWTGPAISWPLKDPSIDFPDPLPHSISELPPQSDNPRHLRVSISLDAVEGAFPRYRIGDSIRIPLVFARDTPFMSGLETTRRAWIEAATEMDIHNTWPIILTGDGWTALSHSDKPIRHEAELKGWFFHSLFGSEMPLTDLKIERIYGGLGTFDSGATRWQELTDTDDAYTENGSWLLEVIVDATLDGAIPPPLQPQQFEASITHIVDEQLWVLGQMLPVLRCWDLETGKYLGQTYVPISVSHSSRLQFSEGLIHDYENAWSLNPGVRMLAEPQPWIEPVIELDVPAPWELQESFPDGLYFLTDGKQT

SEQ ID NO: 1365 - DNA, 447 bp, Corynebacterium glutamicum
  CDS (101)..(424): RXN02950
tccgccctatttcagcaatgtttaataccggtggaatcgtttttattaggatgggtggatacctatctttagtgagccgtactagcgagaaagctgccccatgactgttttcaatgttctccatgacgcacccgcaccacagccggataaaaaccgccccggtgtcaaacgtctcctccaaggtgatggcgcaaacctcatcgccttcactttcagccctggacagtcacttcccgaccaccgcgccgcacatcccatcaccgtgaccgcattttctggccagctcaccttcagctatggcgaggaaacctttgagctctcccccggtgtgacagtgcacttggaagcaggagttacccaccgcgtggactgcccgccagaagcaccaggcgatgcaagtaatgctgttaactatgctcactggtgaaaaacactcagtcaaccagg

SEQ ID NO: 1366 - protein, 108 aa, Corynebacterium glutamicum
MTVFNVLHDAPAPQPDKNRPGVKRLLQGDGANLIAFTFSPGQSLPDHRAAHPITVTAFSGQLTFSYGEETFELSPGVTVHLEAGVTHRVDCPPEAPGDASNAVNYAHW

SEQ ID NO: 1367 - DNA, 732 bp, Corynebacterium glutamicum
  CDS (101)..(709): RXN02951
gataatgagtcagaaaatgaaggtagcactacttgctggattaattttcaaggttttctttcagaaattaatccatagccgatatttaaggtgagaacacatgagctccacgctcgcacgaaaagcttcaggcgacggttccgaaaagaagaagcctggcttgtttagacgtgcgcttcgtttcctcacccacccacctcacaaacaggtagacaacagccttgcggatatccgtgaaggattaggcctcggggtggacgattcccacgaaggatccaaacccagcaacgatcattctttgctgcatgaaaagcctgaaatttccgtcatgccgaccgaatcaatggcacggctgatcttttatgcgcctgatatggatgggcaaacagaccccggtgaagtagtgtggatttgggcaccagccgatggcccccagcaaccaccccgtaaacgtgccatcgttgttgttggaagaaaccgaaacgccattttaggtctgctcatttcctgcaaccccgagcaccgcactgatgaagactggatcgacattggatctggcagctgggaccctcgaggtcgccaaagttgggtacgactcgaccgcgttctggaggtacccgaattgggtatccggcgccaaggaacagtcgtccccccggggcgctttgagcgtatcgccaaccgcctccgcaacgatttcaactgggtctaacatttatttggtaattgggc

SEQ ID NO: 1368 - protein, 203 aa, Corynebacterium glutamicum
MSSTLARKASGDGSEKKKPGLFRRALRFLTHPPHKQVDNSLADIREGLGLGVDDSHEGSKPSNDHSLLHEKPEISVMPTESMARLIFYAPDMDGQTDPGEVVWIWAPADGPQQPPRKRAIVVVGRNRNAILGLLISCNPEHRTDEDWIDIGSGSWDPRGRQSWVRLDRVLEVPELGIRRQGTVVPPGRFERIANRLRNDFNWV

SEQ ID NO: 1369 - DNA, 414 bp, Corynebacterium glutamicum
  CDS (101)..(391): RXN02957
gcatgctattgcgctccgggtgggagattctgtcgtccatgccgcggttgtggtggcgcaatgactgcgccccgggcacggaatggctccgggtcaccaaatgcaaactgcccaaggaggaagggtctacacctcactgatggacgagaagtccctttccccgttgatcggtctgccgggtcgggagaacatcggcctgggccgacactggcacggtctgtcgacgatgttgcgggtgctcaacggcatcgtctacgtcgttctgctgttcgccaccgggctgtggcaaggcattatccccacctcctgggacgtcttccccgaggcgtgggagacattgaaggtttacctgggctttcgtgccccaggcatcgagcacttcacccccctatgacgccttgcaaatgctgggct

SEQ ID NO: 1370 - protein, 97 aa, Corynebacterium glutamicum
MQTAQGGRVYTSLMDEKSLSPLIGLPGRENIGLGRHWHGLSTMLRVLNGIVYVVLLFATGLWQGIIPTSWDVFPEAWETLKVYLGFRAPGIEHFTPL

SEQ ID NO: 1371 - DNA, 441 bp, Corynebacterium glutamicum
  CDS (101)..(418): RXN02967
gggaatctagtcggccttcaccggtgatcaacaagtcagtttctggcagcgcatcctcgattccgttggagcgggcaatcagtggcgcgccggggaggatatggatctgttggtcgttgccgtgcatgagggtggacagccacgtcagtccgattgcaatgcccccggctgcgcccatacctggctttgtgccatcaacttccagttgggcgcaggcgtggtggagggcggcgtcgagaagcgaaatgtctttttcggtggcacctttttggggcccgaatacggtggccgcgccctgcgggccggtggcgggggcgtcgacatcggtgagcaggatccattcgacggcggctgcggggatgttgagttcggcggtatcgatgtaatcgaggttgatgaggtcggcgccaccggttcgtagtgcgtagccctctttgttgc

SEQ ID NO: 1372 - protein, 106 aa, Corynebacterium glutamicum
MDLLVVAVHEGGQPRQSDCNAPGCAHTWLCAINFQLGAGVVEGGVEKRNVFFGGTFLGPEYGGRALRAGGGGVDIGEQDPFDGGCGDVEFGGIDVIEVDEVGATGS

SEQ ID NO: 1373 - DNA, 435 bp, Corynebacterium glutamicum
  CDS (101)..(412): RXN02971
ttctggtccggattttcggggaatacagcgagggagaaacgtggcacgccattcaagtgggaattcaaacttaaggttatctaaatcgctaaccattgcgttgattgccatcgtcgctctcatcgtggcacttgtggtgtggctttttaaccgttcagatgattctggctccaccacgaccacctcacaagagtgcatctccggaaacttgagtctgcccgttggtggcgattccaccgcagccgaagaattagtgaacaaatttaatgactcatcacctgtcagccgtgatttctgtgttgaggcggaagctgtggacggtaacgtccccgctgccacgtacctgttcgctggttctcgttctgatgctgccaccgcacttgctgaaaccggtgccgtagcaagcagctcttaaagctcttggccctaggttgg

SEQ ID NO: 1374 - protein, 104 aa, Corynebacterium glutamicum
LIAIVALIVALVVWLFNRSDDSGSTTTTSQECISGNLSLPVGGDSTAAEELVNKFNDSSPVSRDFCVEAEAVDGNVPAATYLFAGSRSDAATALAETGAVASSS

SEQ ID NO: 1375 - DNA, 1632 bp, Corynebacterium glutamicum
  CDS (101)..(1609): RXN02978
gcctcttaaaatcagacaatttcagtgttggaatagctacaagggtctactgtaaacgaagaacgctcgatagggctgtgtacctcaacggaggtaaaacgtgattgatcgacctgtatggttgtttgaactttataacaccgcgaaagaagtagtatattcgctactcattgatcaagtaactggggaaaatacaatactcaagaaggatgatggttggcgagatcaattcatgattgagtctttctttgcttatgattcagaagctgacgcgacctcgtggagcggtaagaacatgaatagctactggttcgttagcgatctaatcagcaatatatccttcgctgagcgatccttggaaagcttttcttgggctcttcgagatcttgaggatctttcttctagtgaaactgaatttgaagggcttgaagagctgaatctaaagtttagtgagctccaagaatggtatacgaacctggaacttccttttcagccgtcggctgctgatgttgatgaggtggagcagtatctgcaagctgaagtgacaaggcaacggggtgactatcaatggtctcctgagttttggataccaaagccggattcatactatatcgaccatgcactagcggttgtcacagatgttttgggagctattgaacaaggggagctgcgtgaagaagtagaggtgcagcaggctttagacgaggtatctgaaaattggaatcctttggaagattctgattactacttacaggatcaccgtgggcgccctgtacaagatctttcccgggaaatggaggagttggtcagatgtctaatgcttgaccaagagtggtggggtgcagaggcaaggattagaaagcttgttgaatcagttgagtgggaggatactcaggcgatcagctctttaattgaacacgagcaatattgggaggatggtcgttttcgcccacctctacataagttttcggaaggactagacgagccagagcccttgccgatgacgagaaaaatgatacttgcgacgaatcaccctgatgttttacgcgtaaacattgctgattattatcagcagcataggcgcattgctactcagaaggtggaatgttataaggaagttttggcattgtatccagagattcttaagaaatttgatgattcatctttcgtcaatcgacattggatctatagggcgtttgatcgcgaaggtcagcttttgtatatcggggagacaataaaccctcttgtacggttgagggagcatgccggcttagggtctattaaccacgcacatcataggctagtatcgccgtggttttctacgatggctacatttcatcttgaatcttgctttacccaggctgaggcaaaagagaaggaggctttatatattaagctggaacagccaagatataataagacgcataattctgctagattggcggtttctgaagaaggggtgccggtgaacgaggtgccgtcaagaaatgatccgaggaatgtcggttggaagggtcataggcacgtgccaccaatgttgccgattgttgcacgtgttgtcgatgaatcgacaacacgtgagggatatgcgttttacgaggacaaccggtagcgttgcgatctctcgtggaa

SEQ ID NO: 1376 - protein, 503 aa, Corynebacterium glutamicum
VIDRPVWLFELYNTAKEVVYSLLIDQVTGENTILKKDDGWRDQFMIESFFAYDSEADATSWSGKNMNSYWFVSDLISNISFAERSLESFSWALRDLEDLSSSETEFEGLEELNLKFSELQEWYTNLELPFQPSAADVDEVEQYLQAEVTRQRGDYQWSPEFWIPKPDSYYIDHALAVVTDVLGAIEQGELREEVEVQQALDEVSENWNPLEDSDYYLQDHRGRPVQDLSREMEELVRCLMLDQEWWGAEARIRKLVESVEWEDTQAISSLIEHEQYWEDGRFRPPLHKFSEGLDEPEPLPMTRKMILATNHPDVLRVNIADYYQQHRRIATQKVECYKEVLALYPEILKKFDDSSFVNRHWIYRAFDREGQLLYIGETINPLVRLREHAGLGSINHAHHRLVSPWFSTMATFHLESCFTQAEAKEKEALYIKLEQPRYNKTHNSARLAVSEEGVPVNEVPSRNDPRNVGWKGHRHVPPMLPIVARVVDESTTREGYAFYEDNR

SEQ ID NO: 1377 - DNA, 1689 bp, Corynebacterium glutamicum
  CDS (101)..(1666): RXN02995
aaggcaaggtcggagacgagccttgttagttcagagtcctaaataggcgtttatgtcagctcgcgcaacagggatacaatgagcaaccgtgacgcagcaattgaaccacgcaaaggtaaatcaacatcccggtcaagccaccctcccagaaaccgcagaggggcaggttcgcacctacgaggtaaaaacctacggctgtcagatgaatgtgcacgattctgagcgcctttcgggcctgctcgaggaggctggatacgttgctgctccggaggacaccactccggatcttgtcgtatttaatacgtgcgccgtgcgtgaaaacgccgatatgcgcctctatggcactttgggcaacctgcgcagcgtgaaagaaaagaacccaggcatgcaaatcgctgtcggtggttgtttggctcaaaaagacaaagataccgtggtgaaaaaagcaccgtgggtggacgtggtgtttggtacccacaacattggttccttgccaaccttgcttcagcgcgcggagcacaatgcccaagcggaagtcgaaattgtcgattccctcgagcagttcccgtcagtacttcctgcaaagcgcgagtctgcttacgctggttgggtgtccgtatcagtcggatgtaacaacacctgtactttctgcatcgttccgtcgctgcgcggtaaagagcaggaccgtcgaccaggagacatcctcgcagaggtacaagcactggtggatcagggagttaccgaggtaactctacttggccaaaacgtaaatgcttacggcgtgaactttgttgatcctgagctagagcgcgatcgcagtgcattttccaagctgcttcgtgcctgtggtgagatcgaaggcctcgagcgggttcgcttcaccagccctcaccctgcagaattcacctctgatgtcattgacgccatggcagagaccccaaacatctgcccgcagctgcacatgccactgcagtccggatctgacaaggtgctcaaagagatgcgccgttcctaccgatccaagaagttcctctccatcttggatgaggtccgtgcgaagatccctcacgcctctatcaccaccgatattattgtcggattccctggcgaaacagaggaggatttccaagcaaccctcgacgttgtcaagaaggcacgctttacttctgcttacaccttccaatacagcccacgccctggcacccctgcagcggaatatgaaaaccagcttccaaaagaagttgtgcaggaacgctacgagcgcctcatggtcgttcaggaacaagtctgcgaagaagaaaaccaaaagctcatcggcaccaccgtcgaattgctggtccaggctggcggaggccgcaagaacgatgccaccaagcgcatgagtggtcgcgcacgcgatggacgcctcgtgcactttgcgccagagggcgacattgatggtgagatccgccccggcgattttgtcactgtcacggtgactgaggccaagcctttcttcctcatcgcagactccggtgtgcagacccaccgccgcaccaaagctggtgacaactctgcagttggtcaagttccaaccacagcaccgatcggtgtgggcttgggactgccacaaatcggcgcaccaaaggtggctcctgccacagaatctgcctgctgctccattaactaaaaattgcaggctagaataga

SEQ ID NO: 1378 - protein, 522 aa, Corynebacterium glutamicum
LNHAKVNQHPGQATLPETAEGQVRTYEVKTYGCQMNVHDSERLSGLLEEAGYVAAPEDTTPDLVVFNTCAVRENADMRLYGTLGNLRSVKEKNPGMQIAVGGCLAQKDKDTVVKKAPWVDVVFGTHNIGSLPTLLQRAEHNAQAEVEIVDSLEQFPSVLPAKRESAYAGWVSVSVGCNNTCTFCIVPSLRGKEQDRRPGDILAEVQALVDQGVTEVTLLGQNVNAYGVNFVDPELERDRSAFSKLLRACGEIEGLERVRFTSPHPAEFTSDVIDAMAETPNICPQLHMPLQSGSDKVLKEMRRSYRSKKFLSILDEVRAKIPHASITTDIIVGFPGETEEDFQATLDVVKKARFTSAYTFQYSPRPGTPAAEYENQLPKEVVQERYERLMVVQEQVCEEENQKLIGTTVELLVQAGGGRKNDATKRMSGRARDGRLVHFAPEGDIDGEIRPGDFVTVTVTEAKPFFLIADSGVQTHRRTKAGDNSAVGQVPTTAPIGVGLGLPQIGAPKVAPATESACCSIN

SEQ ID NO: 1379 - DNA, 752 bp, Corynebacterium glutamicum
  CDS (1)..(729): RXN02997
cccctaccgggccagccctttgagggcgaggctttaacgcttataaacgccctcctccaccacgccgaaaacgtcgcagcctccaacccctggaagcgcaccaccttccacaccgctcacatgcaccctccagggagtaatgcggattgtgactactgcctggtgctgcaacgccgcggatacgttaaagcccacgaagaaatccaacaaaccatcccgcttccttcaggtgactggtccgctggagaattcaccgtggtggacgttgaaggcaccgccttcccaagcgcgctgatccccagcatcgtggaactccaacaccgcgcagccctcgatgtgccccacggaaacttaagtgttgcgcctgcacagtgggatgaacaccgcttggcgcagcaatctgaaagaatccttaaaacaggaacgaaactgttcaccgtactgtttgccgaaggatccacagtcgctgccatgtcctccatcgcgattcccccaggctccaaccctgacatcgccgaacagggactgaccatcgtgcacccagatttcagaggccgtggtcttggaaccgctgtgaaattagcgggactgtcactactttcgaggtgccacccagaaattcaacgcgtagccacctcaaatgcagtagacaaccatgcgatgctggcgattaaccgctccataggggcaacagagatcgcccgaaccaccctgtgggagaagaaactctaggtgatggaattcgagaccaa

SEQ ID NO: 1380 - protein, 243 aa, Corynebacterium glutamicum
PLPGQPFEGEALTLINALLHHAENVAASNPWKRTTFHTAHMHPPGSNADCDYCLVLQRRGYVKAHEEIQQTIPLPSGDWSAGEFTVVDVEGTAFPSALIPSIVELQHRAALDVPHGNLSVAPAQWDEHRLAQQSERILKTGTKLFTVLFAEGSTVAAMSSIAIPPGSNPDIAEQGLTIVHPDFRGRGLGTAVKLAGLSLLSRCHPEIQRVATSNAVDNHAMLAINRSIGATEIARTTLWEKKL

SEQ ID NO: 1381 - DNA, 553 bp, Corynebacterium glutamicum
  CDS (101)..(553): RXN03001
cccggttcacgtgatcaatgacttcacgagcaccgatgaaatcgatgctgcgcttcgtgaacgctacgacatctaactactttaaaaggacgaaaatattatggactggttaaccattcctcttttcctcgttaatgaaatccttgcggttccggctttcctcatcggtatcatcaccgccgtgggattgggtgccatggggcgttccgtcggtcaggttatcggtggagcaatcaaagcaacgttgggctttttgctcattggtgcgggtgccacgttggtcactgcctccctggagccactgggtgcgatgatcatgggtgccacaggcatgcgtggtgttgtcccaacgaatgaagccatcgccggaatcgcacaggctgaatacggcgcgcaggtggcgtggctgatgattctgggcttcgccatctctttggtgttggctcgtttcaccaacctgcgttatgtcttgctcaacggacaccacgtgctgttgatgtgcaccatgctcaccatggtcttggccaccggaagagttgatgcgtggatcttc

SEQ ID NO: 1382 - protein, 151 aa, Corynebacterium glutamicum
MDWLTIPLFLVNEILAVPAFLIGIITAVGLGAMGRSVGQVIGGAIKATLGFLLIGAGATLVTASLEPLGAMIMGATGMRGVVPTNEAIAGIAQAEYGAQVAWLMILGFAISLVLARFTNLRYVLLNGHHVLLMCTMLTMVLATGRVDAWIF

SEQ ID NO: 1383 - DNA, 891 bp, Corynebacterium glutamicum
  CDS (101)..(868): RXN03005
taggtaaaccttaaacagtcgccattgaagaattttaaaaacaaacaaccttcaacgcgctaacaagcatcttcccactctcgttaccggagtttctcacatgtctcacaagttttcccgccgtgctttcgcagtactgaccgctgccgcaatttccacttccgctttcgcaaccactgctccgtctgcgattgcagagccagttctaatgtcgcactgcagacgattccagcgtcgcaacttcagaaaactccctcgactggggcttcaaggcttcctggcgcacctatgtcaccggaccttggactggtggaaccgtgacgcaactggcggtgcaactgtcaacgaagatggaacctacaacttcaccctcggaactggctccaattacgacgtcgacaccgagaagggccagctgaactacgaaggaactgttgccttcgccagtgacgctcacggcttcaacatcaccttgtccaacccgcagatcaccgtcgagggcgacactgcaactttgagcgccgagctgtctgacaatgccgctcccgaagagacctccactactcgcgttgatgttgctgagttcgaactgaccgctcctgaggtttcagaaaccgatgcggacattacctacacctggaccgatgcttccggcactttcttggagaccctgcagcctgaagaattgagccgttacgcaggccaggaagcggatgcgctgagcttctccatcaccgtggacaaggcttcagagaacccttccgatgatgttgctaccggatcttcctccagcttcctctccaccatcttgaacttccttcagcagctggcgagcccactgctcaagctcttcggttcgctttcttcctaaataatcagtaatgccccacc

SEQ ID NO: 1384 - protein, 256 aa, Corynebacterium glutamicum
MSHKFSRRAFAVLTAAAISTSAFATTAPSAIAEPVLMSHCRRFQRRNFRKLPRLGLQGFLAHLCHRTLDWWNRDATGGATVNEDGTYNFTLGTGSNYDVDTEKGQLNYEGTVAFASDAHGFNITLSNPQITVEGDTATLSAELSDNAAPEETSTTRVDVAEFELTAPEVSETDADITYTWTDASGTFLETLQPEELSRYAGQEADALSFSITVDKASENPSDDVATGSSSSFLSTILNFLQQLASPLLKLFGSLSS

SEQ ID NO: 1385 - DNA, 448 bp, Corynebacterium glutamicum
  CDS (101)..(448): RXN03009
atgtgaacctgatgctggcacctgaagatagccacagcccaggcaccgcaacagtgacctaccgtcatggtttcagcgatcaccgtttaccctgcactgcgtggctaatatcgccagcttgtacggactgtgggaaggcagcacatccacaccaatcgaacagctcgtacctgcgaaaggttccagctttcgtttggtgaggtctttttacaggcgaattgacggccaagcagttcaggctcgtctcaaggagaagattctcaacaccgcggaaaacccgcttcctcgcttggacattccaggtaaggagcgcactgcgcagtacccagaaaatccggataccttcgcccaaaaagcagctcaagaaattcttgatgagttcagaactccactgatcggtgaagaagctgcagctcatgttgagaaaacgaagacgattttctggaag

SEQ ID NO: 1386 - protein, 116 aa, Corynebacterium glutamicum
VANIASLYGLWEGSTSTPIEQLVPAKGSSFRLVRSFYRRIDGQAVQARLKEKILNTAENPLPRLDIPGKERTAQYPENPDTFAQKAAQEILDEFRTPLIGEEAAAHVEKTKTIFWK

SEQ ID NO: 1387 - DNA, 360 bp, Corynebacterium glutamicum
  CDS (101)..(337): RXN03010
tgggcgccttcaatcggcacccactgaatggattcttccgggcctagttttagggctgatcagcctgggactcaatgcgtggattaccttcggtgcgccagtgcccaccgataatctttttctcatcgttgctggaattgcgtgggtgttggcaggaattttgagcgtgctgtccatcggcaagtacatgtcagcagtaaatgagcgaaagtcgacaggcttttatacagaagtgccgtggaagaaagcgctctttactgcgacagccgtcctattggtgtttgctgttgtgtggtcggccttggatattgccctgtgggtaggaaagcagtcatggtgaacacgttgaactctaaaacc

SEQ ID NO: 1388 - protein, 79 aa, Corynebacterium glutamicum
VPTDNLFLIVAGIAWVLAGILSVLSIGKYMSAVNERKSTGFYTEVPWKKALFTATAVLLVFAVVWSALDIALWVGKQSW

SEQ ID NO: 1389 - DNA, 324 bp, Corynebacterium glutamicum
  CDS (101)..(301): RXN03011
ccgacgtaccagtttttgtcgttccacccctggactaaaaccgagacgagaaccaagaagatgaaaccaaggggtaaaaactggtagtctcttccacgtcatggcatacgaaactgattccctcaaccgacgcaccctcgggcccgcgattgcaagcgcagtcgtgggaatcgccgtcggcgcagtcgcagtagttggggtttcaatgatctcagggcaggacactgttcccactggtaacgccgtaactgcagacgatgccctgctcggtggccctgagtatggttcacgcgaagcagactaagaagccacttccccgttttc

SEQ ID NO: 1390 - protein, 67 aa, Corynebacterium glutamicum
MAYETDSLNRRTLGPAIASAVVGIAVGAVAVVGVSMISGQDTVPTGNAVTADDALLGGPEYGSREAD

SEQ ID NO: 1391 - DNA, 593 bp, Corynebacterium glutamicum
  CDS (1)..(570): RXN03012
accactatcaacatcatcatcaccaatggcgctgcaccacacccaactaatctcaatcgcgcagaaattcatgatcacctacccctcactgcctctgattcggagctaacccgcccctcccaggaatcagttctctatgaccatgaatccgaaactgtcttgcgcaccatggtcatccctgcagacctgcacgtcgctatgaagcatctagctaaaaaacacaacctcacggtcacagagatctcgcgcatccttctgcagcgctacatcgaccgcaatattaaccatgtagagcaaaaccaggctgaatccgacatggtggaagtctttgccagccaaccaaccaatgcaaccgcaatgatccctgtacctggaaccagcttcaggcaaatatttatcaagcacagcactggtttctggaaaaacattgatcatgatcttgtcgatctcgacgcctctaagaccccgcgtgtacgcgaccgcagtgtcttaccacaacctcaactccacagagcgttgttatcagatgctgatatggctcgccttgcagcacaactgaccgacaaacactaaaacctccacaacaaggacat

SEQ ID NO: 1392 - protein, 190 aa, Corynebacterium glutamicum
TTINIIITNGAAPHPTNLNRAEIHDHLPLTASDSELTRPSQESVLYDHESETVLRTMVIPADLHVAMKHLAKKHNLTVTEISRILLQRYIDRNINHVEQNQAESDMVEVFASQPTNATAMIPVPGTSFRQIFIKHSTGFWKNIDHDLVDLDASKTPRVRDRSVLPQPQLHRALLSDADMARLAAQLTDKH

SEQ ID NO: 1393 - DNA, 1662 bp, Corynebacterium glutamicum
  CDS (101)..(1639): RXN03017
aactcaatattaaagtcgcgtaattagtgttatattaattacgcgactttaatagttttcgaatacgtagattctcgaaatacagcagaaagcaggggttatgctcgattcattgaaaaatcgcttcaccaaagcgaaaggttctcatggagtgggggagggggctgtttctggcgatgcagcagtaaagccactgcgcaaagaagaacgactcgcctcagtcattcaggaaaccgaaccaggtgctgcagtcgaggtcatgcgtcgcaatgacgcattcgctttgccaggtgagaccggttgggtagtcatgctgttgccaactcacgattcacaattcggtgggctcaacgctaaggaaaagaaccgcgaggataaaggcacgatcatcaacctggtggtcaacgatgatattcattccgttgtcactccagaacttcttgacagcgatgtgcttggtgtcattcctgatgcagattctttcgatcgcatggatgagtttgatttactgcgtaacaaagcacgctggcactacggagtggctgcaattgaacctgacacgggtgagctggtggtgtttaaggtgcccgcgaaaaatagcgcttcggcacgcggtgacattttttccgaggtcggcgatgtgcttagcggtgctgctgacctcgaagacgtggttgattttgaggtcattgccaccttcctagaggtgctgaatgagacctctgaggtggatattgatgacgaagatggcgacgtgccttatggtcttgagggtgtcaatgcagcgggagttatcacggatgacctcattcgcgagaagcttgatgtggattcctatccgagcagtgcagagatcattgacaatattgtgcatgtgttcaccaagttgcagggcaagcatcatgtggcaccacagccggtgcttcacagcgcagacgtagtggatgttgatgcacaggagtcccatgacacagtggttattgagagccctgatgatgtcgcactagcagaacaggtggatgtaccggatttcagtgatggatttggtattgacgatgccgaggttactgagccagaggatgaggaggttgtcgaagcaacagctgatgcagatccttttggtgatgtagcagaagacgatcctttcggcagtgatgatgaaccagattttggtgcatccgatgttgttgctgcaccggcacctgtagccggcatgtccgatgagcagatccaggcgctgattcgtggtgtgtctgagtccgtgcaagcaaagactggttcagaacttaatgctttgcgagaagaacttgcacaagcactggcttacaatccggttcaggattcacaggcagcattggcacaggtgcacgcagctgatgcccgcagctttgatgccgatcaagtgggtgatgctgtcaccaaacgttatgttaatgacgacttggggctgtatgtcgatgaggcaaacttcaataatgctttgaccagggcaccgttccaggtggcgatgccgcaattccaggagactacaccgtggttaggtgatcagcttcgtacattggtggctgtgtttaatggtcagctgcttgatcagcatcagcgtgactaccgaagaagtgcgcgcgatgtacattgcgcttaatgatcgctctaatcttgaga

SEQ ID NO: 1394 - protein, 513 aa, Corynebacterium glutamicum
MLDSLKNRFTKAKGSHGVGEGAVSGDAAVKPLRKEERLASVIQETEPGAAVEVMRRNDAFALPGETGWVVMLLPTHDSQFGGLNAKEKNREDKGTIINLVVNDDIHSVVTPELLDSDVLGVIPDADSFDRMDEFDLLRNKARWHYGVAAIEPDTGELVVFKVPAKNSASARGDIFSEVGDVLSGAADLEDVVDFEVIATFLEVLNETSEVDIDDEDGDVPYGLEGVNAAGVITDDLIREKLDVDSYPSSAEIIDNIVHVFTKLQGKHHVAPQPVLHSADVVDVDAQESHDTVVIESPDDVALAEQVDVPDFSDGFGIDDAEVTEPEDEEVVEATADADPFGDVAEDDPFGSDDEPDFGASDVVAAPAPVAGMSDEQIQALIRGVSESVQAKTGSELNALREELAQALAYNPVQDSQAALAQVHAADARSFDADQVGDAVTKRYVNDDLGLYVDEANFNNALTRAPFQVAMPQFQETTPWLGDQLRTLVAVFNGQLLDQHQRDYRRSARDVHCA

SEQ ID NO: 1395 - DNA, 2616 bp, Corynebacterium glutamicum
  CDS (101)..(2593): FRXA02753
aactcaatattaaagtcgcgtaattagtgttatattaattacgcgactttaatagttttcgaatacgtagattctcgaaatacagcagaaagcaggggttatgctcgattcattgaaaaatcgcttcaccaaagcgaaaggttctcatggagtgggggagggggctgtttctggcgatgcagcagtaaagccactgcgcaaagaagaacgactcgcctcagtcattcaggaaaccgaaccaggtgctgcagtcgaggtcatgcgtcgcaatgacgcattcgctttgccaggtgagaccggttgggtagtcatgctgttgccaactcacgattcacaattcggtgggctcaacgctaaggaaaagaaccgcgaggataaaggcacgatcatcaacctggtggtcaacgatgatattcattccgttgtcactccagaacttcttgacagcgatgtgcttggtgtcattcctgatgcagattctttcgatcgcatggatgagtttgatttactgcgtaacaaagcacgctggcactacggagtggctgcaattgaacctgacacgggtgagctggtggtgtttaaggtgcccgcgaaaaatagcgcttcggcacgcggtgacattttttccgaggtcggcgatgtgcttagcggtgctgctgacctcgaagacgtggttgattttgaggtcattgccaccttcctagaggtgctgaatgagacctctgaggtggatattgatgacgaagatggcgacgtgccttatggtcttgagggtgtcaatgcagcgggagttatcacggatgacctcattcgcgagaagcttgatgtggattcctatccgagcagtgcagagatcattgacaatattgtgcatgtgttcaccaagttgcagggcaagcatcatgtggcaccacagccggtgcttcacagcgcagacgtagtggatgttgatgcacaggagtcccatgacacagtggttattgagagccctgatgatgtcgcactagcagaacaggtggatgtaccggatttcagtgatggatttggtattgacgatgccgaggttactgagccagaggatgaggaggttgtcgaagcaacagctgatgcagatccttttggtgatgtagcagaagacgatcctttcggcagtgatgatgaaccagattttggtgcatccgatgttgttgctgcaccggcacctgtagccggcatgtccgatgagcagatccaggcgctgattcgtggtgtgtctgagtccgtgcaagcaaagactggttcagaacttaatgctttgcgagaagaacttgcacaagcactggcttacaatccggttcaggattcacaggcagcattggcacaggtgcacgcagctgatgcccgcagctttgatgccgatcaagtgggtgatgctgtcaccaaacgttatgttaatgacgacttggggctgtatgtcgatgaggcaaacttcaataatgctttgaccagggcaccgttccaggtggcgatgccgcaattccaggagactacaccgtggttaggtgatcagcttcgtacattggtggctgtgtttaatggtcagctgcttgatcagcatcagcgtgactacgaagaagtgcgcgcgatgtacattgcgcttaatgatcgctctaatcttgagatcgctcgtgatcttggactggataataaggattccgaattctacgaggtttaccgtgccattgagcgtgaccgcgatgttatggctggtgatcaacagcgtgtggagtcagagcgtcgtcagcaattgcagcaggagtatgaggcgaaccgtgaagaatatgtcatggcaaagatcgcggagcagcgcgtggagtatgatcgccgtcatatgcctcgccataccgcatcactagaagcggtaggtcgagagctgacgagcctgcgggatcgcaccattgaggattacaccgcacgcatgaacacgctgcgtcgtgcacgtgctggtgaacgggctaacgctgcagaatctcgcattattgacgaattgcgcccgattgtggagcgccaggcagaactgcaacgagcagctttcgatggtttcattgttgatcttgacaagtttattgctgatcaccgcgaagatgacctgcgtttggcatcggtgaatgagcagaagcttgctgcagataatcgtgtggcacagttgaccaaggaagccgaagagcgcatcgagggtatccgcgtcgagaccgataagatgatcgcctcccagcgcaaggcacttgagcgtcaggaagcggaattcgcagcagagcttaagcgtcgcgacactattgtcgctgcatcggaggaacgtgctgagcgggaaattaccacagcacgtcttgatgctgaggcggcgctcaagcgcatggaagagcaaattcgtgtaaataatgaggcgcatgaggcggagattgttattgagcgcgatcgagccacccaagcagaggcgaactccatgacgtttgttgagtcagtcaagcagcaggatcgcagcaacaacatcattttgattgccgtcctcattgtggggctgattgccggcatggtcgctggcgcagccttcttctaaaagatcgttgcgcgggctgt

SEQ ID NO: 1396 - protein, 831 aa, Corynebacterium glutamicum
MLDSLKNRFTKAKGSHGVGEGAVSGDAAVKPLRKEERLASVIQETEPGAAVEVMRRNDAFALPGETGWVVMLLPTHDSQFGGLNAKEKNREDKGTIINLVVNDDIHSVVTPELLDSDVLGVIPDADSFDRMDEFDLLRNKARWHYGVAAIEPDTGELVVFKVPAKNSASARGDIFSEVGDVLSGAADLEDVVDFEVIATFLEVLNETSEVDIDDEDGDVPYGLEGVNAAGVITDDLIREKLDVDSYPSSAEIIDNIVHVFTKLQGKHHVAPQPVLHSADVVDVDAQESHDTVVIESPDDVALAEQVDVPDFSDGFGIDDAEVTEPEDEEVVEATADADPFGDVAEDDPFGSDDEPDFGASDVVAAPAPVAGMSDEQIQALIRGVSESVQAKTGSELNALREELAQALAYNPVQDSQAALAQVHAADARSFDADQVGDAVTKRYVNDDLGLYVDEANFNNALTRAPFQVAMPQFQETTPWLGDQLRTLVAVFNGQLLDQHQRDYEEVRAMYIALNDRSNLEIARDLGLDNKDSEFYEVYRAIERDRDVMAGDQQRVESERRQQLQQEYEANREEYVMAKIAEQRVEYDRRHMPRHTASLEAVGRELTSLRDRTIEDYTARMNTLRRARAGERANAAESRIIDELRPIVERQAELQRAAFDGFIVDLDKFIADHREDDLRLASVNEQKLAADNRVAQLTKEAEERIEGIRVETDKMIASQRKALERQEAEFAAELKRRDTIVAASEERAEREITTARLDAEAALKRMEEQIRVNNEAHEAEIVIERDRATQAEANSMTFVESVKQQDRSNNIILIAVLIVGLIAGMVAGAAFF

SEQ ID NO: 1397 - DNA, 1116 bp, Corynebacterium glutamicum
  CDS (101)..(1093): RXN03018
gtggcgatgccgcaattccaggagactacaccgtggttaggtgatcagcttcgtacattggtggctgtgtttaatggtcagctgcttgatcagcatcagcgtgactaccgaagaagtgcgcgcgatgtacattgcgcttaatgatcgctctaatcttgagatcgctcgtgatcttggactggataataaggattccgaattctacgaggtttaccgtgccattgagcgtgaccgcgatgttatggctggtgatcaacagcgtgtggagtcagagcgtcgtcagcaattgcagcaggagtatgaggcgaaccgtgaagaatatgtcatggcaaagatcgcggagcagcgcgtggagtatgatcgccgtcatatgcctcgccataccgcatcactagaagcggtaggtcgagagctgacgagcctgcgggatcgcaccattgaggattacaccgcacgcatgaacacgctgcgtcgtgcacgtgctggtgaacgggctaacgctgcagaatctcgcattattgacgaattgcgcccgattgtggagcgccaggcagaactgcaacgagcagctttcgatggtttcattgttgatcttgacaagtttattgctgatcaccgcgaagatgacctgcgtttggcatcggtgaatgagcagaagcttgctgcagataatcgtgtggcacagttgaccaaggaagccgaagagcgcatcgagggtatccgcgtcgagaccgataagatgatcgcctcccagcgcaaggcacttgagcgtcaggaagcggaattcgcagcagagcttaagcgtcgcgacactattgtcgctgcatcggaggaacgtgctgagcgggaaattaccacagcacgtcttgatgctgaggcggcgctcaagcgcatggaagagcaaattcgtgtaaataatgaggcgcatgaggcggagattgttattgagcgcgatcgagccacccaagcagaggcgaactccatgacgtttgttgagtcagtcaagcagcaggatcgcagcaacaacatcattttgattgccgtcctcattgtggggctgattgccggcatggtcgctggcgcagccttcttctaaaagatcgttgcgcgggctgt

SEQ ID NO: 1398 - protein, 331 aa, Corynebacterium glutamicum
VTTEEVRAMYIALNDRSNLEIARDLGLDNKDSEFYEVYRAIERDRDVMAGDQQRVESERRQQLQQEYEANREEYVMAKIAEQRVEYDRRHMPRHTASLEAVGRELTSLRDRTIEDYTARMNTLRRARAGERANAAESRIIDELRPIVERQAELQRAAFDGFIVDLDKFIADHREDDLRLASVNEQKLAADNRVAQLTKEAEERIEGIRVETDKMIASQRKALERQEAEFAAELKRRDTIVAASEERAEREITTARLDAEAALKRMEEQIRVNNEAHEAEIVIERDRATQAEANSMTFVESVKQQDRSNNIILIAVLIVGLIAGMVAGAAFF

SEQ ID NO: 1399 - DNA, 1539 bp, Corynebacterium glutamicum
  CDS (101)..(1516): RXN03024
ctctacccacttaaaatggacgcatattcgcaagataaggcatgcttggatgaatagattttaactcaacgtttactaaacagaatcggaattaggagccatgcttgaacgcacacaggtattcgtggatacgtcctacctgctcgcaagcttttacaactcttgggagacaggggcacgtgcccaattagaaatcgacctccccgaagtagtcggggtattaggaaggatgattgaacaacaacttaaacagccagtacaacgccaaatgtggtacgacggaatccccgattccggcccccaccgctatcaacgagcactacgcacctgcgatggtgtgcaacttcgtgctggccaattaattgaatggggcgaacgccgcacacaaaaggcagtagatacccgccttgttgcagacctcgttctcgcaggtgttcgcggacaatgctccgatatcgtgctcgtcagtggcgacgccgacatgatccccggtgttcaagaagctgccaatgcaggccttcgcgttcacctctacggcttcggctgggattccatgtcctcccaactgcgccactgctgtgacaccaccaccattttggatcctcgagaagattttgctgaatgcatgcagctgcaggttctcgaaggtccactaccccctgtcgttcgggtaaagcccatcaacgatgcagaacccatcgaggatttggatttcactccagttccaggcgtcgcctcaccatttgaagaggtcagcgcgaaagatgagaaattctctccacgcccaagtgaacctgccgaagctttgtcggaacaggtctgtgaagcgcagtatgagatctccaaacacgaaggtcaaaccgctgattcaggagaaatcaccgagtctttcgaggccgctgaaatcaaggtaactgagttttttggagaaccagctgctccagtagcggaatcaggcgtagaagctcccactccggaagctcccacggttcctgaagcagctaagcccactccggcgaaacctaagactccaaaggcagagccccaaaagcaagaatcccccaagccgggaactccaaaaccaaaagctccaagccctgcggatattccaccgaaagccccagctgacactgaggaacattcggaagtcgaagctgaaatcgaggactcacgtccaaagatccccagcccttcgatgatggctccccgccgcaagcttcgttcccgctacgttccgcttcccaacgaagtgtgggcaacagcaggattccaaactccttacgatgtcgggcaacagtacgcatcgtggtggtttgaaaacgcagctaccagcactcaaagagatcaggctcatctattgtctggtggcggacttccaccagagatcgatcgcccgcttctgcagtttgcttgtgaaactctccacgaatacaccctgactgaagcgcagcgcgtagctttacgcgatggctttcactccggaatccgtggtgtattgctcaaccagcgagatagctagaatcacaaaaaactggggct

SEQ ID NO: 1400 - protein, 472 aa, Corynebacterium glutamicum
MLERTQVFVDTSYLLASFYNSWETGARAQLEIDLPEVVGVLGRMIEQQLKQPVQRQMWYDGIPDSGPHRYQRALRTCDGVQLRAGQLIEWGERRTQKAVDTRLVADLVLAGVRGQCSDIVLVSGDADMIPGVQEAANAGLRVHLYGFGWDSMSSQLRHCCDTTTILDPREDFAECMQLQVLEGPLPPVVRVKPINDAEPIEDLDFTPVPGVASPFEEVSAKDEKFSPRPSEPAEALSEQVCEAQYEISKHEGQTADSGEITESFEAAEIKVTEFFGEPAAPVAESGVEAPTPEAPTVPEAAKPTPAKPKTPKAEPQKQESPKPGTPKPKAPSPADIPPKAPADTEEHSEVEAEIEDSRPKIPSPSMMAPRRKLRSRYVPLPNEVWATAGFQTPYDVGQQYASWWFENAATSTQRDQAHLLSGGGLPPEIDRPLLQFACETLHEYTLTEAQRVALRDGFHSGIRGVLLNQRDS

SEQ ID NO: 1401 - DNA, 996 bp, Corynebacterium glutamicum
  CDS (101)..(973): RXN03025
agcgaatcggattcagtgatttgcttgcgggcgcagaaatgatttttcaattagacacacttagacacacgtaactaaaacctcagggaagtgactgataatggctaatccgctcagcaagggctggaagtatctcatggcatcgttcgacaacaagatcgatgagaatgcagatccaaagatccaaattcagcaagctacagaagctgcccagaagcagcaccagcagattatgcagcacgcttctcagattatcggtcagcagaagcagcttgagatgaaattgaaccgcttggttactgaccgcgataagttgcaggaacaggctcgtcaggcaattcagttggcagataagtccgcaaacgaaggcgacagtgttaaggctcaggagttcaacaacactgctgaggtttttgcttcccagttggtagctgtggaacagcagttggagcagactactgcgcttcatcagcaggctgaggttgcggcgaaggatgctgttgcgaagtctaaagagtctgagatgcgcctgaaagagcagatgtctcagattgatgctctacgtgcgcaggctgatcaggcgaagatgcaggaaagtgtcactaagtctatggattctttgaatcagtttggcactcaggattcttctgttcctacccttgatgcggtgcgtgagaagatcgagcgtcgatacgcagatgctttgggcgcgcaggaacttacccagaacactgttagtgatcgcatggctgagattgcgcagtccggcaccgatatgcgggcgtcagctcgtttggctgaacttcgcgcggaggcgctgggcacgtccgcaacgcctaagggccagctagaggcaggtgtcgaggatgcggaagaacttatcgacgaaacctccaccccttcagctaccccagaaaccgcaagcccagaagctgatgctccagaagcatccgcagacgagtccgagaagaaataacctaaacacaaaaaactggg

SEQ ID NO: 1402 - protein, 291 aa, Corynebacterium glutamicum
MANPLSKGWKYLMASFDNKIDENADPKIQIQQATEAAQKQHQQIMQHASQIIGQQKQLEMKLNRLVTDRDKLQEQARQAIQLADKSANEGDSVKAQEFNNTAEVFASQLVAVEQQLEQTTALHQQAEVAAKDAVAKSKESEMRLKEQMSQIDALRAQADQAKMQESVTKSMDSLNQFGTQDSSVPTLDAVREKIERRYADALGAQELTQNTVSDRMAEIAQSGTDMRASARLAELRAEALGTSATPKGQLEAGVEDAEELIDETSTPSATPETASPEADAPEASADESEKK

SEQ ID NO: 1403 - DNA, 174 bp, Corynebacterium glutamicum
  CDS (17)..(151): RXN03027
aataggagaatttaaaatggaaaacgtttacgagttccttggaaaccttgatgtcctttccggctccggcctcatcggctacgtcttcgacttcctcggcgcttccagcaagtgggctggcgcagttgctgacctcatcggtctgcttggctaattaacttcgcccacgggcaa

SEQ ID NO: 1404 - protein, 45 aa, Corynebacterium glutamicum
MENVYEFLGNLDVLSGSGLIGYVFDFLGASSKWAGAVADLIGLLG

SEQ ID NO: 1405 - DNA, 630 bp, Corynebacterium glutamicum
  CDS (95)..(607): RXN03029
ggtgtggcttcctattcgctgcatcctgaatatgccatcaaaatcttcactctgaggccgaaaaatccggttatgacattaagtacctaggacaatgtttggagtgggctattatacaaccgcccaccgattgtccaccctgcagcgccccaacttgcgcggcatccccttaaccttcgtgagcgtcgaccgagccggcaacatgtccaaacgccaatccgccacgggcttccacttcacccattacggcggcacctgccccctgtggaacgtgtttgaaaccttcaccaaccccggccaagtgctccgccaattcgcgcaaatgcccgacggacgcaactacctgtggatctcacgcaccgtgcgacaccacgaagcccggttcggcgaagtagacaaaatgttcgccatcggcttgggctgcgaagcgcgccacgccgaccgcactgtgtactcccgcggtttcaacctccaggacctctccaccgccacccccatcgggtccggctgccgagtgtgcacccgcgagaactgcgcgcagcgcgcattcccatccgtccacggccgcatcaacatcgacgcgcacgaatccactatcgcgccgtactaagaaaaggagcttgctttacg

SEQ ID NO: 1406 - protein, 171 aa, Corynebacterium glutamicum
MFGVGYYTTAHRLSTLQRPNLRGIPLTFVSVDRAGNMSKRQSATGFHFTHYGGTCPLWNVFETFTNPGQVLRQFAQMPDGRNYLWISRTVRHHEARFGEVDKMFAIGLGCEARHADRTVYSRGFNLQDLSTATPIGSGCRVCTRENCAQRAFPSVHGRINIDAHESTIAPY

SEQ ID NO: 1407 - DNA, 789 bp, Corynebacterium glutamicum
  CDS (1)..(789): RXN03031
aacaacggccttaacgccatggccgcgatgaccaacctcccacacctgcgcgccatccaagaacgctactacttcctgagcatccgctacctcgcctccatcatgatcgccgtggccaaagcagaccccaccctgtgggaagaactcgacctgcgcatcaccgacgccttaacaccagtcaccgcaggggaagtgatgatccaatcctccaccctgtccaaacgcatcgccgcctggatcaaagaactcgaccccgaacccacaccagagcccataccgaaagaggactatgttcacgtccacaccactgatgaggcgacctatgtccgcatcaaaatcagcggccccaaccgcctgatcctcaatgacatcatcacccaactcaaagacacagacaccgaggacagcctgcctgaagcgctcatggcgttcctgatggagaaaatccagttaaagatcaccaagtaccttttcaccccacataagcaccctgagcaggtgtggtcaccggactacggtgacattggtcccgaagcctatgccaatgccaccctcgtgtgcgccaaggacttagatgaggtcgctggagccacggagaagagctacaccccgagtgagaagatgaaagccctgatcagagctcgggatgggcattgccgcttcccagggtgttgcgtcccggcgagtaaatgccaggtcgatcacattatcccgtgggcggagggcggcccgacagcggcgtggaacctgcagttgttgtgccagcggcatcacaatatgaaaaccgat

SEQ ID NO: 1408 - protein, 263 aa, Corynebacterium glutamicum
NNGLNAMAAMTNLPHLRAIQERYYFLSIRYLASIMIAVAKADPTLWEELDLRITDALTPVTAGEVMIQSSTLSKRIAAWIKELDPEPTPEPIPKEDYVHVHTTDEATYVRIKISGPNRLILNDIITQLKDTDTEDSLPEALMAFLMEKIQLKITKYLFTPHKHPEQVWSPDYGDIGPEAYANATLVCAKDLDEVAGATEKSYTPSEKMKALIRARDGHCRFPGCCVPASKCQVDHIIPWAEGGPTAAWNLQLLCQRHHNMKTD

SEQ ID NO: 1409 - DNA, 408 bp, Corynebacterium glutamicum
  CDS (101)..(385): RXN03032
cctggtcataggatacttagctcaaccacacggtcagggccagcaattcctcacgttttaccaactccgtaagcacaccatcatggcctggtgcgccgctatgaccgacggggacttagacgctgatatctcaccccgccagatcgggttgatgaccacccgaaccgtggtcgaaatcgttcgactacgccacatgattgcccaacaactagaaagagccacgatcatggaaaacgagtacctcaaagaaatcgcagcgctgaagaaagaactcgcgcactacaagcaaaaagaccatcagaatcaaatggtgatcgatatcttgggaaaagctattgggaccaggcccaatcctggcgagggcttagacgaggaggacgccacctaaacgtggatgagcaacgcgcc

SEQ ID NO: 1410 - protein, 95 aa, Corynebacterium glutamicum
MTDGDLDADISPRQIGLMTTRTVVEIVRLRHMIAQQLERATIMENEYLKEIAALKKELAHYKQKDHQNQMVIDILGKAIGTRPNPGEGLDEEDAT

SEQ ID NO: 1411 - DNA, 683 bp, Corynebacterium glutamicum
  CDS (1)..(660): RXN03034
ttcccaccagatcgaatctccgccaacgggcgacgctattacgagccacaaacacgactcgagttcatgcggatctacaccaccctgccgcacggctaccgccagcccttccttaaagccaacaacatcggccactgcaccgttcgaacctggctagcagcaataagcaccttcagccgacttccccatgcttttgatgatgcccaccgcttcgggatcgaacgcaccaccccagtcgacgatgtcaccacactaacggctgatgacaaacgtgacctggtcataggatacttagctcaaccacacggtcagggccagcaattcctcacgttttaccaactccgtaagcacaccatcatggcctggtgcgccgctatgaccgacggggacttagacgctgatatctcaccccgccagatcgggttgatgaccacccgaaccgtggtcgaaatcgttcgactacgccacatgattgcccaacaactagaaagagccacgatcatggaaaacgagtacctcaaagaaatcgcagcgctgaagaaagaactcgcgcactacaagcaaaaagaccatcagaatcaaatggtgatcgatatcttgggaaaagctattgggaccaggcccaatcctggcgagggcttagacgaggaggacgccacctaaacgtggatgagcaacgcgcc

SEQ ID NO: 1412 - protein, 220 aa, Corynebacterium glutamicum
FPPDRISANGRRYYEPQTRLEFMRIYTTLPHGYRQPFLKANNIGHCTVRTWLAAISTFSRLPHAFDDAHRFGIERTTPVDDVTTLTADDKRDLVIGYLAQPHGQGQQFLTFYQLRKHTIMAWCAAMTDGDLDADISPRQIGLMTTRTVVEIVRLRHMIAQQLERATIMENEYLKEIAALKKELAHYKQKDHQNQMVIDILGKAIGTRPNPGEGLDEEDAT

SEQ ID NO: 1413 - DNA, 408 bp, Corynebacterium glutamicum; identical to SEQ ID NO: 1409
  CDS (101)..(385): FRXA00063

SEQ ID NO: 1414 - protein, 95 aa, Corynebacterium glutamicum; identical to SEQ ID NO: 1410

SEQ ID NO: 1415 - DNA, 309 bp, Corynebacterium glutamicum
  CDS (101)..(286): RXN03037
cgctaaaagacaaatgacagcgaagctgcattcggatacacacctgaagaacactcttcaccactagcattccaccaacgcctcggaaagggctatctccatgtctgttgacgatctttacgctgttgctctcgatactcacaccggtaagcctatcccctgcgtactctgtgaaaatgctccacagattgttatctacgatggttgctgctcgcttgcatatacccaagcacttggcgatctcgccgaagcggaatactacggcgccgatcttgctgcagctgcctaaacaaacttcatagaacgaca

SEQ ID NO: 1416 - protein, 62 aa, Corynebacterium glutamicum
MSVDDLYAVALDTHTGKPIPCVLCENAPQIVIYDGCCSLAYTQALGDLAEAEYYGADLAAAA

SEQ ID NO: 1417 - DNA, 621 bp, Corynebacterium glutamicum
  CDS (101)..(598): RXN03041
  misc_feature (473): n = a, t, c, or g
  VARIANT (125): Xaa = Cys, Arg, Ser, or Gly
accgaggaactgaaggaaaatgtaggtgtcggggcttagagaaacaaaaaaggctgctacgcggacagcattgtcacgtgctgctgcggagatcgccttgatggaaggccctgaggcgttcacggttgcggccattgcagctgcagccggggtctcccccaggacttttcataactacttcccttctcgggaagacgcattggtgcaatttgtggtcattcgcgttcaggaactcacggatcagctatacgagtttcctacaagcgtgcccccacgagatgccattgaacaattggtgataaaccaattgcgggatggcgatgacgctatggattctttcagcgcaatgtttcgaatcggtgagatccttgaaaatcttgaccccatcaagtgtgttatcgataaggagcgactcattgctccgttgcttgagttcatggttgaacgtgacaaagaccttgacaagttcgatngcggcaactctgatccatttgcatgcagcggcaattgcaacctcgctgcatacgttttaccaagcttccgagccccgggacatagaagatggagtcgcattgatccgtcgggcatgcgcctggattaagaaantaaaaatctstgaca

SEQ ID NO: 1418 - protein, 166 aa, Corynebacterium glutamicum
  VARIANT (125): Xaa = Cys, Arg, Ser, or Gly
MEGPEAFTVAAIAAAAGVSPRTFHNYFPSREDALVQFVVIRVQELTDQLYEFPTSVPPRDAIEQLVINQLRDGDDAMDSFSAMFRIGEILENLDPIKCVIDKERLIAPLLEFMVERDKDLDKFDXGNSDPFACSGNCNLAAYVLPSFRAPGHRRWSRIDPSGMRLD

SEQ ID NO: 1419 - DNA, 627 bp, Corynebacterium glutamicum
  CDS (101)..(604): FRXA02892
accgaggaactgaaggaaaatgtaggtgtcggggcttagagaaacaaaaaaggctgctacgcggacagcattgtcacgtgctgctgcggagatcgccttgatggaaggccctgaggcgttcacggttgcggccattgcagctgcagccggggtctcccccaggacttttcataactacttcccttctcgggaagacgcattggtgcaatttgtggtcattcgcgttcaggaactcacggatcagctatacgagtttcctacaagcgtgcccccacgagatgccattgaacaattggtgataaaccaattgcgggatggcgatgacgctatggattctttcagcgcaatgtttcgaatcggtgagatccttgaaaatcttgaccccatcaagtgtgttatcgataaggagcgactcattgctccgttgcttgagttcatggttgaacgtgacaaagaccttgacaagttcgatgcggcaactctgatccatttgcatgcagcggcaattgcaacctcgctgcatacgttttaccaagcttccgagccccgggacatagaagatggagtcgcattgatccgtcgggcatgcgcctggattaagaaataaaaattgtggcgtgtgaacct

SEQ ID NO: 1420 - protein, 168 aa, Corynebacterium glutamicum
MEGPEAFTVAAIAAAAGVSPRTFHNYFPSREDALVQFVVIRVQELTDQLYEFPTSVPPRDAIEQLVINQLRDGDDAMDSFSAMFRIGEILENLDPIKCVIDKERLIAPLLEFMVERDKDLDKFDAATLIHLHAAAIATSLHTFYQASEPRDIEDGVALIRRACAWIKK

SEQ ID NO: 1421 - DNA, 1096 bp, Corynebacterium glutamicum
  CDS (101)..(1096): RXN03045
agcttttctatttcgaaaaatagccttgtattcgaaaatttgatcgggtatggtggttggtattagcacagggaactaaacgggaaagggggaagacaccatgagcatcaccacacacgtccaagcactcaccacagcactcaacgccatcgacaaccatttggccagcatgcttgaccatggtgtcaccccagaccaatacaaggccatcgagcccgacctcatcgccctagaacacaccatcaaccaccacgccaccatcgccgcccaaaccaccgccctcgccgaacgcaccaatgctgcgcagtcgattggctccacccacctcatcgactacctcaccaccaccttcggcctatctaaagcacgcgcccaccaccgcatcaatctcgcccactccctctaccccataccgaagccaaactctggatctggcaacggcggtaatggtggcaatcccgacggtggtcctgatggtggcgactcgggtgatgacgactccggcgatgatgaccccgaccccgaaccggacaagcctgaagacggcaaacctgatagtgataagccccgtaggccacggatcagcgcggaaaaacacgccatcatcaccgacgaactcgcccgcctcaacccgaataccacacccagcgccgaggaactgcgcaaccaagccctgagtcaggcgatctggcgcaccccagaagacctccgcacgtggctacgccaccaggtcaccaccgcgaacaaaaacaaccccaaccccatcaccgccatgaaaaggcgctacctctcagtaggtaaacccgatgccgacaacatggtccgcatcagcggcctcgtgcccgcagccaccgcagcactgatcaccgcgaacaccgcaccgttaaccaaacgcggcaacctcgtggatctaccagcagcagaagatatgcgcacccgcgggcaacgccatgcggacgcgttgcatcacatcatggagatctacaaccacggtattgtcaccccagctcgtggtggaacagccagcatcatcatctccatgaccaccgatgatcttgacgagatcaaccacgccaacagcagtggtgaaagtctg

SEQ ID NO: 1422 - protein, 332 aa, Corynebacterium glutamicum
MSITTHVQALTTALNAIDNHLASMLDHGVTPDQYKAIEPDLIALEHTINHHATIAAQTTALAERTNAAQSIGSTHLIDYLTTTFGLSKARAHHRINLAHSLYPIPKPNSGSGNGGNGGNPDGGPDGGDSGDDDSGDDDPDPEPDKPEDGKPDSDKPRRPRISAEKHAIITDELARLNPNTTPSAEELRNQALSQAIWRTPEDLRTWLRHQVTTANKNNPNPITAMKRRYLSVGKPDADNMVRISGLVPAATAALITANTAPLTKRGNLVDLPAAEDMRTRGQRHADALHHIMEIYNHGIVTPARGGTASIIISMTTDDLDEINHANSSGESL

SEQ ID NO: 1423 - DNA, 359 bp, Corynebacterium glutamicum
  CDS (1)..(336): RXN03046
gcctcaattgctaattccaccctgaatattccagtgggattgggcggctccaatttgctgctcaaggcgcaaaccgcgaccccatctgagcctgcgaatgctcaggacaaactgtaccgtttctgcatcgccaatggtaagagggcattttccgatgcgcagcgattcttgctcaacgccgacgagctcgcggagctttctgattatgagcgtctggcttatgccatcaccttgcttgatcagcctggaaaagaagcagaaggacgcgaactttttcctttcggagcttcgccgccagggctaccgcgctgtcgatttcttggaatcccagactgttgaccagctgaataaccccgatg

SEQ ID NO: 1424 - protein, 112 aa, Corynebacterium glutamicum
ASIANSTLNIPVGLGGSNLLLKAQTATPSEPANAQDKLYRFCIANGKRAFSDAQRFLLNADELAELSDYERLAYAITLLDQPGKEAEGRELFPFGASPPGLPRCRFLGIPDC

SEQ ID NO: 1425 - DNA, 1539 bp, Corynebacterium glutamicum; identical to SEQ ID NO: 1399
  CDS (101)..(1516): RXN03047

SEQ ID NO: 1426 - protein, 472 aa, Corynebacterium glutamicum; identical to SEQ ID NO: 1400

SEQ ID NO: 1427 - DNA, 1539 bp, Corynebacterium glutamicum; identical to SEQ ID NO: 1399
  CDS (101)..(1516): FRXA00036

SEQ ID NO: 1428 - protein, 472 aa, Corynebacterium glutamicum; identical to SEQ ID NO: 1400

SEQ ID NO: 1429 - DNA, 996 bp, Corynebacterium glutamicum; identical to SEQ ID NO: 1401
  CDS (101)..(973): RXN03048

SEQ ID NO: 1430 - protein, 291 aa, Corynebacterium glutamicum; identical to SEQ ID NO: 1402

SEQ ID NO: 1431 - DNA, 996 bp, Corynebacterium glutamicum; identical to SEQ ID NO: 1401
  CDS (101)..(973): FRXA00037

SEQ ID NO: 1432 - protein, 291 aa, Corynebacterium glutamicum; identical to SEQ ID NO: 1402

SEQ ID NO: 1433 - DNA, 1066 bp, Corynebacterium glutamicum
  CDS (101)..(1066): RXN03050
gttaagcctataggaaaaagtgtttgcatatcacccttgtattcgaacacgtgagcgggtagagtgggtggtaacaacacggggaaagggggaagacaccatgagcatcaccacacacgtccaagcactcaccacagcactcaacgccatcgacaaccatttggccagcatgctcgaccatggtgtcaccccagaccaatacaaggccatcgagcccgacctcatcgccctagaacacaccatcaaccaccacgccaccatcgccgcccaaaccacagccctcgccgaacgcaccaacgccgcccacaccattggctccacccacctcatcgactacctcaccaccaccttcggactatccaaagcacgcgcccaccaccgcatcaatctcgcccactccctctaccccataccgaagccaaaccctggatctggcaacggcggtaatggtggcaatcccgacggcggtcctgatggtggcgactcgggtgatgacgactccggcgacgatgaccccgaccccgaaccggacaagcctgaagacggcaaacctgatggtgataagcctcgtgggccacggatcagcgcggaaaaacacgccatcatcaccgacgaactcgcccgcctcaacccgaataccacacccagcgccgaggagctacgcacccaagccctgagtcaagcgatctggcgcaccccagaagacctccgcacgtggctacgccaccacgtcaccaccgccaataaaaacaaccccaaccccatcaccgccatgaaaaggcgctacctcgctgtaggtaaacccgatgccgacaacatggtccgcatcagcggcctcgtgcccgcagccaccgcagcactgatcaccgcgaacaccgcaccgttaaccaaacgcggcaacctcgtggatctacccgcagcagaagatatgcgcacccgcgggcaacgccatgcggacgcgttgcatcacatcatggagatctacaaccacggtattgtcaccccagctcgtggtggaacagccagcatcatcatctccatgaccaccgatgatcttgatgagatc

SEQ ID NO: 1434 - protein, 322 aa, Corynebacterium glutamicum
MSITTHVQALTTALNAIDNHLASMLDHGVTPDQYKAIEPDLIALEHTINHHATIAAQTTALAERTNAAHTIGSTHLIDYLTTTFGLSKARAHHRINLAHSLYPIPKPNPGSGNGGNGGNPDGGPDGGDSGDDDSGDDDPDPEPDKPEDGKPDGDKPRGPRISAEKHAIITDELARLNPNTTPSAEELRTQALSQAIWRTPEDLRTWLRHHVTTANKNNPNPITAMKRRYLAVGKPDADNMVRISGLVPAATAALITANTAPLTKRGNLVDLPAAEDMRTRGQRHADALHHIMEIYNHGIVTPARGGTASIIISMTTDDLDEI

SEQ ID NO: 1435 - DNA, 1558 bp, Corynebacterium glutamicum
  CDS (12)..(1535): RXN03053
gaggtaaaggattccacttcacctcgactgagtttgccggttcttattctttggtcaccaatggtcttaacgatgttgctggcgaatacgtcggtgtcatgcgtggcgatgtcaacaactccgctgtgctttttgatgtggatcgctggtcgggacatgtcgtatgcgcagatagctcgattaatacatcaccactacttaagcgtccccgtgtcgttgacatgtgggggtcgaagatttctcaggcagcgctactgaataaccgtcgcgtagtgcacctggtgctcaatggtgccaagctcgatgaaatgggaccaaagctagaatccatgaccgctcatgtggatatgactagcggagatctcaacatgttcgagctgtttggtaagcaagaagatgagctgtcgctgtattccacacacatggacaaaatcgtgtttatgaccgagcaggcattgggcgataagacctctgagctggcgctattgcgcggaaagctcaaagaaattattacagccttttatgtggatatgaaaatgtgggctcttaatgccggtgaaaaccgtgacaagctgcgtcttgttggtgtgcctcatgagcagatcccgttgctctctgtcttcgtgtcctatttggatcaagaatatgagcgccagaaatatgagggaaccaaagaccctgaaatgtttcgtgccatttctgtgctgcgactgacctataaggatttgctcgatactcatggcgatctgtttaatcagcacacggcagatggcattgattctgtgaactctgcacgccgcgtgatctatgatttttctggagtgctgcgacgtggcgcaggtgtcgcgatggcacagctggttaacgtgattggttttgctgtggagacgcttggtcaaggcgatgtggtcatcattcacggtgctgatggcattgtcgatgttgatgttcaggattatttggctaatcagttcgcatatatggctgagcgtggtgggcgagtggcgtatctctacagctcgatggacgcgatgcttggcactgttggcttcaatcaattccaacgtgctgcgtacaccattttgggcccgatgaacgttgactcggtggatacttatcaatctctgattaatagtcagatcccgatggacttggcacggttggtgacaacgcagaattctggtgcgagctatttgcgccgaggatctaccaatgtggtgtttgaaaccaaccttgcgttgggcgttaatccttatatggagcagcgtcgcaagattgaagcacagcgaggtcagcgacgatccaagcgagacaagcactacggtggtggcacgacgatggtgggcacagcggatcttgatgttgtcgcaattcaggcgaaggccgagcaccgcgaagagcgctttgatgagaaatctgcgcgcaagatgaaggagcttgatgatgtagaagcgaaagaactagctttgaaaactgggccgaagaatcttgatgatgcgcttgcacaggtggagaagaagcgcctggcgaagcggtagttgttggctgtggtgaataa

SEQ ID NO: 1436 - protein, 508 aa, Corynebacterium glutamicum
FHFTSTEFAGSYSLVTNGLNDVAGEYVGVMRGDVNNSAVLFDVDRWSGHVVCADSSINTSPLLKRPRVVDMWGSKISQAALLNNRRVVHLVLNGAKLDEMGPKLESMTAHVDMTSGDLNMFELFGKQEDELSLYSTHMDKIVFMTEQALGDKTSELALLRGKLKEIITAFYVDMKMWALNAGENRDKLRLVGVPHEQIPLLSVFVSYLDQEYERQKYEGTKDPEMFRAISVLRLTYKDLLDTHGDLFNQHTADGIDSVNSARRVIYDFSGVLRRGAGVAMAQLVNVIGFAVETLGQGDVVIIHGADGIVDVDVQDYLANQFAYMAERGGRVAYLYSSMDAMLGTVGFNQFQRAAYTILGPMNVDSVDTYQSLINSQIPMDLARLVTTQNSGASYLRRGSTNVVFETNLALGVNPYMEQRRKIEAQRGQRRSKRDKHYGGGTTMVGTADLDVVAIQAKAEHREERFDEKSARKMKELDDVEAKELALKTGPKNLDDALAQVEKKRLAKR

SEQ ID NO: 1437 - DNA, 1559 bp, Corynebacterium glutamicum
  CDS (1)..(1536): FRXA02885
cgaggtaaaggattccacttcacctcgactgagtttgccggttcttattctttggtcaccaatggtcttaacgatgttgctggcgaatacgtcggtgtcatgcgtggcgatgtcaacaactccgctgtgctttttgatgtggatcgctggtcgggacatgtcgtatgcgcagatagctcgattaatacatcaccactacttaagcgtccccgtgtcgttgacatgtgggggtcgaagatttctcaggcagcgctactgaataaccgtcgcgtagtgcacctggtgctcaatggtgccaagctcgatgaaatgggaccaaagctagaatccatgaccgctcatgtggatatgactagcggagatctcaacatgttcgagctgtttggtaagcaagaagatgagctgtcgctgtattccacacacatggacaaaatcgtgtttatgaccgagcaggcattgggcgataagacctctgagctggcgctattgcgcggaaagctcaaagaaattattacagccttttatgtggatatgaaaatgtgggctcttaatgccggtgaaaaccgtgacaagctgcgtcttgttggtgtgcctcatgagcagatcccgttgctctctgtcttcgtgtcctatttggatcaagaatatgagcgccagaaatatgagggaaccaaagaccctgaaatgtttcgtgccatttctgtgctgcgactgacctataaggatttgctcgatactcatggcgatctgtttaatcagcacacggcagatggcattgattctgtgaactctgcacgccgcgtgatctatgatttttctggagtgctgcgacgtggcgcaggtgtcgcgatggcacagctggttaacgtgattggttttgctgtggagacgcttggtcaaggcgatgtggtcatcattcacggtgctgatggcattgtcgatgttgatgttcaggattatttggctaatcagttcgcatatatggctgagcgtggtgggcgagtggcgtatctctacagctcgatggacgcgatgcttggcactgttggcttcaatcaattccaacgtgctgcgtacaccattttgggcccgatgaacgttgactcggtggatacttatcaatctctgattaatagtcagatcccgatggacttggcacggttggtgacaacgcagaattctggtgcgagctatttgcgccgaggatctaccaatgtggtgtttgaaaccaaccttgcgttgggcgttaatccttatatggagcagcgtcgcaagattgaagcacagcgaggtcagcgacgatccaagcgagacaagcactacggtggtggcacgacgatggtgggcacagcggatcttgatgttgtcgcaattcaggcgaaggccgagcaccgcgaagagcgctttgatgagaaatctgcgcgcaagatgaaggagcttgatgatgtagaagcgaaagaactagctttgaaaactgggccgaagaatcttgatgatgcgcttgcacaggtggagaagaagcgcctggcgaagcggtagttgttggctgtggtgaataa

SEQ ID NO: 1438 - protein, 512 aa, Corynebacterium glutamicum
RGKGFHFTSTEFAGSYSLVTNGLNDVAGEYVGVMRGDVNNSAVLFDVDRWSGHVVCADSSINTSPLLKRPRVVDMWGSKISQAALLNNRRVVHLVLNGAKLDEMGPKLESMTAHVDMTSGDLNMFELFGKQEDELSLYSTHMDKIVFMTEQALGDKTSELALLRGKLKEIITAFYVDMKMWALNAGENRDKLRLVGVPHEQIPLLSVFVSYLDQEYERQKYEGTKDPEMFRAISVLRLTYKDLLDTHGDLFNQHTADGIDSVNSARRVIYDFSGVLRRGAGVAMAQLVNVIGFAVETLGQGDVVIIHGADGIVDVDVQDYLANQFAYMAERGGRVAYLYSSMDAMLGTVGFNQFQRAAYTILGPMNVDSVDTYQSLINSQIPMDLARLVTTQNSGASYLRRGSTNVVFETNLALGVNPYMEQRRKIEAQRGQRRSKRDKHYGGGTTMVGTADLDVVAIQAKAEHREERFDEKSARKMKELDDVEAKELALKTGPKNLDDALAQVEKKRLAKR

SEQ ID NO: 1439 - DNA, 552 bp, Corynebacterium glutamicum
  CDS (101)..(529): RXN03055
aaggtcagccgtatttcggtcagtcagcaactaattacgcttatcttccgtgtacgatagaccgtagttaacataaggaatggaataggagaattgcggcatgtattccgacaagctgattctcttgttcctttctgagcaggattcaagctatgaatgctgcgtaggtttattagatggctcagatggacgtgattatattgaaaagcttctgaagggtaggaagctgaagaaccattttcttgaatgggaagatattaacaaggctgatgttgctcgtgaagaaatatataaagggcaattggtgcatctggtgtttgtgacggctctttccacgcctggtgaaatttcttttgtttttccaggtcaatctcttatgagtgcaacactcgaagaagactttgctgcgcttgtgctcgaagaggagcgcacatcatttagacctgaactgtctcacctgtggtcactccccgtagggtgggtagctccggggcttgagggtttcgtggagcgtaattccgaggcagcttgaaccaccgctttctgagccgg

SEQ ID NO: 1440 - protein, 143 aa, Corynebacterium glutamicum
MYSDKLILLFLSEQDSSYECCVGLLDGSDGRDYIEKLLKGRKLKNHFLEWEDINKADVAREEIYKGQLVHLVFVTALSTPGEISFVFPGQSLMSATLEEDFAALVLEEERTSFRPELSHLWSLPVGWVAPGLEGFVERNSEAA

SEQ ID NO: 1441 - DNA, 552 bp, Corynebacterium glutamicum
  CDS (101)..(529): FRXA00261
aaggtcagccgtatttcggtcagtcagcaactaattacgcttatcttccgtgtacgatagaccgtagttaacataaggaatggaataggagaattgcggcatgtattccgacaagctgattctcttgttcctttctgagcaggattcaagctatgaatgctgcgtaggtttattagatggctcagatggacgtgattatattgaaaagcttctgaagggtaggaagctgaagaaccattttcttgaatgggaagatattaacaaggctgatgttgctcgtgaagaaatatataaagggcaattggtgcatctggtgtttgtgacggctctttccacgcctggtgaaatttcttttgtttttccaggtcaatctctcatgagtgcaacactcgaagaagactttgctgcacttgtgctcgaagaggagcgcacatcatttagacctgatctgtctcacttgtggtcactccccgtagggtgggtagctccggggcttgagggtttcgtggagcgtaattcagaggcagcttgaaccaccgctctttgagccgg

SEQ ID NO: 1442 - protein, 143 aa, Corynebacterium glutamicum
MYSDKLILLFLSEQDSSYECCVGLLDGSDGRDYIEKLLKGRKLKNHFLEWEDINKADVAREEIYKGQLVHLVFVTALSTPGEISFVFPGQSLMSATLEEDFAALVLEEERTSFRPDLSHLWSLPVGWVAPGLEGFVERNSEAA

SEQ ID NO: 1443 - DNA, 552 bp, Corynebacterium glutamicum; identical to SEQ ID NO: 1439
  CDS (101)..(529): FRXA02888

SEQ ID NO: 1444 - protein, 143 aa, Corynebacterium glutamicum; identical to SEQ ID NO: 1440

SEQ ID NO: 1445 - DNA, 603 bp, Corynebacterium glutamicum
  CDS (101)..(580): RXN03059
gtgtcattttcttggcggacggtcgtatcgtgaaccagttgtttgatcccaccatcgaggaaatcttggccacgatgaacggaattgaggatattgcctaatgaattccggttccacaatgcgcagaatcagtctgcgcaatattggcgcgcacaaggtcaggctgtttttgacagttctggcagtggtgctcggcacgtcttttgtttccggcgcgatgatgtttaccaacgcgctgtcctccacttttgatgaggctattgccagcagctttgacggcgtggatgtggtggtttcaccaaacggtgcatcagaggtgcagggtgttcctgttgagacggttgaatctttgcgtgaggattcccgcatcaaccatctcaacatcaacggttcccagactgtcgttctggcggatgctgattccaaggcaattcaaacgactgggggatcgtcgttaagcatttattacagcgcggacgacgcggttgcccaggcacctgaattggctgagggagaggcaccgactggcaccgaagaggtgcttgcctcgaaggcgggcgctgaggcgaatggcctggagtaggggaccagatcttggtcgtg

SEQ ID NO: 1446 - protein, 160 aa, Corynebacterium glutamicum
MNSGSTMRRISLRNIGAHKVRLFLTVLAVVLGTSFVSGAMMFTNALSSTFDEAIASSFDGVDVVVSPNGASEVQGVPVETVESLREDSRINHLNINGSQTVVLADADSKAIQTTGGSSLSIYYSADDAVAQAPELAEGEAPTGTEEVLASKAGAEANGLE

SEQ ID NO: 1447 - DNA, 603 bp, Corynebacterium glutamicum; identical to SEQ ID NO: 1445
  CDS (101)..(580): FRXA02899

SEQ ID NO: 1448 - protein, 160 aa, Corynebacterium glutamicum; identical to SEQ ID NO: 1446

SEQ ID NO: 1449 - DNA, 622 bp, Corynebacterium glutamicum
  CDS (101)..(622): RXN03062
gatgagtattctctccgaggcaacgaagttaatatgtccatgagggcgaagttgtagacaatatttggcccatatggataattgacaggagtttaacgccatggaaaccccaacccaagacatggatgtccgctggttatacacccaaagccagctcaaactccgcgaaattctccccacaaacaaaaccttcgatgtcatccaaatcagcgaactcgttgaccccaccgacttcatcaggcccaacagcgtggtcttatccgttggcatcgccttcgcagaaacgcccgacgggcttcgcgattgggcacaccgactcgccgacgcaggggtcatcgcgatcgggttcggctccggcctcaccttcccacaggttccgcaggcgcttatcgacgcctccctccaccttggcctcggcctctttgaagtcccccgtgaaattccatttatctcgatcacctccagcgtgcgtgatgagcaaacccgccgtgccggccgcctgcaacaagaactcctcctggaacaggaacggcttaactccatcgccatctccggtggcatcgaagccctgtgccgtgctgccgccgactatttgggtggtgcagtaaccatcgtggacagc

SEQ ID NO: 1450 - protein, 174 aa, Corynebacterium glutamicum
METPTQDMDVRWLYTQSQLKLREILPTNKTFDVIQISELVDPTDFIRPNSVVLSVGIAFAETPDGLRDWAHRLADAGVIAIGFGSGLTFPQVPQALIDASLHLGLGLFEVPREIPFISITSSVRDEQTRRAGRLQQELLLEQERLNSIAISGGIEALCRAAADYLGGAVTIVDS

SEQ ID NO: 1451 - DNA, 786 bp, Corynebacterium glutamicum
  CDS (101)..(763): RXN03066
aactgttggcatggcgaagtacaatgttcgtgcaactggtcacgtggagcgcatcgtccgcgaaatcaccgcggcgtaatagcaccagcttaaaaaccttatgacatcagacaaagacactgaacaattggaagcggcaggcactgaaattttaatgcctcgccgccgtccggcacagcagcgcagtcgtgaacgattcaatcgaatcctcaccgctgcgcgttcagtgcttgtcgatctaggttttgaatcgttcacgtttgatgaagtcgctaagcgtgcagaggtaccgatcggcacgctgtaccaattctttgccaataagtatgtattgatctgcgaattggatcgtgtggataccgcagaagctgtcgcggagttgaagaaattctccgatcaggttcctgcgttgcagtggccggatatccttgatgaattcattgagcacttggctaggctctggcgcgatgatccgtctcggcgggccgtgtggcatgccatccagtccacgccggcaactcgtgcgacagctgcggcgacggaaaaagagatgctggaaatcatcgcggaagttatgcgcccgcttgcccgcggtgccggctacgaggagcgcatgtcactggcgggattgctggtgcacacggtaagttccctgcttaactatgccgtgcgtgatgtcaatagttccgaagaggatttcgacagcatcgtggaagaaataaaacgaatgctgatttcttacctcttctccgtggctactggatagtcaacacgcacgttccaccg

SEQ ID NO: 1452 - protein, 221 aa, Corynebacterium glutamicum
MTSDKDTEQLEAAGTEILMPRRRPAQQRSRERFNRILTAARSVLVDLGFESFTFDEVAKRAEVPIGTLYQFFANKYVLICELDRVDTAEAVAELKKFSDQVPALQWPDILDEFIEHLARLWRDDPSRRAVWHAIQSTPATRATAAATEKEMLEIIAEVMRPLARGAGYEERMSLAGLLVHTVSSLLNYAVRDVNSSEEDFDSIVEEIKRMLISYLFSVATG

SEQ ID NO: 1453 - DNA, 786 bp, Corynebacterium glutamicum
  CDS (101)..(763): FRXA02876
aactgttggcatggcgaagtacaatgttcgtgcaactggtcacgtggagcgcatcgtccgcgaaatcaccgcggcgtaatagcaccagcttaaaaaccttatgacatcagacaaagacactgaacaattggaagcggcaggcactgaaattttaatgcctcgccgccgtccggcacagcagcgcagtcgtgaacgattcaatcgaatcctcaccgctgcgcgttcagtgcttgtcgatctaggttttgaatcgttcacgtttgatgaagtcgctaagcgtgcagaggtaccgatcggcacgctgtaccaattctttgccaataagtatgtattgatctgcgaattggatcgtgtggataccgcagaagctgtcgcggagttgaagaaattctccgatcaggttcctgcgttgcagtggccggatatccttgatgaattcattgagcacttggctaggctctggcgcgatgatccgtctcggcgggccgtgtggcatgccatccagtccacgccggcaactcgtgcgacagctgcggcgacggaaaaagagatgctggaaatcatcgcggaagttatgcgcccgcttgcccgcggtgccggctacgaggagcgcatgtcactggcgggattgctggtgcacacggtaagttccctgcttaactatgccgtgcgtgatgtcaatagttccgaagaggatttcgacagcatcgtggaagaaatcaaacgaatgctgatttcttacctcttctccgtggctactggatagtcaacacgcacgtcgccacc

SEQ ID NO: 1454 - protein, 221 aa, Corynebacterium glutamicum; identical to SEQ ID NO: 1452

SEQ ID NO: 1455 - DNA, 294 bp, Corynebacterium glutamicum
  CDS (101)..(271): RXN03067
ttgctgttgttggcatttccccggatccggtggacaagctggtaagttccgtgaggaccatgagctgaacttccctcttctttccgatgaggacaagtctgtgatgactgcgtggggtgcgtttggtgagaagaagaattacggcaagattgttcagggtgtaattcgttccacattcctcatcaatgctgacggaactgttggcatggcgaagtacaatgttcgtgcaactggtcacgtggagcgcatcgtccgcgaaatcaccgcggcgtaatagcaccagcttaaaaacct

SEQ ID NO: 1456 - protein, 57 aa, Corynebacterium glutamicum
VMTAWGAFGEKKNYGKIVQGVIRSTFLINADGTVGMAKYNVRATGHVERIVREITAA

SEQ ID NO: 1457 - DNA, 143 bp, Corynebacterium glutamicum
  CDS (1)..(120): RXN03068
accaaggaagcatgcgatttccgtgattctttgagcaacctcaacgatctcgacattgctgttgttggcatttccccggatccggtggacaagctggtaagttccgtgaggaccatgagctgaacttccctcttctttccgat

SEQ ID NO: 1458 - protein, 40 aa, Corynebacterium glutamicum
TKEACDFRDSLSNLNDLDIAVVGISPDPVDKLVSSVRTMS

SEQ ID NO: 1459 - DNA, 753 bp, Corynebacterium glutamicum
  CDS (101)..(730): RXN03073
cgaaacatctaggcaacccgacttttatgtccctgcttgagttgaaaactgctgtcgatcaaaggtgccccaattgtttcatgccgtgagttttgcattaatggactccgtaaatgtcctgctcattggcataatcgtcgcgattgctgctttgctgcctcgcaagggtaaatatgggccaatcgccacgctactggttgccggcgattggcttggcgttttcctcctcagtattttggtgatgctcgtttttgatggactagaggatttagttcagggctttttggattcaatctggttcggagtcatccttcttgtaactggcatcgtttccttcgttgcgacactggtttctaaaaccgacagcactagaaagcttgatggattcctagcgccagtaaaaactcctagttggaaaactgttggagccggattgatccttggaatcgttcagtcagcgacatctgtacctttttatgcagggcttggatatttgagcgttggcaatttcagtccagaaattaggtatggcggacttgtggtctatgcgaccttggctctgagtctgccgattatcgtggcaattctcgttggaatggttcgcaaataccctgaaagtcctgttggtaggttgtttgaactgattggtcaaaataaagagagagtcaccaaatggtcgggctatctcgtgtcactggttctgtgcataatgggcattacttcgatcctgtaactagcgcatgtactcatgag

SEQ ID NO: 1460 - protein, 210 aa, Corynebacterium glutamicum
MDSVNVLLIGIIVAIAALLPRKGKYGPIATLLVAGDWLGVFLLSILVMLVFDGLEDLVQGFLDSIWFGVILLVTGIVSFVATLVSKTDSTRKLDGFLAPVKTPSWKTVGAGLILGIVQSATSVPFYAGLGYLSVGNFSPEIRYGGLVVYATLALSLPIIVAILVGMVRKYPESPVGRLFELIGQNKERVTKWSGYLVSLVLCIMGITSIL

SEQ ID NO: 1461 - DNA, 574 bp, Corynebacterium glutamicum
  CDS (101)..(574): FRXA02905
cgaaacatctaggcaacccgacttttatgtccctgcttgagttgaaaactgctgtcgatcaaaggtgccccaattgtttcatgccgtgagttttgcattaatggactccgtaaatgtcctgctcattggcataatcgtcgcgattgctgctttgctgcctcgcaagggtaaatatgggccaatcgccacgctactggttgccggcgattggcttggcgttttcctcctcagtattttggtgatgctcgtttttgatggactagaggatttagttcagggctttttggattcaatctggttcggagtcatccttcttgtaactggcatcgtttccttcgttgcgacactggtttctaaaaccgacagcactagaaagcttgatggattcctagcgccagtaaaaactcctagttggaaaactgttggagccggattgatccttggaatcgttcagtcagcgacatctgtacctttttatgcagggcttggatatttgagcgttggcaatttcagtccagaaattaggtatggcggacttgtggtctatgcgaccttggctctgagtctgccgatt

SEQ ID NO: 1462 - protein, 158 aa, Corynebacterium glutamicum
MDSVNVLLIGIIVAIAALLPRKGKYGPIATLLVAGDWLGVFLLSILVMLVFDGLEDLVQGFLDSIWFGVILLVTGIVSFVATLVSKTDSTRKLDGFLAPVKTPSWKTVGAGLILGIVQSATSVPFYAGLGYLSVGNFSPEIRYGGLVVYATLALSLPI

SEQ ID NO: 1463 - DNA, 474 bp, Corynebacterium glutamicum
  CDS (101)..(451): RXN03085
taagcaggattacgacaagcgccaagatatcaagcgtcgcaccgaagaacgcgaagtcacccgtgagctcggccgtcgcattaagggaatcaacgcgtaaatgagtattcacatcgcaaaagtccacgacgtcctcaaaggtgaaaaaacctacggaaccaccattttggtggatcggctctggccacgcggtgtgaaaaaagacgaccttgagccagacctctggctcaaaagcgtcgcccccacaaccgaactccgaaaatggttcggccacgacccagctaaattctccgaattcagcacccgttacaccgaagagctcaacgccagcaacgacaaagacctagagacgcttgtcgacgccacctcccgccaccccgtaaccctcctctacggtgctgccgaccgcgaccacaaccacgccattgttctagccaagtggctaaagaaataactccttgcaaatagttgcaa

SEQ ID NO: 1464 - protein, 117 aa, Corynebacterium glutamicum
MSIHIAKVHDVLKGEKTYGTTILVDRLWPRGVKKDDLEPDLWLKSVAPTTELRKWFGHDPAKFSEFSTRYTEELNASNDKDLETLVDATSRHPVTLLYGAADRDHNHAIVLAKWLKK

SEQ ID NO: 1465 - DNA, 1181 bp, Corynebacterium glutamicum
  CDS (1)..(1158): RXN03089
cactccctctaccccataccgaagccaaactctggatctggcaacggcggtaatggtggcaatcccgatggcggtcctgatggtggcgactcgggtgatgacgactccggcgatgatgaccccgaccccgaaccggacaagcctgaagacggcaaacctgatagtgataagccccgtaggccacggatcagcgcggaaaaacacgccatcatcaccgacgaactcgcccgcctcaacccgaataccacacccagcgccgaggaactacgcacccaagccctgagtcaagcgatctggcgcaccccagaagacctccgcacgtggctacgccaccaggtcaccaccgcgaacaaaaacaaccccaaccccatcaccgccatgaaaaggcgctacctctcagtaggtaaacccgatgccgacaacatggtccgcatcagcggcctcgtgcccgcagccaccgcagcactgatcaccgcgaacaccgcaccgttaaccaaacgtggcaacctcgtggatctaccagcagcagaagatatgcgcacccgcgggcaacgccatgcggatgcgttgcatcacatcatggagatctacaaccacggtattgtcaccccagctcgtggtggaacagccagcatcatcatctccatgaccaccgatgatcttgacgagatcaaccacggtgatcatggcgatggcagtctacttaacaacctgtaccccacgaacacgggttactcattgaacttggcggagatcatgaacctcatcgctgcgaaatacgacttcgctgtgctcctcgatggtgagacggggcagccgttgaacgtcaataggatgcagcgctcagcgaacctgactcaacgcatcgcgttgtttgcttctgagttggtgtgctcggcacccaattgtgacaggccgcagttagagtgcgaggttcatcatttagatccctggatgagaggtgggctgaccaacctggtcaatctcacgcatcagtgctttaatcaccacccacgcaacgatgattccaggagtggggtcaatggtaaagggtttatggaccgcgatcccgtcactggcagagtaggtcactactcagcaagtggtgaggggccggtgtttaaccggtcggctgctgctgatcgttccggtggtgcatagtccagacgtaagcattatgg

SEQ ID NO: 1466 - protein, 386 aa, Corynebacterium glutamicum
HSLYPIPKPNSGSGNGGNGGNPDGGPDGGDSGDDDSGDDDPDPEPDKPEDGKPDSDKPRRPRISAEKHAIITDELARLNPNTTPSAEELRTQALSQAIWRTPEDLRTWLRHQVTTANKNNPNPITAMKRRYLSVGKPDADNMVRISGLVPAATAALITANTAPLTKRGNLVDLPAAEDMRTRGQRHADALHHIMEIYNHGIVTPARGGTASIIISMTTDDLDEINHGDHGDGSLLNNLYPTNTGYSLNLAEIMNLIAAKYDFAVLLDGETGQPLNVNRMQRSANLTQRIALFASELVCSAPNCDRPQLECEVHHLDPWMRGGLTNLVNLTHQCFNHHPRNDDSRSGVNGKGFMDRDPVTGRVGHYSASGEGPVFNRSAAADRSGGA

SEQ ID NO: 1467 - DNA, 1575 bp, Corynebacterium glutamicum
  CDS (101)..(1552): FRXA00071
  VARIANT 25, 187: Xaa = Leu
  VARIANT 59: Xaa = Thr
  VARIANT 66: Xaa = Asp
  VARIANT 67, 68: Xaa = Ala
  VARIANT 69: Xaa = Gln or His
  VARIANT 70: Xaa = Thr or Ser
  VARIANT 189: Xaa = Asn or Thr
  VARIANT 194: Xaa = Gln
gcttttctatttcgaaaaatagccttgtattcgaaaatttgatcgggtatggtggttggtakwrksrswggkaacwamacggggaaagggggaagacaccatgagcatcaccacacacgtccaagcactcaccacagcactcaacgccatcgacaaccatttggccagcatgctygaccatggtgtcaccccagaccaatacaaggccatcgagcccgacctcatcgccctagaacacaccatcaaccaccacgccaccatcgccgcccaaaccacmgccctcgccgaacgcaccaaygcygcscaswcsattggctccacccacctcatcgactacctcaccaccaccttcggcctatctaaagcacgcgcccaccaccgcatcaatctcgcccactccctctaccccataccgaagccaaactctggatctggcaacggcggtaatggtggcaatcccgacggcggtcctgatggtggcgactcgggtgatgacgactccggcgatgatgaccccgaccccgaaccggacaagcctgaagacggcaaacctgatagtgataagccccgtaggccacggatcagcgcggaaaaacacgccatcatcaccgacgaactcgcccgcctcaacccgaataccacacccagcgccgaggaactrcgcamccaagccctgagtcargcgatctggcgcaccccagaagacctccgcacgtggctacgccaccaggtcaccaccgcgaacaaaaacaaccccaaccccatcaccgccatgaaaaggcgctacctctcagtaggtaaacccgatgccgacaacatggtccgcatcagcggcctcgtgcccgcagccaccgcagcactgatcaccgcgaacaccgcaccgttaaccaaacgtggcaacctcgtggatctaccagcagcagaagatatgcgcacccgcgggcaacgccatgcggatgcgttgcatcacatcatggagatctacaaccacggtattgtcaccccagctcgtggtggaacagccagcatcatcatctccatgaccaccgatgatcttgacgagatcaaccacggtgatcatggcgatggcagtctacttaacaacctgtaccccacgaacacgggttactcattgaacttggcggagatcatgaacctcatcgctgcgaaatacgacttcgctgtgctcctcgatggtgagacggggcagccgttgaacgtcaataggatgcagcgctcagcgaacctgactcaacgcatcgcgttgtttgcttctgagttggtgtgctcggcacccaattgtgacaggccgcagttagagtgcgaggttcatcatttagatccctggatgagaggtgggctgaccaacctggtcaatctcacgcatcagtgctttaatcaccacccacgcaacgatgattccaggagtggggtcaatggtaaagggtttatggaccgcgatcccgtcactggcagagtaggtcactactcagcaagtggtgaggggccggtgtttaaccggtcggctgctgctgatcgttccggtggtgcatagtccagacgtaagcattatgg

SEQ ID NO: 1468 - protein, 484 aa, Corynebacterium glutamicum
  VARIANT 25, 187: Xaa = Leu
  VARIANT 59: Xaa = Thr
  VARIANT 66: Xaa = Asp
  VARIANT 67, 68: Xaa = Ala
  VARIANT 69: Xaa = Gln or His
  VARIANT 70: Xaa = Thr or Ser
  VARIANT 189: Xaa = Asn or Thr
  VARIANT 194: Xaa = Gln
MSITTHVQALTTALNAIDNHLASMXDHGVTPDQYKAIEPDLIALEHTINHHATIAAQTXALAERTXXXXXIGSTHLIDYLTTTFGLSKARAHHRINLAHSLYPIPKPNSGSGNGGNGGNPDGGPDGGDSGDDDSGDDDPDPEPDKPEDGKPDSDKPRRPRISAEKHAIITDELARLNPNTTPSAEEXRXQALSXAIWRTPEDLRTWLRHQVTTANKNNPNPITAMKRRYLSVGKPDADNMVRISGLVPAATAALITANTAPLTKRGNLVDLPAAEDMRTRGQRHADALHHIMEIYNHGIVTPARGGTASIIISMTTDDLDEINHGDHGDGSLLNNLYPTNTGYSLNLAEIMNLIAAKYDFAVLLDGETGQPLNVNRMQRSANLTQRIALFASELVCSAPNCDRPQLECEVHHLDPWMRGGLTNLVNLTHQCFNHHPRNDDSRSGVNGKGFMDRDPVTGRVGHYSASGEGPVFNRSAAADRSGGA

SEQ ID NO: 1469 - DNA, 747 bp, Corynebacterium glutamicum
  CDS (101)..(724): RXN03098
gaccgttttgtcgatcgcaccgctgctggctcgcaccatcaacgagatcttcgaaaacggttccgtcaccaccctcttcgagggcgaggcctaaacacccatgcccaccacggacgtcttcaaccgcgtccggttggcattggaacctctagctgatcccgcacgtgccaccggaatggcaagctacatgcgggatcagttttcttttctcggcatcccatccacccccagaaaagaagcctgcaaacccgtgctgtccgcgctaaaagagttggacactgactttgtctcagactgctttggcgcagctgaacgggaataccagtatgtcgcctgcgatcacatcaatcgcgtcggcatcaccgatttaggttttgccaaagcattagtgcagaccaaatcctggtgggacaccgtcgattccctagcaaaaccgatcggcgccaaacacgatgatgatctgatgaaaacgtgggcgcttgatgaggacttctgggtgcgccgcatcgcgatcatccaccaactgggccgcaagaaaaacaccgacgctgccctgctggcctggatcatcgagcagaacctcggctccagcgagttcttcatcaacaaagcgatcggctgggcactgcgggatttcgcccgccacgaccccagctgggtccgggcttttgtcgacgccacggacctttccccactgagccggcgagaagccctgaagaatatttagccctcaggcatcatctgagc

SEQ ID NO: 1470 - protein, 208 aa, Corynebacterium glutamicum
MPTTDVFNRVRLALEPLADPARATGMASYMRDQFSFLGIPSTPRKEACKPVLSALKELDTDFVSDCFGAAEREYQYVACDHINRVGITDLGFAKALVQTKSWWDTVDSLAKPIGAKHDDDLMKTWALDEDFWVRRIAIIHQLGRKKNTDAALLAWIIEQNLGSSEFFINKAIGWALRDFARHDPSWVRAFVDATDLSPLSRREALKNI

SEQ ID NO: 1471 - DNA, 798 bp, Corynebacterium glutamicum
  CDS (101)..(775): RXN03099
ccacgccgtagcgatcattgatcaccttgagcactggggtaatggcattggtggtgcatgatgctgcggaaacgatctgatcatctgcggtgatgtcggtgtggttgatgccgtacacgatgttcttcagatcgcccttgcccggcgcggtgagtacaaccttggcaacgcccttggacttgaggtgctgggacaggccttcgcggtcacgccagcggccggtgttgtctaccacgacggcgtcattgatgccgtattcggtgtaatcaatggtggctgggtcattggagtagatgaccttgattggggtgccgttggcccagatgatgttgttgtcataatcggtggtgatggtgccatcgaatccaccgtggacagaatcacgacgcagcaaggatgcgcgcttgaccaggtcttcttcaccatttttgcggaccacgatggcgcgcagacgagcaccgtcatacagtgcctcgcgggaaaccaggatgcgggccagcaggcgaccgatgcggccgaaaccgtacagcacgatatcagttgggttgatgtcggtttccgcaccaatgaccggcgcgagagcgtcctccaggaaggcacgcaggtcggtgctttcggattcttcgaagctgtaggccagctgtcccaggtcgatcgatgcggtaccaaggttcatatctaccagttcgcgcaaaatatccaaggagctttccagtggaagttccttggatatgatgtggcgggcgtagcggtgagacttgatgatatcgatgtctgagacattcacaaggagacgac

SEQ ID NO: 1472 - protein, 225 aa, Corynebacterium glutamicum
VVDAVHDVLQIALARRGEYNLGNALGLEVLGQAFAVTPAAGVVYHDGVIDAVFGVINGGWVIGVDDLDWGAVGPDDVVVIIGGDGAIESTVDRITTQQGCALDQVFFTIFADHDGAQTSTVIQCLAGNQDAGQQATDAAETVQHDISWVDVGFRTNDRRESVLQEGTQVGAFGFFEAVGQLSQVDRCGTKVHIYQFAQNIQGAFQWKFLGYDVAGVAVRLDDIDV

SEQ ID NO: 1473 - DNA, 300 bp, Corynebacterium glutamicum
  CDS (101)..(277): RXN03104
actgctgggagtagccgaagaggatggtggcgtcagtggtcagggcgtcaacgttgccctgggacagtgcctcaacacaggaagagtaggtgtcgtattcttggagctgaacgcctgggaggacatccttgaccttctgagctggagtggatccggaaacggagcacaggatcaaaccgttatccaagtcctcgagggtttcaatgcgatcgtcatcttggcgaacaagcagagcctggtgggtaagcaggtatgggccaccgaagttgacggactctgaacggccagcgttgatggagt

SEQ ID NO: 1474 - protein, 59 aa, Corynebacterium glutamicum
LELNAWEDILDLLSWSGSGNGAQDQTVIQVLEGFNAIVILANKQSLVGKQVWATEVDGL

SEQ ID NO: 1475 - DNA, 292 bp, Corynebacterium glutamicum
  CDS (101)..(292): RXN03106
aaatgccctcctgaactggaagaatcaagcttgcttagagtcctgattcacctgccagaaaggcacctcacaggtgcaattattacacaaccccacagcgatgtccgcatcctttgatgaccccaacctcatctcgcttgctggactggttccaaccatgcacttagccgatgctgccagcctgtccaccttggcccaggaccggttgagcatcaccggtgataaaggtgccaatgctggtgcgaagatcgcctccctagtcgcgggcatggtcgccggtgctgattccatc

SEQ ID NO: 1476 - protein, 64 aa, Corynebacterium glutamicum
MSASFDDPNLISLAGLVPTMHLADAASLSTLAQDRLSITGDKGANAGAKIASLVAGMVAGADSI

SEQ ID NO: 1477 - DNA, 324 bp, Corynebacterium glutamicum
  CDS (101)..(301): RXN03107
ggatttatatcaatttcagggcgtggcgagcttttagtgattcacgctcctacggtgggtatcacaaatacctcaactagaagtaggagatgagcaccacatgagcgatttttccaacaaggcagaggacctcacaggtaaggctaaagaaggattcggcgaggcaactgataacgagtccctcgctgatgagggccgtgcggatcaggctaaggcagacatcaaggatgctgtcgaaaacgccggtgaaaaggtaaaggacgcagctaacaaggttctgggtgcgttcaagaaggacgactaatcccgtacttgttcaggatt

SEQ ID NO: 1478 - protein, 67 aa, Corynebacterium glutamicum
MSDFSNKAEDLTGKAKEGFGEATDNESLADEGRADQAKADIKDAVENAGEKVKDAANKVLGAFKKDD

SEQ ID NO: 1479 - DNA, 1722 bp, Corynebacterium glutamicum
  CDS (101)..(1699): RXN03113
gttggatcttgcattgaaaaaatgaaaacctcgtcgggaatgcaacttgggatcacgtctcgggcaagaaacgtccttaaaaaaaggggagtgattgtgagtgcttgatttcttagctgcgaacccgctgattgcgctggtggttattttggccgttggtttagcaattggtcagattagggtctttggcctttctttaggtgccgccgcggtgctgtttgtggccctggtggtttcaactgcaaataccgacatcgtcatccccatgattgtttatcagctgggcttggcgatgttcgtttatgtcatcggtttgtccgccggaccagcatttttcagtgagttcgctaaaaagggctggaagctcaccatctttatgctcctgctgctggcaacactgattggtttggcgtgggtgcttattaagtcactggggcttgatgcagcgatcggtaccggtatgttcaccggcgcgctgacctcgactcccggtatggcagcggtcgtggaattgattgaaggaatcgatccaagccttgccagtgaacctgttattggttattccttggcatatccgggagccgtgctgggatccattgtggtggccgcggttggagcgaaactgctcaaagtaaatcaccgggaagatgctcgaaaagaaggcatgatcaccgcaccgctggtgtggaagggtgtgcagctcaaacctggaatcacaggcagggtgggagatcttccacgccttgcaggtgaaagtatcatcgcaacccgcattgtggatgatccacatacacaccgcctcgcggatccagatctgccgattactgaaggcatggaactgttgatcaacggcactgaagaagccgtggatcgggcaattaaggcgttgggtgaagaacgcgaaaccaaaattgaggacacagagctgatctacacccgcctgacggtatctagccctgaggttgcaggtagaaccgttgctgagcttgatactgtagctcacggattcatgattgcccgtatccgccagggcgattctgaggtagtgcctaaacctgacaccgtgatcaactactctgaccgcatccgcgtggtggttgctcctggtcgtgtggctgaagtgcgacgattcttaggggactctgaaaagtcccttgctgatgttaatctgctgcctttagccatcggattatctcttggcctgttgttgggcgcgatcccgattcctcttccaggcggcaccacgatgtcccttggctttggtggcggcccgattattgccggcctgattttgggagcactcaagcacacaggaccgctgacgtggcagatgccgttccacgccaaccgcacgatctccaccttgggcctggcgctgtttttggctggtgtgggtacctctgcaggtgcaggatttagagctgcgcttaccgattcctcctccttgatctacatggccggtggcttggtgatcaccttggcctctgcgctgctgtgtgctgtgatcggcatgtgggtactcaggttgaggtgggatgaagccatgggtgttgccgctggcaccaccacaaatcctgcaattatttcctatctgaatgggcaaaccggaacggatcttgccaacaggggatatgccactgtgtaccccacggcgatgatcggtaaaatcctcggcgcgcagatattgttcttgctgctctaaggtgatttttgggcagtggt

SEQ ID NO: 1480 - protein, 533 aa, Corynebacterium glutamicum
VLDFLAANPLIALVVILAVGLAIGQIRVFGLSLGAAAVLFVALVVSTANTDIVIPMIVYQLGLAMFVYVIGLSAGPAFFSEFAKKGWKLTIFMLLLLATLIGLAWVLIKSLGLDAAIGTGMFTGALTSTPGMAAVVELIEGIDPSLASEPVIGYSLAYPGAVLGSIVVAAVGAKLLKVNHREDARKEGMITAPLVWKGVQLKPGITGRVGDLPRLAGESIIATRIVDDPHTHRLADPDLPITEGMELLINGTEEAVDRAIKALGEERETKIEDTELIYTRLTVSSPEVAGRTVAELDTVAHGFMIARIRQGDSEVVPKPDTVINYSDRIRVVVAPGRVAEVRRFLGDSEKSLADVNLLPLAIGLSLGLLLGAIPIPLPGGTTMSLGFGGGPIIAGLILGALKHTGPLTWQMPFHANRTISTLGLALFLAGVGTSAGAGFRAALTDSSSLIYMAGGLVITLASALLCAVIGMWVLRLRWDEAMGVAAGTTTNPAIISYLNGQTGTDLANRGYATVYPTAMIGKILGAQILFLLL

SEQ ID NO: 1481 - DNA, 1441 bp, Corynebacterium glutamicum
  CDS (101)..(1441): FRXA00506
gttggatcttgcattgaaaaaatgaaaacctcgtcgggaatgcaacttgggatcacgtctcgggcaagaaacgtccttaaaaaaaggggagtgattgtgagtgcttgatttcttagctgcgaacccgctgattgcgctggtggttattttggccgttggtttagcaattggtcagattagggtctttggcctttctttaggtgccgccgcggtgctgtttgtggccctggtggtttcaactgcaaataccgacatcgtcatccccatgattgtttatcagctgggcttggcgatgttcgtttatgtcatcggtttgtccgccggaccagcatttttcagtgagttcgctaaaaagggctggaagctcaccatctttatgctcctgctgctggcaacactgattggtttggcgtgggtgcttattaagtcactggggcttgatgcagcgatcggtaccggtatgttcaccggcgcgctgacctcgactcccggtatggcagcggtcgtggaattgattgaaggaatcgatccaagccttgccagtgaacctgttattggttattccttggcatatccgggagccgtgctgggatccattgtggtggccgcggttggagcgaaactgctcaaagtaaatcaccgggaagatgctcgaaaagaaggcatgatcaccgcaccgctggtgtggaagggtgtgcagctcaaacctggaatcacaggcagggtgggagatcttccacgccttgcaggtgaaagtatcatcgcaacccgcattgtggatgatccacatacacaccgcctcgcggatccagatctgccgattactgaaggcatggaactgttgatcaacggcactgaagaagccgtggatcgggcaattaaggcgttgggtgaagaacgcgaaaccaaaattgaggacacagagctgatctacacccgcctgacggtatctagccctgaggttgcaggtagaaccgttgctgagcttgatactgtagctcacggattcatgattgcccgtatccgccagggcgattctgaggtagtgcctaaacctgacaccgtgatcaactactctgaccgcatccgcgtggtggttgctcctggtcgtgtggctgaagtgcgacgattcttaggggactctgaaaagtcccttgctgatgttaatctgctgcctttagccatcggattatctcttggcctgttgttgggcgcgatcccgattcctcttccaggcggcaccacgatgtcccttggctttggtggcggcccgattattgccggcctgattttgggagcactcaagcacacaggaccgctgacgtggcagatgccgttccacgccaaccgcacgatctccaccttgggcctggcgctgtttttggctggtgtgggtacctctgcaggtgcaggatttagagctgcgcttaccgattcctcc

SEQ ID NO: 1482 - protein, 447 aa, Corynebacterium glutamicum
VLDFLAANPLIALVVILAVGLAIGQIRVFGLSLGAAAVLFVALVVSTANTDIVIPMIVYQLGLAMFVYVIGLSAGPAFFSEFAKKGWKLTIFMLLLLATLIGLAWVLIKSLGLDAAIGTGMFTGALTSTPGMAAVVELIEGIDPSLASEPVIGYSLAYPGAVLGSIVVAAVGAKLLKVNHREDARKEGMITAPLVWKGVQLKPGITGRVGDLPRLAGESIIATRIVDDPHTHRLADPDLPITEGMELLINGTEEAVDRAIKALGEERETKIEDTELIYTRLTVSSPEVAGRTVAELDTVAHGFMIARIRQGDSEVVPKPDTVINYSDRIRVVVAPGRVAEVRRFLGDSEKSLADVNLLPLAIGLSLGLLLGAIPIPLPGGTTMSLGFGGGPIIAGLILGALKHTGPLTWQMPFHANRTISTLGLALFLAGVGTSAGAGFRAALTDSS

SEQ ID NO: 1483 - DNA, 522 bp, Corynebacterium glutamicum
  CDS (101)..(499): RXN03115
ggaactgctggcaggcaacgtccgtgatggcgatggtgtgcttgtcaacgtcgccgacggcggccagaagctcgacgtttccagggcggtctaacggctcgtgggcaagcaggaaaagctgcgcattcctctcgatgttccgggagtggaatcagaagaggtaggtgtagaactgcttgccgaaggctactacctggtagccactttgccggctgtcgcccaggactgtgccctgggtgacgtcgtgcgggcacatcatgttgatgaggtcttggaatttcaagaagtggcagttgctggcggaaacaaaaccctccgggtgctcgttgatgccatcgctgctgaccacgtgcgagcccaactagaaacacttgggctacacgtggaagctcccatgtcagaaatgctaactgtcaatattgcccccgattcaccgtcgcacggtttggagatcctgctcgatgatctgcatgctcagggggtaattttcagggcgttatagagcgcctaattgtagagagc

SEQ ID NO: 1484 - protein, 133 aa, Corynebacterium glutamicum
VGKQEKLRIPLDVPGVESEEVGVELLAEGYYLVATLPAVAQDCALGDVVRAHHVDEVLEFQEVAVAGGNKTLRVLVDAIAADHVRAQLETLGLHVEAPMSEMLTVNIAPDSPSHGLEILLDDLHAQGVIFRAL

SEQ ID NO: 1485 - DNA, 270 bp, Corynebacterium glutamicum
  CDS (101)..(247): RXN03122
atggaccatggcgggatgagtggaatgatgagcgaggaggacatgacagccctcgaggacgcccagggcacccgaggctgcccggctctaccttgagcagatgaccgcccaccatgagggcgcggtcgatatggcccgcgatgaggtcactgatggccagaacccgcaggccatcgctctggctgagcaggtcattgaagatcaggaggccgagatcgccgagatggagcatatgctcaacgagctctgaacaaggacattccccgacca

SEQ ID NO: 1486 - protein, 49 aa, Corynebacterium glutamicum
MTAHHEGAVDMARDEVTDGQNPQAIALAEQVIEDQEAEIAEMEHMLNEL

SEQ ID NO: 1487 - DNA, 474 bp, Corynebacterium glutamicum
  CDS (101)..(451): RXN03134
atgctgtttcatcgctggcgttggctttttcgagccattcgagctcttctccggggagatccagtttgctgatcagcgggtttgtttcgcgtggggcgtggtggcttggcgcgtcggcccaggttcccatgagcatgacatagttgggtcctccggctttggatccgaggccgacggaggattttttccagcctccgaaggattggcgttggacaatggcgccggtgatgccgcggttgacgtaggcgtttccgacatcgacgtggtcaagccaggtgcggacttcgtcggcgtcgagggattggagtccgccggtgagtccgaagtcgttgccgttttggaattcgatggcttcattgaggtcggtggctttcatcaggccgaggactggtccgaatacttctgtgaggtggaagaaggttcctggtttgacgccttctttgatgccgggtgaccagagtcggccggtgtcgt

SEQ ID NO: 1488 - protein, 117 aa, Corynebacterium glutamicum
VAWRVGPGSHEHDIVGSSGFGSEADGGFFPASEGLALDNGAGDAAVDVGVSDIDVVKPGADFVGVEGLESAGESEVVAVLEFDGFIEVGGFHQAEDWSEYFCEVEEGSWFDAFFDAG

SEQ ID NO: 1489 - DNA, 852 bp, Corynebacterium glutamicum
  CDS (101)..(829): RXN03135
ttagcttgtcgacgtccccctcttccaacacctccggctttgtttgtttttccaaccaaccgggctctgctgcggtggcgacggcttttgtggcccactgttggttttggatgagcgctgggttggtgtcgggctcgttgataaatgggacgaggggggcgtcgagaagcgtctctttgctgcggtcttgtgtgtggttggggccgggcgcgggcacgtcgatgagcgtggcgaggtcagatatggaggcgcggaagcggctctcctctcgcttgaaggacgggttgtcggcgtcgaggtcgaagatggcggacatgaagttttcgctcgcggcgttttcctcgaggcggcgcacgaggtaagaaatggccacgtcgaattcttgtgggcgcacggctggtacgtaaagcagcagctcaccgacgtcaacgctgacggcgcgcgcctgatcggacgccatgccctgcagcatttcgaactccacacggtccgctaccccacgctccacagagagcaaatgtgcgaatgctatgtcgaaaaggttgtggccggcaacgcccaggcgcaggccctccatgttttctttgcgcatcgtccaatagaggacgcgcttgtaattggcatcggtggcttgtttggaaggttctgtggcaactggccagccggtgatctgcgcgtggacgtgctccataggcaaattagcacccttgaccaggcgaaccttaacgcccgccccgcctgtgttgacgcgctcgcggccgaactgcgccaagtcctggattgcaccgagggcatcgggaaggtacgcctgcaacacaattccggcttctagttcatgcagctctggattgg

SEQ ID NO: 1490 - protein, 243 aa, Corynebacterium glutamicum
LVLDERWVGVGLVDKWDEGGVEKRLFAAVLCVVGAGRGHVDERGEVRYGGAEAALLSLEGRVVGVEVEDGGHEVFARGVFLEAAHEVRNGHVEFLWAHGWYVKQQLTDVNADGARLIGRHALQHFELHTVRYPTLHREQMCECYVEKVVAGNAQAQALHVFFAHRPIEDALVIGIGGLFGRFCGNWPAGDLRVDVLHRQISTLDQANLNARPACVDALAAELRQVLDCTEGIGKVRLQHNSGF

SEQ ID NO: 1491 - DNA, 852 bp, Corynebacterium glutamicum; identical to SEQ ID NO: 1489
  CDS (101)..(829): FRXA02285

SEQ ID NO: 1492 - protein, 243 aa, Corynebacterium glutamicum; identical to SEQ ID NO: 1490

SEQ ID NO: 1493 - DNA, 594 bp, Corynebacterium glutamicum
  CDS (101)..(571): RXN03138
agaatgttccagtcttggcatccaaccagccgattccgctggcccacactggggcgttggcgaggtctttggcggtgtacaagttgaggactaccttgacttggatattgttccgaaggatgtcgctgaaagcttcgccgtaggtgaggtcgtttttcttcgcgtgttgggtgacggcgtcgttgatgatgtgcccgtccacagcatcgacggaggctccgatttcggcggttccgtctggggagaaggtcactccgaaagagctgtcgtcttgggtaccgcgcgaaccggtggctcttgcgtcgtcaagcaaatctcttatttcttttatcttgcgtcctatggacgccgggcttggcagaatctggttggggctggtggcggtgaggtattcggtgaggattgcgtcggcgccggcgaggttgtcggggttgatgccggcgagttcgttgctaatggtgatcagtcgggagaggtcgaggtggtacagcttttgttgcagggctttgagttcgggcaagtcggcgagcgtggcaaacgcgatggatatgcgggagacctgcgcttttgttagacctgtgacgatggcgaggc

SEQ ID NO: 1494 - protein, 157 aa, Corynebacterium glutamicum
LDIVPKDVAESFAVGEVVFLRVLGDGVVDDVPVHSIDGGSDFGGSVWGEGHSERAVVLGTARTGGSCVVKQISYFFYLASYGRRAWQNLVGAGGGEVFGEDCVGAGEVVGVDAGEFVANGDQSGEVEVVQLLLQGFEFGQVGERGKRDGYAGDLRFC

SEQ ID NO: 1495 - DNA, 372 bp, Corynebacterium glutamicum
  CDS (101)..(349): RXN03140
ctcaagcgatcggtggaacatccactaacggggttaccaaaaatccttcgcggacactcccgaaggaacacttcttgcgagaaggaaaggaagaagcactgtgaagggcattcatcaggaaattagccgtatcgagcgtagccacgattatctgtggagcgtccgagaagacctgcatgcacgattcgacaaccaactgaaggcacactttgtagacagtgtcctggatagcattgcagaaggatatgaaggccgaatcaaccgattccgcaaaatcttcattgaaatgaaagcggttgaagagctgcgcaccatcgccgccacccgcccaagccacctcttggctgcataagacacttaaaagttaaataa

SEQ ID NO: 1496 - protein, 83 aa, Corynebacterium glutamicum
VKGIHQEISRIERSHDYLWSVREDLHARFDNQLKAHFVDSVLDSIAEGYEGRINRFRKIFIEMKAVEELRTIAATRPSHLLAA

SEQ ID NO: 1497 - DNA, 453 bp, Corynebacterium glutamicum
  CDS (101)..(430): RXN03141
ggccctgctgcttcatgcggtgagctgcgcgaccgaaagcgatctgtgaggaagcggtgaaatctgggtttcggtccagcttgaggatgtattccacggtgtggttgaagccaccggtgtcgccggtggtaatcacgtggccaccgtgtggcatgccggtgtgctcggagtcgaaggttgcttcgtcgatgaagttgacttcgacttcgtagccaacgaagtaatcaggcatggtgcggatgtcgttttcgatgcgctcgtgatcggccgcgtcggcaaccacgaagcattggcgcttgtgggtttgctttccggtaaggtcgccggcttcgccgcggcgggccttttccagggcgtcttcggatgggagggtgtactggactgccttttgaacgccagggatgcgtcgcaaagcatcggagtggccctgtgacaaacctgggccccagaagg

SEQ ID NO: 1498 - protein, 110 aa, Corynebacterium glutamicum
VVEATGVAGGNHVATVWHAGVLGVEGCFVDEVDFDFVANEVIRHGADVVFDALVIGRVGNHEALALVGLLSGKVAGFAAAGLFQGVFGWEGVLDCLLNARDASQSIGVAL

SEQ ID NO: 1499 - DNA, 594 bp, Corynebacterium glutamicum
  CDS (101)..(571): RXN03146
taacgtgggggttttaagcttgcgtagacatatcgtttttcgatagatttacatcttgaaacgatacgcccatccacggcgcatgtctgaaaggttccccatgaatccccgcatcctcatgctgcttcgcatcattttcggcgcggccttcctcgcactgttggtgctgcaagtcctgctcgccatcaaaatcgtgcgcgatggcctcaactccggcgagctctcccccatcccgctcaccattctcgcgagcttcgtgatcatcggtttcgggctcgtgcagttcatcatcgtctgtctgttcgcgctactgcgtctcgtggaagacgatgaaatcttcgacgcccactcgctcgcctgggttgatcgaattgccatcaccatcgcagccggcgccgttttactcctcccaatggcctacatcgtcgcagaagtcgacgacgcccccggagccatcgtcttcggtctcatcctcgcgatgctcatcacgggcgtatccctgctggtaaaaatcatgcgcgcactcctggcccgcgccatcggattctccacggaactggaatcggtgatctaaatggccatcatcgtcgacat

SEQ ID NO: 1500 - protein, 157 aa, Corynebacterium glutamicum
MNPRILMLLRIIFGAAFLALLVLQVLLAIKIVRDGLNSGELSPIPLTILASFVIIGFGLVQFIIVCLFALLRLVEDDEIFDAHSLAWVDRIAITIAAGAVLLLPMAYIVAEVDDAPGAIVFGLILAMLITGVSLLVKIMRALLARAIGFSTELESVI

SEQ ID NO: 1501 - DNA, 375 bp, Corynebacterium glutamicum
  CDS (101)..(352): RXN03147
ccctgatcccgaggacgatgaccgccaaagcgatggcgcctccaatcaggatgtactgcagtgggattgggcgggcgtcatcgatggcatcgatgcagttttggaaatcctctttaagagcggtttgggattcgttgtaatcatcggtgcggtcggcgaatacttcggcgcggatttctgcggtgcgggtgccggtggtggcggcttgttgaagttggctgagtacatcgctggctggatcgctggagaatccgctgatgatgtctttggcttcgtcgtatgtgtactccgttttgaaactttcctcggcgttggggtctgccagcgtgggatcgtctgggaggagcatggctaggccttcgccggattcgatgg

SEQ ID NO: 1502 - protein, 84 aa, Corynebacterium glutamicum
LEILFKSGLGFVVIIGAVGEYFGADFCGAGAGGGGLLKLAEYIAGWIAGESADDVFGFVVCVLRFETFLGVGVCQRGIVWEEHG

SEQ ID NO: 1503 - DNA, 390 bp, Corynebacterium glutamicum
  CDS (101)..(367): RXN03149
gctttactagaaccagtgatcggtaaactaccttttagttcggctattagcagtacaatctctgtggcgctgggatttattttagttaccgtatatcgatgtggttattggcgaactgcttcctaagagctatagtatcgtcaatacggagaaggtcgtcttgttcgtagttaaaccacttcattatttttataaagtaatgtttccttttatttgggtattgaatcattcagctgcagggctagggaagctattaggtgtgcgtctcgtatctgaaggagaagagacattgtctcaagaagagctgacattagtcgcattgaattcttatgaaaaaggagagttgccaaagaagaatatcattatttgaaaacgtgtttgaatttgatg

SEQ ID NO: 1504 - protein, 89 aa, Corynebacterium glutamicum
VVIGELLPKSYSIVNTEKVVLFVVKPLHYFYKVMFPFIWVLNHSAAGLGKLLGVRLVSEGEETLSQEELTLVALNSYEKGELPKKNIII

SEQ ID NO: 1505 - DNA, 396 bp, Corynebacterium glutamicum
  CDS (101)..(373): RXN03152
gcaaaatatcagctttgacctgcacatatagttgcacaatggtgaaagtgcacataaagtaactttcgtattcgaatatttaaacctaaggggtttagcaatgaagctattttctcgtactcccctcgtcgcactcggcacagctgctgcaatggcagcaacctccatctccgttcctgcacaggctgaagaagtcgcaccagcacaggttgtgtacgtggctgacaccgtagaagaagaaacgggtagctccaacggatcttctgacattgactctgacaccattttggattacgtcgtcgttattactggcatcgttggcgtcctcagcgctggtttgaccttcgctactgctttccagcgttcattgcagtaaatttcagcgttaatcaccaa

SEQ ID NO: 1506 - protein, 91 aa, Corynebacterium glutamicum
MKLFSRTPLVALGTAAAMAATSISVPAQAEEVAPAQVVYVADTVEEETGSSNGSSDIDSDTILDYVVVITGIVGVLSAGLTFATAFQRSLQ

SEQ ID NO: 1507 - DNA, 687 bp, Corynebacterium glutamicum
  CDS (101)..(664): RXN03153
taatttgaattttagggaacctaccccgagcttttgcagtctaacgcttatgagtgccttttcacggccctcgttacgactacaaagatcggggtattttatgcgacgaatctggctgctcgtatgcggcatcgcattgactgtcgccggctgcacgagtggatccaccactcccacaaccgtcacggtaaccgcaacgccaacgtcggaggaggctgcatccacggagccgaccaacgacatacttgccagccaatttcatccgtgtgaagtactcacgcaggaacagttcgaagaagtcggattgggagtcttgattgttgaagacgcttacctcggctcgacaggtttaggttgcagtttcgggaaagcagacagagaggatttttcaggtacgtggctcatttcaactgaccaagcaaaccgacaatttgttgaaaaccaagatctagagacattggattggggatccaatgacaatccagatctgtatgtgcatcaaatgtccgagacgggtcgtcaatgtgaggcagcagttgactatgactggggccggcttacggttgactatctcgaattaggtgagggctgggagccagaaattttgtgctctgatgctgttgaaattttagaaaatctcatcaaggaactaaggggaattccatgacattgaaaattgatccctcg

SEQ ID NO: 1508 - protein, 188 aa, Corynebacterium glutamicum
MRRIWLLVCGIALTVAGCTSGSTTPTTVTVTATPTSEEAASTEPTNDILASQFHPCEVLTQEQFEEVGLGVLIVEDAYLGSTGLGCSFGKADREDFSGTWLISTDQANRQFVENQDLETLDWGSNDNPDLYVHQMSETGRQCEAAVDYDWGRLTVDYLELGEGWEPEILCSDAVEILENLIKELRGIP

SEQ ID NO: 1509 - DNA, 1035 bp, Corynebacterium glutamicum
  CDS (101)..(1012): RXN03154
aaagtgccctctcctaaatcgtttctaagggctcgtcagaccccagttgatacaaacatacattctgaaaattcagtcgcttaaatgggcgcagcgggaaatgctgaaaactacattaatcaccgataccctagggcacgtgacctctactgaacccaccaccacagcccatgttccactacctgatggatcttccactccagtccaaatttgggcgtcagataacaaagactcccaactggtgatgctgtggccaggtttcggcatgggtggctattactatcgtccgcttgcggcagcgctaaataaagctggattccatgtggcgattggtgaacttcgtggtcaggggcaaagttccgcgaaggcttctcggaaaagtcagtggggataccatgatctcgcatcggtagattttccgctgcagattgccgctgcgaaaaaggcgcttgacctggaggaaggccatcccatgaggtttttgtcgcattcgatgggtgggcagatttcttgtcttttcgcagcgaggccggaggctgagaaatataatcttcgggcgattttcggggtgggtgcagggtcgccgtttaggcctacgtttagtccgaaaatggggaagcgtttgggattgggtgcggtgctgcttggtgggattggtggccacattgtgggattttggcccggcaaagttttaggaaaagacctggtgggttatggccgacaatcgggaactcacatgagggaatggcgtcgattccataagcacaattctttggacgatctcaccgcgcaggacatcaactatgtggaggtgatgaagaaggtgagcattcctattacttttagtcgttgtcctgatgatgaggactgcccgcaggcatcgattgatgggttggcgagttttgttcccgcagcgcagatcaaaatgatagaaattccagaagccctgggacataaccggtgggctcgggaacctgaatcaacagtgaaactcttcctggaacaagctctttagtgaccgatggagcggaggta

SEQ ID NO: 1510 - protein, 304 aa, Corynebacterium glutamicum
MLKTTLITDTLGHVTSTEPTTTAHVPLPDGSSTPVQIWASDNKDSQLVMLWPGFGMGGYYYRPLAAALNKAGFHVAIGELRGQGQSSAKASRKSQWGYHDLASVDFPLQIAAAKKALDLEEGHPMRFLSHSMGGQISCLFAARPEAEKYNLRAIFGVGAGSPFRPTFSPKMGKRLGLGAVLLGGIGGHIVGFWPGKVLGKDLVGYGRQSGTHMREWRRFHKHNSLDDLTAQDINYVEVMKKVSIPITFSRCPDDEDCPQASIDGLASFVPAAQIKMIEIPEALGHNRWAREPESTVKLFLEQAL

SEQ ID NO: 1511 - DNA, 303 bp, Corynebacterium glutamicum
  CDS (101)..(280): RXN03156
gtatcgacctcgatgatcgcgttgctgcagagatgaccattttaggtcgccctgtgcctaaagaaggataaccaccacaccagaaaagaagtacctcattatggctcgaaccacacctccaccagctgatgtactcgacatcatcatttccaccgtgaagcagaccatcggcattgatcttgctgaactgattcagggccgtgcactcggccaggctcaaggtgaggcacaaggcaaagctagtgcagcagcccttgagcaggcacctcataatgagcagtaaataacacacaccacatgtgc

SEQ ID NO: 1512 - protein, 60 aa, Corynebacterium glutamicum
MARTTPPPADVLDIIISTVKQTIGIDLAELIQGRALGQAQGEAQGKASAAALEQAPHNEQ

SEQ ID NO: 1513 - DNA, 182 bp, Corynebacterium glutamicum
  CDS (1)..(159): FRXA00176
cagctgatgtactcgacatcatcatttaccaccgtgaagcagaccatcggcattgatcttgctgaactgattcagggccgtgcactcggccaggctcaaggtgaggcacaaggcaaagctagtgcagcagcccttgagcaggcacctcataatgagcagtaaataacacacaccacatgtgc

SEQ ID NO: 1514 - protein, 53 aa, Corynebacterium glutamicum
QLMYSTSSFTTVKQTIGIDLAELIQGRALGQAQGEAQGKASAAALEQAPHNEQ

SEQ ID NO: 1515 - DNA, 519 bp, Corynebacterium glutamicum
  CDS (101)..(496): RXN03162
ggtcaatcagttcctgccactgctctggcttgtcgtaggtgtacttcgcgccggagaacagggttgcggagaagttgtcgccgccttctgctggcttcttgtgcacgacgaacactgggtgtggtccgacgagaaggatgcggatttcgccttcgacgatgcgtggcatgaaacgcatatcaacgagcatgccgttgtcgccgatgatgtactggtcacagaaatccatgaactcgccgagcttgcggacttcagtgtggttgtcgactgcttcggtgcacttgatttcagtgtccaatggcagtgcggtgcctggctcgatggatgcagccagttccttgtctaccaactggacgcgccaaatgccggagccggtggagccacggttttgcttgagcacgcgctcaccgaaggacagggaggttgggaaaaccttgtggaaggtctccacgtcgtagtacgcctcggtgtcggatggcaccaggtcggtttgggatagcttgaccagcgcatctttcg

SEQ ID NO: 1516 - protein, 132 aa, Corynebacterium glutamicum
VHDEHWVWSDEKDADFAFDDAWHETHINEHAVVADDVLVTEIHELAELADFSVVVDCFGALDFSVQWQCGAWLDGCSQFLVYQLDAPNAGAGGATVLLEHALTEGQGGWENLVEGLHVVVRLGVGWHQVGLG

SEQ ID NO: 1517 - DNA, 730 bp, Corynebacterium glutamicum
  CDS (101)..(730): RXN03167
gccgcgactgcgggtgcttttgcgctgttgcgtaaaaaatagtttttattaagggcattccctgattcccaggtggtgccacattgtttatggtggagatatgaacacgaacttgccgaacctatacaccgcatttgaccttgatcgaagtgaatcctccgaagctttaggtgtttccctttctgcccgcgatcttcgcttagaacaaatgggaattgcccaggacgatcctcgacgtgcccaaaccgtccaagctttcgcagtgcttgcagacccagcaaaacgcgccacctacgatgctcaattagaagctggagttccactcacctgggcgcagattcagcatttaggaaacttcggcaccttgccttccacccctactgcgcagccgtttgcggcacctcagccggagccgtcgccggaaccgcaacagcagtggaatagcggacaaaactatgcgtatggcaatccgaccatggattaccaaactcagcagagctacaacccgatgcaggaccaaacccaagcgtcgatgtatgcgcaacctttcgcgaacacccctgcaccgatgtacaacagcaatcaggtttttaacaggcctactgcgggtacgcgtttgtggatggcgatcctcgacagtatttttgccggcatcgctggtggaattgtctccggtattttcggctttggatctgaattcctcaccagtgtcatcatgattttggtgctg

SEQ ID NO: 1518 - protein, 210 aa, Corynebacterium glutamicum
MNTNLPNLYTAFDLDRSESSEALGVSLSARDLRLEQMGIAQDDPRRAQTVQAFAVLADPAKRATYDAQLEAGVPLTWAQIQHLGNFGTLPSTPTAQPFAAPQPEPSPEPQQQWNSGQNYAYGNPTMDYQTQQSYNPMQDQTQASMYAQPFANTPAPMYNSNQVFNRPTAGTRLWMAILDSIFAGIAGGIVSGIFGFGSEFLTSVIMILVL

SEQ ID NO: 1519 - DNA, 736 bp, Corynebacterium glutamicum
  CDS (101)..(736): FRXA02862
gccgcgactgcgggtgcttttgcgctgttgcgtaaaaaatagtttttattaagggcattccctgattcccaggtggtgccacattgtttatggtggagatatgaacacgaacttgccgaacctatacaccgcatttgaccttgatcgaagtgaatcctccgaagctttaggtgtttccctttctgcccgcgatcttcgcttagaacaaatgggaattgcccaggacgatcctcgacgtgcccaaaccgtccaagctttcgcagtgcttgcagacccagcaaaacgcgccacctacgatgctcaattagaagctggagttccactcacctgggcgcagattcagcatttaggaaacttcggcaccttgccttccacccctactgcgcagccgtttgcggcacctcagccggagccgtcgccggaaccgcaacagcagtggaatagcggacaaaactatgcgtatggcaatccgaccatggattaccaaactcagcagagctacaacccgatgcaggaccaaacccaagcgtcgatgtatgcgcaacctttcgcgaacacccctgcaccgatgtacaacagcaatcaggtttttaacaggcctactgcgggtacgcgtttgtggatggcgatcctcgacagtatttttgccggcatcgctggtggaattgtctccggtattttcggctttggatctgaattcctcaccagtgtcatcatgattttggtgctgatcgtc

SEQ ID NO: 1520 - protein, 212 aa, Corynebacterium glutamicum
MNTNLPNLYTAFDLDRSESSEALGVSLSARDLRLEQMGIAQDDPRRAQTVQAFAVLADPAKRATYDAQLEAGVPLTWAQIQHLGNFGTLPSTPTAQPFAAPQPEPSPEPQQQWNSGQNYAYGNPTMDYQTQQSYNPMQDQTQASMYAQPFANTPAPMYNSNQVFNRPTAGTRLWMAILDSIFAGIAGGIVSGIFGFGSEFLTSVIMILVLIV

SEQ ID NO: 1521 - DNA, 372 bp, Corynebacterium glutamicum
  CDS (101)..(349): RXN03170
gttaaatcattgccgcccagaagaagaccgcgcgggcgaatttgggcttggagggaaccaaacggccacttttccagtccaacaaagtatgaggattaatttgccccacgccaaagagctcgcccacgagctgtgtttgttgcccacccctgctgtgcccgcgcttcccactgattctggcgcgcagtttgatatccaccaggcactatccgcctcccttgccacctatgcccgcaacctcaccttgctgtcccacaccgccgagaatttaggaaaccgcgcgctgacgggcctcgctgaaatcgaagacaccgacgaccaactcgcacacgcattggagcgcctgacatgatcggtctgatcagcgccctt

SEQ ID NO: 1522 - protein, 83 aa, Corynebacterium glutamicum
LPHAKELAHELCLLPTPAVPALPTDSGAQFDIHQALSASLATYARNLTLLSHTAENLGNRALTGLAEIEDTDDQLAHALERLT

SEQ ID NO: 1523 - DNA, 372 bp, Corynebacterium glutamicum; identical to SEQ ID NO: 1521
  CDS (101)..(349): FRXA02856

SEQ ID NO: 1524 - protein, 83 aa, Corynebacterium glutamicum; identical to SEQ ID NO: 1522

SEQ ID NO: 1525 - DNA, 1049 bp, Corynebacterium glutamicum
  CDS (1)..(1026): RXN03172
ccagagtggaagaaattcaactccggcgacgcagcccgcgttgtcccagacgccaacgcagagctcgacatcatcggcgcaccagcacttcttgccgatcgcccctcctacgcaaacgtcaaaaccctctcccgcatcttcgctgtcatgcgcagcctcggccacgtcaccgctgcctccccagtcaccgtgttcttctcctcccactccgtgctcagcaacgttgaccgcggatccgagcactactccggacccaacggcctgggcgaatggacctccgttggtcgcgcagtagccaccaactggaacggcgttgtcgacgccctcgacgaagccatcaccgtcaaggaagtaaacagcctctttaccgaagacgccgcaacccgcattcaagaagcacaagcagctgttcaggcagctcgcgaggctgaagagcaaatcgccaaggaagaagccgaaaaggtcgacccttacgacaactccccatgggctgcagcaggcatcgaccccatcaaggtctccatcgacggacgcaccatctacaccctgcgcacctacctcggcggacagccagtattcctcggaaaattcggcgaaatctccaccttcaacagccaaaaatccctcctgcgctggctcgtcgaacacgatgaccacgacctcgcccgcgcctccacctggagcgacctcatgctcggcatcaacgccggtgaaaccgaactcctcgtccacagcgacaacgtctactccttcaacggcctggtcaaagacatcaacacctccgtcgacgccgtagacacccaacaaatggcccgcgcctacgaactcatggcagacaccgccgactgggccgacgacgactccatgaattcctacttcctggccaacccacgcatgcaggactacatctcctacatgctcggcggcagcgacacctccggatatgtccctcacgcaccattcaacgaccactctgagagctggcgcgagctggaggagatgctgatcaagcgattcagcaagttctaggtcgcctatttggggttcgt

SEQ ID NO: 1526 - protein, 342 aa, Corynebacterium glutamicum
PEWKKFNSGDAARVVPDANAELDIIGAPALLADRPSYANVKTLSRIFAVMRSLGHVTAASPVTVFFSSHSVLSNVDRGSEHYSGPNGLGEWTSVGRAVATNWNGVVDALDEAITVKEVNSLFTEDAATRIQEAQAAVQAAREAEEQIAKEEAEKVDPYDNSPWAAAGIDPIKVSIDGRTIYTLRTYLGGQPVFLGKFGEISTFNSQKSLLRWLVEHDDHDLARASTWSDLMLGINAGETELLVHSDNVYSFNGLVKDINTSVDAVDTQQMARAYELMADTADWADDDSMNSYFLANPRMQDYISYMLGGSDTSGYVPHAPFNDHSESWRELEEMLIKRFSKF

SEQ ID NO: 1527 - DNA, 1049 bp, Corynebacterium glutamicum
  CDS (1)..(1026): FRXA02858
ccagagtggaagaaattcaactccggcgacgcagcccgcgttgtcccagacgccaacgcagagctcgacatcatcggcgcaccagcacttcttgccgatcgcccctcctacgcaaacgtcaaaaccctctcccgcatcttcgctgtcatgcgcagcctcggccacgtcaccgctgcctccccagtcaccgtgttcttctcctcccactccgtgctcagcaacgttgaccgcggatccgagcactactccggacccaacggcctgggcgaatggacctccgttggtcgcgcagtagccaccaactggaacggcgttgtcgacgccctcgacgaagccatcaccgtcaaggaagtaaacagcctctttaccgaagacgccgcaacccgcattcaagaagcacaagcagctgttcaggcagctcgcgaggctgaagagcaaatcgccaaggaagaagccgaaaaggtcgacccttacgacaactccccatgggctgcagcaggcatcgaccccatcaaggtctccatcgacggacgcaccatctacaccctgcgcacctacctcggcggacagccagtattcctcggaaaattcggcgaaatcttcaccttcaacagccaaaaatccctcctgcgctggctcgtcgaacacgatgaccacgacctcgcccgcgcctccacctggagcgacctcatgctcggcatcaacgccggtgaaaccgaactcctcgtccacagcgacaacgtctactccttcaacggcctggtcaaagacatcaacacctccgtcgacgccgtagacacccaacaaatggcccgcgcctacgaactcatggcagacaccgccgactgggccgacgacgactccatgaattcctacttcctggccaacccacgcatgcaggactacatctcctacatgctcggcggcagcgacacctccggatatgtccctcacgcaccattcaacgaccactctgagagctggcgcgagctggaggagatgctgatcaagcgattcagcaagttctaggtcgcctatttggggttcgt

SEQ ID NO: 1528 - protein, 342 aa, Corynebacterium glutamicum
PEWKKFNSGDAARVVPDANAELDIIGAPALLADRPSYANVKTLSRIFAVMRSLGHVTAASPVTVFFSSHSVLSNVDRGSEHYSGPNGLGEWTSVGRAVATNWNGVVDALDEAITVKEVNSLFTEDAATRIQEAQAAVQAAREAEEQIAKEEAEKVDPYDNSPWAAAGIDPIKVSIDGRTIYTLRTYLGGQPVFLGKFGEIFTFNSQKSLLRWLVEHDDHDLARASTWSDLMLGINAGETELLVHSDNVYSFNGLVKDINTSVDAVDTQQMARAYELMADTADWADDDSMNSYFLANPRMQDYISYMLGGSDTSGYVPHAPFNDHSESWRELEEMLIKRFSKF

SEQ ID NO: 1529 - DNA, 1121 bp, Corynebacterium glutamicum
  CDS (1)..(1098): RXN03173
ctcaaccgcgacacccatcacctgtgggtcgtcttaaccaccgactccgacgacttcgacgcagactcctttaccaccgaagtcatccggatcaccggctactcccgccacgaagtcaacaacggccttaacgccatggccgcgatgaccaacctcccacacctgcgcgccatccaagaacgctactacttcctgagcatccgctacctcgcctccatcatgatcgccgtggccaaagcagaccccaccctgtgggaagaactcgacctgcgcatcaccgacgccttaacaccagtcaccgcaggggaagtcatgatccaatcctccaccctgtccaaacgcatcgccgcctggatcaaagaactcgaccccgaacccacaccagagcccacaccgaaagaggactatgttcacgtccacaccactgatgaggcgacctatgtccgcatcaaaatcagcggccccaaccgcctgatcctcaatgacatcatcacccaactcaaagacacagacaccgaggacagcctgcctgaagcgctcatggcgttcctgacagagaaaatccagttaaagatcaccaaatacctcttcaccccacataagcaccctgagcaggtgtggtcaccggactacggtgacattgatcccgaagcctatgccaacgccaccctcgtgtgcgccaaggacttagatgagctcgctggagccacggagaagagctacaccccgagtgagaagatgaaagccctgatcagagctcgggatgggcattgccgcttcccagggtgttgcgttccggcgagtaagtgccaggtcgatcacattatcccgtgggcggagggcggcccgacagcggcgtggaacctgcagttgttgtgccagcggcatcacaatatgaaaaccgatggtcgctttactgctgatgctaatggattggcggagattagatggattgggccgatggatgtaccagcggtgaccaggccgacgggtccgttggtgaaagcgatgccgcgggggatttggggtcaggtgttgagggatcggatccaggctaggtttgagcggatccgcgaccgcgccctcaacaaagaagactagaagcgcacaggtttttgcat

SEQ ID NO: 1530 - protein, 366 aa, Corynebacterium glutamicum
LNRDTHHLWVVLTTDSDDFDADSFTTEVIRITGYSRHEVNNGLNAMAAMTNLPHLRAIQERYYFLSIRYLASIMIAVAKADPTLWEELDLRITDALTPVTAGEVMIQSSTLSKRIAAWIKELDPEPTPEPTPKEDYVHVHTTDEATYVRIKISGPNRLILNDIITQLKDTDTEDSLPEALMAFLTEKIQLKITKYLFTPHKHPEQVWSPDYGDIDPEAYANATLVCAKDLDELAGATEKSYTPSEKMKALIRARDGHCRFPGCCVPASKCQVDHIIPWAEGGPTAAWNLQLLCQRHHNMKTDGRFTADANGLAEIRWIGPMDVPAVTRPTGPLVKAMPRGIWGQVLRDRIQARFERIRDRALNKED

SEQ ID NO: 1531 - DNA, 503 bp, Corynebacterium glutamicum
  CDS (1)..(480): FRXA02874
  misc_feature (347, 356): n = a, c, t, or g
  VARIANT (116, 119): Xaa = Leu, Pro, Gln, or Arg
accgaactcaaccgcgacacccatcacctgtgggtcgtcttaaccaccgactccgacgacttcgacgcagactcctttaccaccgaagtcatccggatcaccggctactcccgccacgaagtcaacaacggccttaacgccatggccgcgatgaccaacctcccacacctgcgcgccatccaagaacgctactacttcctgagcatccgctacctcgcctccatcatgatcgccgtggccaaagcagaccccaccctgtgggaagaactcgacctgcgcatcaccgacgccttaacaccagtcaccgcaggggaagtcatgatccaatcctccaccctgtccaaacngcatcgccngcctggatcaaagaactcgaccccgaacccacaccagagcccacaccgaaagaggactatgttcacgtccacaccactgatgaggcgacctatgtccgcatcaaaatcagcggccccaaccgcctgatcctcaatgacatcatcacc

SEQ ID NO: 1532 - protein, 160 aa, Corynebacterium glutamicum
  VARIANT (116, 119): Xaa = Leu, Pro, Gln, or Arg
TELNRDTHHLWVVLTTDSDDFDADSFTTEVIRITGYSRHEVNNGLNAMAAMTNLPHLRAIQERYYFLSIRYLASIMIAVAKADPTLWEELDLRITDALTPVTAGEVMIQSSTLSKXHRXPGSKNSTPNPHQSPHRKRTMFTSTPLMRRPMSASKSAAPTA

SEQ ID NO: 1533 - DNA, 556 bp, Corynebacterium glutamicum
  CDS (101)..(556): RXN03174
gcgatgctcgaacgcgcagaacgctcctgggtagacaaagccgctgcatacgatttgcgctggtcagatcactcaccactgaacgtgatctactcctaaaatgctgctgacaattctatgggccatcggcatcaccgccgaaggcatgacaggcgcgctggccgcaggccgacaaaaaatggatctcttcggagtatccgtcatcgcatgcgttaccgcgatcggcggcggatccatccgcgacatgctgctgggacattacccgctggtgtgggtggaaaagccactgtatctactgctgatcattggcgcagccattttgacagtgtccatttccttcctgatggagcacttccgtgtgttgttcctcgtgctcgacgccgtgggtctttctgcattcgctgtgatcggcacacaaatcgcactggaaatgggctacggattcatcatcgcagtagtggcatcagtgctcacaggtgtattcggcggcgtcatgcgtgaccttttgtgtgaccgcatcccactggtatttcaaaaagagctctacgcatcaatc

SEQ ID NO: 1534 - protein, 152 aa, Corynebacterium glutamicum
MLLTILWAIGITAEGMTGALAAGRQKMDLFGVSVIACVTAIGGGSIRDMLLGHYPLVWVEKPLYLLLIIGAAILTVSISFLMEHFRVLFLVLDAVGLSAFAVIGTQIALEMGYGFIIAVVASVLTGVFGGVMRDLLCDRIPLVFQKELYASI

SEQ ID NO: 1535 - DNA, 562 bp, Corynebacterium glutamicum
  CDS (101)..(562): FRXA02884
gcgatgctcgaacgcgcagaacgctcctgggtagacaaagccgctgcatacgatttgcgctggtcagatcactcaccactgaacgtgatctactcctaaaatgctgctgacaattctatgggccatcggcatcaccgccgaaggcatgacaggcgcgctggccgcaggccgacaaaaaatggatctcttcggagtatccgtcatcgcatgcgttaccgcgatcggcggcggatccatccgcgacatgctgctgggacattacccgctggtgtgggtggaaaagccactgtatctactgctgatcattggcgcagccattttgacagtgtccatttccttcctgatggagcacttccgtgtgttgttcctcgtgctcgacgccgtgggtctttctgcattcgctgtgatcggcacacaaatcgcactggaaatgggctacggattcatcatcgcagtagtggcatcagtgctcacaggtgtattcggcggcgtcatgcgtgaccttttgtgtgaccgcatcccactggtatttcaaaaagagctctacgcatcaatcgcattc

SEQ ID NO: 1536 - protein, 154 aa, Corynebacterium glutamicum
MLLTILWAIGITAEGMTGALAAGRQKMDLFGVSVIACVTAIGGGSIRDMLLGHYPLVWVEKPLYLLLIIGAAILTVSISFLMEHFRVLFLVLDAVGLSAFAVIGTQIALEMGYGFIIAVVASVLTGVFGGVMRDLLCDRIPLVFQKELYASIAF

SEQ ID NO: 1537 - DNA, 781 bp, Corynebacterium glutamicum
  CDS (93)..(758): RXN03177
ctgcccgatttatgttttccgacggcaccatctgcaaagaacgagtgtgaccggtagctttatgggctgaacaattctaaggagaattatccgtgaaaaagaagcttatgttgcctttgattgttgcagctttggggttaagtgcctgcagctccgaacctgcagcagccccactcgaagcagagccattacataacctgctcattgatggttcagagtccggcttggacaatgccactgaaggaaacgacacctcattaagtggccaacccatcaatcttacagtggtcaacggtgccttagatatcgatggctcctgcggaaaagccctccaagctgtagaggacgtcaatctggacagcgtagctagcgcatccagggcactggcatccggcgacaaacaagtaggcatcgccatgtactcaaccgccgaagacaacgacatctcaccaatggacctctacgcagacatcgcgaatgcttgcgaagaccccgtcgtcgattcttccgacaccacctacaccttcggcaaactcgatgatgctcccgacggcgccgttggattcaccctcgacattgaagtcacccctgacaatcaaggctccaccgtgatgatgatccaagaattaggaaaccaccacatcatcgtcgcaggacttgaaaccaccccagaagaaaccgccactgtcttcgaagcacaacgcaccaaactcgaagaaggcttgcagcttaaacagaattggcagcttgggtgggtttaaatgcgcccaacctaagaaaa

SEQ ID NO: 1538 - protein, 222 aa, Corynebacterium glutamicum
VKKKLMLPLIVAALGLSACSSEPAAAPLEAEPLHNLLIDGSESGLDNATEGNDTSLSGQPINLTVVNGALDIDGSCGKALQAVEDVNLDSVASASRALASGDKQVGIAMYSTAEDNDISPMDLYADIANACEDPVVDSSDTTYTFGKLDDAPDGAVGFTLDIEVTPDNQGSTVMMIQELGNHHIIVAGLETTPEETATVFEAQRTKLEEGLQLKQNWQLGWV

SEQ ID NO: 1539 - DNA, 782 bp, Corynebacterium glutamicum
  CDS (94)..(759): FRXA02881
ctgcccgatttcatgttttccgacggcaccatctgcaaagaacgagtgtgaccggtagctttatgggctgaacaattctaaggagaattatccgtgaaaaagaagcttatgttgcctttgattgttgcagctttggggttaagtgcctgcagctccgaacctgcagcagccccactcgaagcagagccattacataacctgctcattgatggttcagagtccggcttggacaatgccactgaaggaaacgacacctcattaagtggccaacccatcaatcttacagtggtcaacggtgccttagatatcgatggctcctgcggaaaagccctccaagctgtagaggacgtcaatctggacagcgtagctagcgcatccagggcactggcatccggcgacaaacaagtaggcatcgccatgtactcaaccgccgaagacaacgacatctcaccaatggacctctacgcagacatcgcgaatgcttgcgaagaccccgtcgtcgattcttccgacaccacctacaccttcggcaaactcgatgatgctcccgacggcgccgttggattcaccctcgacattgaagtcacccctgacaatcaaggctccaccgtgatgatgatccaagaattaggaaaccaccacatcatcgtcgcaggacttgaaaccaccccagaagaaaccgccactgtcttcgaagcacaacgcaccaaactcgaagaaggcttgcagcttaaacagaattggcagcttgggtgggtttaaatgcgcccaacctaagaaaa

SEQ ID NO: 1540 - protein, 222 aa, Corynebacterium glutamicum; identical to SEQ ID NO: 1538

SEQ ID NO: 1541 - DNA, 373 bp, Corynebacterium glutamicum
  CDS (101)..(373): RXN03182
actcgacaccaccgtcaccaacttcatgatggtcatcgcactcttaggattcatcagctctgtatccgtagcccgcttccgcaagagggatggtgcctaaatgaccctgcaactattcaccgacatcgtgtctctggtgttcattctcagcggcgcattcttgtcattctccgcatccatcggcctcatacgattcaaagacaccatgtccagagtccacgccatgaccaaaccccaaacaaccggccttatcctcaccgttgtaggcgcaatcatccgcatcttaggccacgaacacttcgatcaatcacaacgcagtgacctcggagtccttgttctcctcgtactgtttgcactgctcaccagcccagtg

SEQ ID NO: 1542 - protein, 91 aa, Corynebacterium glutamicum
MTLQLFTDIVSLVFILSGAFLSFSASIGLIRFKDTMSRVHAMTKPQTTGLILTVVGAIIRILGHEHFDQSQRSDLGVLVLLVLFALLTSPV

SEQ ID NO: 1543 - DNA, 603 bp, Corynebacterium glutamicum
  CDS (87)..(584): RXN03184
gcacaacgtcgctggtcagtgccattagtcacgcaagaaatgggcgggtccggtggaagactggcctgctgtttggtgccgcgggcatggttggcgcgtttggcggtggcgttctcgggggctacattcctggcacgattttgatgatcgcgtttgcgctcatgatgatcgccacgtcgactgcgatgttgcgggggcgtaagcagaagaagggggcgtcgaaaagctctctttggcgcgtccttgttgatggcctggtggtcggcgcggtgaccgggcttgttggtgcgggcggcggctttttggtggtgccggcgctggcgctgctcggcgggctgtcgatgccggtggctgtgggcacgtcgttggtggtgatcacgatgaagtcgtttgcggggcttgccgggtatctgaccagcgtgcagctggattgggggctggtgctgatggtgactgcggccgccatcgtcggttcgcttgccggttcgcgccttgcggggcgcgtgcctgagactttgctccgcaaagggttcggggtgttcgtgctggtcatgggcgtgttcgtgctcggcttggagcttttataagcttttcgacgtctcc

SEQ ID NO: 1544 - protein, 166 aa, Corynebacterium glutamicum
MVGAFGGGVLGGYIPGTILMIAFALMMIATSTAMLRGRKQKKGASKSSLWRVLVDGLVVGAVTGLVGAGGGFLVVPALALLGGLSMPVAVGTSLVVITMKSFAGLAGYLTSVQLDWGLVLMVTAAAIVGSLAGSRLAGRVPETLLRKGFGVFVLVMGVFVLGLELL

SEQ ID NO: 1545 - DNA, 295 bp, Corynebacterium glutamicum
  CDS (84)..(272): RXN03185
  misc_feature (56): n = a, c, t, or g
agcgcccaaccgttcagaccagcggtttctctgaggatgcaaagtccatgatgggtnaggtcactgagctgtccgaaaccaccatgaatgatcttgcagctgaaggtgaaaacgatccttaccgcatggttcagcagctgcgccgcaagctctctcgcttcgtcgagcagaagtggaagcgccagccggtcatcatgccaaccgtcattccgatgactgcggaaaccacgcacatcggtgacgatgaggttcgcgcttcacgcgagtccctgtaaaagcatttcgcttttcgacg

SEQ ID NO: 1546 - protein, 63 aa, Corynebacterium glutamicum
MNDLAAEGENDPYRMVQQLRRKLSRFVEQKWKRQPVIMPTVIPMTAETTHIGDDEVRASRESL

SEQ ID NO: 1547 - DNA, 864 bp, Corynebacterium glutamicum
  CDS (101)..(841): RXA00003
catccatttcgcacagaacatggtaatccttctctaggccccactcgaagccggcgatataagcgccaagaaggccacccttgccttcgcggtgcagcacgtgcaggtgagaatcctcagcagcgagcttgtctgcagcctctccggtgccatccggggcgtgaacctagatattgcagcaccgaagcccaagaagtcaggccgccgcacactcacaaaacccgaatgggatgccgtcattaagcatctgttaacgcgggataccgagccactgttaacccccaccaagcacaagaacatccgacaaagcaccaagaacatccatgcccgcattgtgcggctcactctcctccaagccgtttcagggctgagaattgccgaagccaatcaattgcagtggaagcacatcatcgacggtgacgatggcatgctcattaatgccagcgccgatattgtcaaggggcgaaaaggcaaggaaagagggcggtatatccctatcctgagggccgacgtagcggaatacctgcgtacacaccgcgaggacgacgagcatttcatcgtaggctcaccgacgacgaccgcgaggccctgggacgcgacgaacgcagatgacaaggtgcccgagctataccggcaaattgcagaagctacaggcgtgaagactcttcaagacctccgaagccactcctggcgtgcgacgctgcacggtgtgtacgcggacgtgatggacccagctacacgcgccgccattttcggccacaccgagcaggtagctgaggagtactacaacgaccgccaaaatattgaatcactcatgagacaagtcaagcgcgcctacgcgtaactacgcttaagactacgcgt

SEQ ID NO: 1548 - protein, 247 aa, Corynebacterium glutamicum
VQVRILSSELVCSLSGAIRGVNLDIAAPKPKKSGRRTLTKPEWDAVIKHLLTRDTEPLLTPTKHKNIRQSTKNIHARIVRLTLLQAVSGLRIAEANQLQWKHIIDGDDGMLINASADIVKGRKGKERGRYIPILRADVAEYLRTHREDDEHFIVGSPTTTARPWDATNADDKVPELYRQIAEATGVKTLQDLRSHSWRATLHGVYADVMDPATRAAIFGHTEQVAEEYYNDRQNIESLMRQVKRAYA

SEQ ID NO: 1549 - DNA, 615 bp, Corynebacterium glutamicum
  CDS (101)..(592): RXA00008
cattggcgtggtgatcgccggcattatcgcacaactcaccctgcgcttctacgtgaggaaataagactattgaactccttgccgtagacttagaaagactatggccaagaagaaaaagaaagtcgacgaaaacaactcagttctcgcgaccaatcgcaaggcccgccatgactaccacatcattgatacgtgggaggcgggcgtggtgctcttaggcaccgaaatcaaatcactgcgcgaaggtaaggtatccctcgtggattcctttgccaccattgataacggagaaatctggcttcagcatctccacatcccgcagtattccatgggctcctggacaaaccacacgcccaagcgcacccgcaaacttttgctgcaccgcaacgagattgattccctgatgggtaaagtccgcgacggcaaccgcacgttggttccgctcaagctttacctcaaaaacggtcgcgtcaaactcgaactcggactcgcacaaggtaagcaggattacgacaagcgccaagatatcaagcgtcgcaccgaagaacgcgaagtcacccgtgagctcggccgtcgcattaagggaatcaacgcgtaaatgagtattcacatcgcaaa

SEQ ID NO: 1550 - protein, 164 aa, Corynebacterium glutamicum
MAKKKKKVDENNSVLATNRKARHDYHIIDTWEAGVVLLGTEIKSLREGKVSLVDSFATIDNGEIWLQHLHIPQYSMGSWTNHTPKRTRKLLLHRNEIDSLMGKVRDGNRTLVPLKLYLKNGRVKLELGLAQGKQDYDKRQDIKRRTEEREVTRELGRRIKGINA

SEQ ID NO: 1551 - DNA, 432 bp, Corynebacterium glutamicum
  CDS (101)..(409): RXA00015
aagacgcacagaagctacacacatagctacatcgtcagcaccaaagccggaacaagaactacagcaaccgacgacactcaacgagcgcgacctccaagacatgattgatatgtgcaccactcctcgacaagagatcatgatccgcgagcaatttaaggagatcaacaacggtagggttgtacctcattacgatcagcttgaacagctcgcagagattttttcaactaaagactcaatcgacatggtcaacgagatactcaatcgcgatacggattttctcagtaatgaaggcacaatttttatggaatacattttcaacggtggattccatacggacaacggctatcaaccgttgtcctatgcatatgttgaacgaggcttagcgatccgccctccacgcatagtgctctagatatgacacaaatcggtatt

SEQ ID NO: 1552 - protein, 103 aa, Corynebacterium glutamicum
MIDMCTTPRQEIMIREQFKEINNGRVVPHYDQLEQLAEIFSTKDSIDMVNEILNRDTDFLSNEGTIFMEYIFNGGFHTDNGYQPLSYAYVERGLAIRPPRIVL

SEQ ID NO: 1553 - DNA, 1422 bp, Corynebacterium glutamicum
  CDS (101)..(1399): RXA00018
caacccgccccacaaacacatacaattaacttctatatttagtaaataaataactagtatttttaatgacttacaaatatcaagaaagaatctattccttatgtccgcattatctagaccgcacaagatcgccaccggcgttgctgtcgcaactcttaccctcaccttgtgtacctctgctgccggcgttgtccatgcagcgcaacaatccatcagcggtccagaatcctcctgtgcttttaatcaacagcgttgggatgacagcaaagttaagcttgacgacaccatcgctacggccaaaaactcattggtacaaacaggcgaactgcaccgcaacgaacaggatctacttactggctatcttttccagcaaccgcacagcagcaattaccttgcactcaacaacgcttatgccgatgccgtagcaatcaaagacagctttgtccgcccaacatgtgacggttctaaagagtccaagattgccagcgaacacgccgtgtctgaggttgtgggtgcagtgaatgtactcgcccgagcacaaaaagcgctgcagattaactccgacacctacgaacagcaacgtcgttgtgatgcccttcgtctagcaagccgagatgaatcagatgttcttatgcgcattgatcgcaccatgctgcagcttcgtcgcacactagctgacattgaccaggcgtccacagacattcgcgatattcgggctcaaacaacaagctttgaacgtgatcttgcccgcgagcaaaaagaggccgacgcagcagcacgtgctcaagctgtagacacttcgaccacaccaacatcaagcacagaagatcgtgtcaacgacattcttaaagagtcccgtaccgatcacagtggcgacagttacacgcgctcaacgacaacgagcgcacaaagcactgagccggattctgcaaccaacacctcatatctgtcacgtcgtctcgacagcctggaacgcagtgcgcagcatattgatctcaatacccagtgcgacaacctcgatgatcttcgtgaactcaccaacaatgacacgcgtgatcacaccggctccgtcatttccattgccgatcaactcacagacatcaccaatgaaatcaatgaattacgcgatagcacttttgccaccagagacagtgcccaacaagcacaggatcaggtaattgctcaacgtgaagaactgcaacgagcaaaggaagcacgactagaagaacagcgactcgccaaagaagcagaagagggcgctcgcaacgcagcaattcaggaacgtgacgcggccgaagcagcactgcgtgaagcacaagacctcctcagtcgcctcgatgacacaggcaacgcaaccagtgatgacacagcagcgctagtagacggtcttctcaataactaacaatcagcaacaccgctcac

SEQ ID NO: 1554 - protein, 433 aa, Corynebacterium glutamicum
MSALSRPHKIATGVAVATLTLTLCTSAAGVVHAAQQSISGPESSCAFNQQRWDDSKVKLDDTIATAKNSLVQTGELHRNEQDLLTGYLFQQPHSSNYLALNNAYADAVAIKDSFVRPTCDGSKESKIASEHAVSEVVGAVNVLARAQKALQINSDTYEQQRRCDALRLASRDESDVLMRIDRTMLQLRRTLADIDQASTDIRDIRAQTTSFERDLAREQKEADAAARAQAVDTSTTPTSSTEDRVNDILKESRTDHSGDSYTRSTTTSAQSTEPDSATNTSYLSRRLDSLERSAQHIDLNTQCDNLDDLRELTNNDTRDHTGSVISIADQLTDITNEINELRDSTFATRDSAQQAQDQVIAQREELQRAKEARLEEQRLAKEAEEGARNAAIQERDAAEAALREAQDLLSRLDDTGNATSDDTAALVDGLLNN

SEQ ID NO: 1555 - DNA, 903 bp, Corynebacterium glutamicum
  CDS (101)..(880): RXA00020
taggagaactacctttcttgctggtgttacctagctttaagtttgttagagtaattaatgaataactaagtaatgtaagtaaagggacttttaaataactatgactgtgaccaccgcacaacgaatcgctgacgaatttcaacgtggcattagtatcggcccgtgggatctgtgcgaagtaccagcaggcgatgactatttagagcacaccaccaaggtcaggcgacgccacagcacggctgtagagattcacactgactctttgatcatttgtgcgcctgaaggcagtacgtacagccacaaccgcactaaggctggtcttgcgtccacgggcacagtcactgtgccagtgaaggggctttctgagcctgtgaagcttagtctcaatcttcttgctgattatggaaactcctttgacactgtgcacgacgatctgtggcaacgagagctgcgtgagcagacgcgggggcagttactcacacttaatgcagtctccggtcttggggatgacagcgtggcgattatgggcacgccatggggcgatggtctcaccggggaggccaacaccattaaaggtcgtgagcattttgtcatgtgggctgcagggtgccgctttgaagacggttatggtcgtcacgcacttcgagaggatcgccatgtgcgacaccaggcacgtgcgggtgaggattccactgcacatcacggttggttgcttaaaggcacagtgttcgggaaagaactcaccggtgatgctgtgacggcagccatgacagtttttagtgatgtggtggtcactgtcgatgaggggcgtatccctggcatgaaatcaggacaaccgttttctatggcaacccgtttacgcgcatcatctgcgcctgtgtagagactttttcagaccttaac

SEQ ID NO: 1556 - protein, 260 aa, Corynebacterium glutamicum
MTVTTAQRIADEFQRGISIGPWDLCEVPAGDDYLEHTTKVRRRHSTAVEIHTDSLIICAPEGSTYSHNRTKAGLASTGTVTVPVKGLSEPVKLSLNLLADYGNSFDTVHDDLWQRELREQTRGQLLTLNAVSGLGDDSVAIMGTPWGDGLTGEANTIKGREHFVMWAAGCRFEDGYGRHALREDRHVRHQARAGEDSTAHHGWLLKGTVFGKELTGDAVTAAMTVFSDVVVTVDEGRIPGMKSGQPFSMATRLRASSAPV

SEQ ID NO: 1557 - DNA, 1896 bp, Corynebacterium glutamicum
  CDS (101)..(1873): RXA00021
aaaagcaactcacttcgtgcttttttcaccgaccccggctgtgtggatgccacccacttacaccgcacaatcgaaaataaaagtaaaggatgttcaccttatgtctgacaccacagacagccacgacccagcaacctcccctacagtcgattcagccgcatccggtacttctgaccccaaccagcaacccaagaagaaattcaccatcattaagcaggtgaacatgattgcgcgtactgccattgatgactgcattaatcgactaggcccagatgttgtcaccatgtccagcgaagacattgctgatcaagtggtcaactccattaacgttgctattgccagagaaaacacacgtgcccaagatgccaatgctgcggtgcgttacacacctatctttaagctcgatttctcccatgtcgctgtccttatgcgcagactgcatgtgattatcaacatcgcgccatcgcataactctgatcctgacagcgatatgttggctatttacgaccccaacccacgcagcgagcattacgggatctatcgcacctcagaggctgaaatacgccgcgtagcccgtgaatactgccctgacctcacctcagcgcagtttagagaactgcagatggcactctcagatgctgcacctcgtaaagtccgccacaagcagcgtgacttgattcccgtgaaaaacggcatctttaattactcgactaaacaactagaaccgttttctcaagagtttgtctttcttgctaaatctgcagtgaactacaacccaaatgcacaaaaccctgtcatcactcatccccaggatggctctgtctgggatgttgaatcatggatgaacgatctctccgatgaccctgaagtcgttaacctgctgtgggagattatcggcgctatcgtgcgcccctatgtgtcctggaacaagtctgcctggttctactcagaggccggcaacaacggtaaaggcacgctcgttgagctcatgcgcaacatcttgggcgcagaggcctataccagtatccagctctcggacttctctaaagagttccaccttgaatcactgactcgtgcacaagcaatccttgttgatgagaacgatgtcggcgccttcttagaaaagtcagcaaaccttaaagcgattgtcaccaatgacgtcatctccattaaccgcaagcacaaaaccatgctcagctatcagttttatggctttatggtgcagtgtattaacggcttccccaaggtcaaagaccagtcggagtcatttttcaggcgccaactctttgtgccgtttgagaaaagcttcaccggtgccgagcgcaagtacatcaaagacgactacatgtcgcgcactgatgtcctcgaatatgtactgcaccgcgtactgcatatgaactacgacaatctctccacccctgctgcagctctcgctgtgctggatgaatacaaagagtttgtcgatcctgtgcgcgcattctggaatgaattcagcgatcaatttgtctgggatcttcttcccctgcaattcctctacgagttttatcgcaagtggtttgaccgtgacagcccatccgggtctgtgctcggcaaacgcagcttcattcaaaaaatcaccaccatcgccgttgatagcggtcagtgggagtatccgctgacagcacagcgtcccggtggcgatatggccgttcctgagccattagtcattgattatgacctcaccgagtggcaaaacgccactgtacctaaaggtcacgtcaacaaggggctccctctaccactcaaggctaattatcgaggactgctccgcaaacctctaacaacacctgctactccccctgcagcgccggtcaaccccacaccacccaccccttaacaaccacaagaaagatttat

SEQ ID NO: 1558 - protein, 591 aa, Corynebacterium glutamicum
MSDTTDSHDPATSPTVDSAASGTSDPNQQPKKKFTIIKQVNMIARTAIDDCINRLGPDVVTMSSEDIADQVVNSINVAIARENTRAQDANAAVRYTPIFKLDFSHVAVLMRRLHVIINIAPSHNSDPDSDMLAIYDPNPRSEHYGIYRTSEAEIRRVAREYCPDLTSAQFRELQMALSDAAPRKVRHKQRDLIPVKNGIFNYSTKQLEPFSQEFVFLAKSAVNYNPNAQNPVITHPQDGSVWDVESWMNDLSDDPEVVNLLWEIIGAIVRPYVSWNKSAWFYSEAGNNGKGTLVELMRNILGAEAYTSIQLSDFSKEFHLESLTRAQAILVDENDVGAFLEKSANLKAIVTNDVISINRKHKTMLSYQFYGFMVQCINGFPKVKDQSESFFRRQLFVPFEKSFTGAERKYIKDDYMSRTDVLEYVLHRVLHMNYDNLSTPAAALAVLDEYKEFVDPVRAFWNEFSDQFVWDLLPLQFLYEFYRKWFDRDSPSGSVLGKRSFIQKITTIAVDSGQWEYPLTAQRPGGDMAVPEPLVIDYDLTEWQNATVPKGHVNKGLPLPLKANYRGLLRKPLTTPATPPAAPVNPTPPTP

SEQ ID NO: 1559 - DNA, 1560 bp, Corynebacterium glutamicum
  CDS (101)..(1537): RXA00025
taaatttctcaatggtgtggaaacacttggaaacaagctgcccacaccatttacgcttttcttgatacttttcctgatcacggcgctggcttcatcgatcatggcgtggatgaacgtatccgtgattgttccaggctctgatgaggaactatttgtaaaaggcctgttcaccggtgaaggcctaacctggttgactacgaatctcggggcaaactacatcgggttcccgccgttgctcaccgtgttgccaattctgttggcagtgggtgttgctgaacgttccggcatgttggctgcgctgattaggaaactttttggttcggcgaaaaagatcgttttgccatatgcagtcggtgtgattggcgtgaccgcgtcgatcatggcggacgctgccttcgtggtggtgccacctttggccgcgatggtgtttaaagctgctggtcggcaccctgtggctgggctattgggttcgtttgcagctgtgggtgcaggatattccacagcgattgtgcccaccagccttgatgcactttttgcgggaattaccaacgccgtgatggagacacttccaggcattgcgacaactgaagtcaatccggtttctaactattacttcaatattgcatcctcgattgtgttgggtctgttatgtggtttcctcattgataaggtgctggaacctcggatgtggcgtcagaaaatcgctacggagtatgcagaaagcattgaacccaccagcgcagcagatgatgaggaaatctctgcaaccctaaccgcacaggaaaaccgcgcgctgacaatttccatgtggaccaccctggcgacggccatcatcgtgctggttgtggtgctgattccgggatccccatggagaaatgaggatggtggattcttgcctacctcgccactgctgagctctgtggtgtttattgtatttttgtttttcatggtgatgggcctggcctacggcatggtggtgggcacgatcaagaacatggatgatgtcgtgaacatgatgggcgaagcaatcaaggacatgattggtttcttggttttggccttcattttgggacagtttgtggcgctgtttaactggacgggcatcggtacctggactgctgttcagggtgctgcgggattggaagcgatcgggcttaccggattccctgcgatcattgcatttattattttggcgtcatgtttgaacctgctgattatttccggctctgcgatgtggacgctgatggctgcggtgttcgtcccgatgttcgctctgcttggctatgaaccatcattcattcaggcagcattccgcgtgggtgactcggcaactcaggtgatcacaccgctgaatccgtacatgattgtgatcctcggtttgctccgtcgatacgaaccggatgcaggtttaggcaccttgatgtcaaggcttatcccatttgtgatccctttctggctagcctgggctacattgttggcaatttggttctacgccgatttgccgcttggacctggctctgcgatcttcctcgaaggataagttttcatgagtactgacaa

SEQ ID NO: 1560 - protein, 479 aa, Corynebacterium glutamicum
MAWMNVSVIVPGSDEELFVKGLFTGEGLTWLTTNLGANYIGFPPLLTVLPILLAVGVAERSGMLAALIRKLFGSAKKIVLPYAVGVIGVTASIMADAAFVVVPPLAAMVFKAAGRHPVAGLLGSFAAVGAGYSTAIVPTSLDALFAGITNAVMETLPGIATTEVNPVSNYYFNIASSIVLGLLCGFLIDKVLEPRMWRQKIATEYAESIEPTSAADDEEISATLTAQENRALTISMWTTLATAIIVLVVVLIPGSPWRNEDGGFLPTSPLLSSVVFIVFLFFMVMGLAYGMVVGTIKNMDDVVNMMGEAIKDMIGFLVLAFILGQFVALFNWTGIGTWTAVQGAAGLEAIGLTGFPAIIAFIILASCLNLLIISGSAMWTLMAAVFVPMFALLGYEPSFIQAAFRVGDSATQVITPLNPYMIVILGLLRRYEPDAGLGTLMSRLIPFVIPFWLAWATLLAIWFYADLPLGPGSAIFLEG

SEQ ID NO: 1561 - DNA, 525 bp, Corynebacterium glutamicum
  CDS (101)..(502): RXA00031
cacacatcgcctcgtcatccttagacacgccaaatcttcctggtccaccggagtactcgaccataaacgcccacttaatcaacgtgggcttcgcgatggcgtggcagctggccaatggctagctggcaacatcggcgaaattgatcatgtgctgtgttcagatgccacccgcacacaattaacgtgggaacgcgtccagcttggtggcgcaaccgccaaaggctctagcttccacaatgacatctatgaaaaccaagtgtctgaatttaaacatttaataacagggctcccagatgtagttggtaccgccctactcatcgggcactggccaggcgtggaagaactagcccattattttggcatccgcgatgaacatcccggttgggatcagatggaagaaaagtttcccaccagcgccattgcggtgttggaatttaacaccccttggtcaaaacttgagagaaactctgctcggttgacagattttgtcattccacggggttagttctgcttcaattgaacaat

SEQ ID NO: 1562 - protein, 134 aa, Corynebacterium glutamicum
VAAGQWLAGNIGEIDHVLCSDATRTQLTWERVQLGGATAKGSSFHNDIYENQVSEFKHLITGLPDVVGTALLIGHWPGVEELAHYFGIRDEHPGWDQMEEKFPTSAIAVLEFNTPWSKLERNSARLTDFVIPRG

SEQ ID NO: 1563 - DNA, 810 bp, Corynebacterium glutamicum
  CDS (101)..(787): RXA00049
ctgaatcatgattcataaatgaacaagggttcagattttacaatacccccattccacccccttatatttaagtcaccgcagatcagctaaggttttccctatgcccacgccttcgcagcacaaggacgcttcaacagcacaaaccgacaaccaggtaccaactggccgccgtgcacaaaaacgcgaacaaacccgcgcgcgcctgatcacttccgctcgcacactcatggcagaacggggtgtcgacaatgtaggaatagctgaaatcaccgaaggcgcaaacatcggaacgggaaccttctacaactacttcccagaccgtgaacaactactccaagctgtcgcagaagatgcctttgaatccgtgggaattgccctcgaccaggtgctaaccaaattagacgatccggctgaagtatttgcagggtcgcttcgacatctagtacggcactcgttagaagatcggatttggggcggatttttcatacaaatgggtgctgctcatcccgtactcatgcgcatcctaggaccccgcgcacgccgagatctacttcatggtttagaaactggccgattcaccatcgaagatctggacctagcaaccacatgcacttttggttcactcatcgcagcgatccaaatggcgctttctgcagatcaagattccaacgatgacaaagatcagattttcgcagccgcgatgctccggatggtgggtgttcaagcagcagaagcccgggagatcgcttcgcgtccactccccgaaatatccccagtcaaaccgcagtagtgatcgggcctcaaataaac

SEQ ID NO: 1564 - protein, 229 aa, Corynebacterium glutamicum
MPTPSQHKDASTAQTDNQVPTGRRAQKREQTRARLITSARTLMAERGVDNVGIAEITEGANIGTGTFYNYFPDREQLLQAVAEDAFESVGIALDQVLTKLDDPAEVFAGSLRHLVRHSLEDRIWGGFFIQMGAAHPVLMRILGPRARRDLLHGLETGRFTIEDLDLATTCTFGSLIAAIQMALSADQDSNDDKDQIFAAAMLRMVGVQAAEAREIASRPLPEISPVKPQ

SEQ ID NO: 1565 - DNA, 834 bp, Corynebacterium glutamicum
  CDS (101)..(811): RXA00052
agctaaagttctaatttcctaaattggtaaagatcggaactcaaaaatgtcgcttcgaaagctcacaagcttaattggcatactggctgttgttggcctagtggcgtttatccttttcaacttcgtgaaaacaaacgacgaaacatcgaatgtctctcagagcgagtcaactgcagagacagtcagcgaaacaaatggcgtgctctccgacggcgcagaaaacatcgcttctcaatctgatgagagtaaatcgggtgtagagattattgattctggatttgggcagagctcaaattcggcgatggcaattgttattgccaaaacttctggtggaagcctcgcaggggaatttgttacggcgacggtgaatttcctcgatgaaagtggcgccgttgtagcgactgaagatcaagtagaaacactcagttgggaagaccaggaattggtattgccagtatctcactacaaggaggattcaagccgcccagaaattacaagcattgaggcttttctttcagtaacggattacggttcaggacaaccagatgaaactgcattgccggtgttggaaaccaccgatatttccaacccatacgctggtagttacaatgcctcatttgcgttgaaaaatgactcctcagatgattttaagaacctgagagttggtattgtttgctacaacgagcaaactgacatcattggtggtggtttcaaatttccgaacctggttccagcgggtgggagtattcgaatggacgctagtgtgacggtctccgaaatgccagcttcttgtaaggcatatttaaatcactaatagattcttaaaaggcagca

SEQ ID NO: 1566 - protein, 237 aa, Corynebacterium glutamicum
VAFILFNFVKTNDETSNVSQSESTAETVSETNGVLSDGAENIASQSDESKSGVEIIDSGFGQSSNSAMAIVIAKTSGGSLAGEFVTATVNFLDESGAVVATEDQVETLSWEDQELVLPVSHYKEDSSRPEITSIEAFLSVTDYGSGQPDETALPVLETTDISNPYAGSYNASFALKNDSSDDFKNLRVGIVCYNEQTDIIGGGFKFPNLVPAGGSIRMDASVTVSEMPASCKAYLNH

SEQ ID NO: 1567 - DNA, 3036 bp, Corynebacterium glutamicum
  CDS (101)..(3013): RXA00054
atgctgagatccgctgggtggcaccacacgaattggaatctttggagtgggcacctgctgatattcctgcggtgaaacttctcgtcgagcagcttgcttaatgagcccattcgattcaaagcttggtcgcgatacccattttggattcctcgataagaccactgcttcgcaacaactgctgaatccttcattgatttctaatgaggatccgcacaccatgttgcaggcgatcaagttagagcttcgtaccgcacagtcttttacattttcagtcgcttttatttccagtcgcggtatcgcgttgttgaaacaggcattgttggacttcaagggtaaaggacgaattatcacgtcccgctacctggatttcaatgatccaacgatgtttcgtgagcttcttactttggagaacgtggaagtcctcatacatcaaggcgatggtttccactccaagggctacgttttccatcacgacgtgggaatcaccgcagtagtgggtagttccaacctcacagataatgctctgttggtaaaccgggaatggaatctgaagttctctgccagcaagaatggcgacattgcttttcaacttgatgatgcgattaatcgccaaattgaacgatccacgccactgacgcctgaatggatctcagagtatgaggcaaccagacgtgtacctgagcgtttggtgtctcagaatattcctctcgaggatcaaagtaacgccggaacaattgttccaaacgtcatgcaggaagaggccctcgacgctctactttctttgacggagaagggagagaaacgtggtgtcattatttctgcgacaggaactggcaagactatcctggctgctctagctacaagaatgctcaagcctgaacgagttttgtttgtcgtgcaccgcgaacaaattctggataaggcgcgatccgagttcatcaaagttcttgaacgtcccgctgttgatttcggaaaaatgtctggctcgaccaaggagctagataagccgtttgtgtttggcaccatccaaacgctgacaaaggaagctacactttcccagatctcccctactgactttgatttagtcatcgtcgatgaagtccatcgcgccggtgccgaatcctatttggcattgctcaatcatctgcagccacagtttttattgggcctgactgctaccccagagcgaactgatggattcaatatttatgagttgttcgatttcaacgtgccatatgagatccgacttcaagctgctttagaatccaacatgctcgtaccgtttcactattacggtgtcacagacttcacgcttgattctgaaacaacggtgactgatacctccaaactaagtgccttggtgagcgaagagagagtccatcacattctggaggccctcaaaacttatggtcatccagaaaatgttcgtggactgatcttctgttccaagactgaagaggctgaggagctgtcaaaacttctcgaccagtcgttgtttaatggcagcttgcttaaaaccaaggcgctctctgcgaaggactcaattccctaccgcgaagaggttgtagctgagctggagtccggcgacctggactacatcttgacggttgacatcttcaatgaaggcattgatattccttcggtgaatcaaatcgtaatgattcgtagtactcaatcaagcattgtgtttacgcagcagctcgggcgtggactccgaaaagctgctggcaaagaccatctgcgcgttattgatttcattggcaactacgcgaacaactatctcattcccatcgcattgtttggcgataattctcgcaataagaacagcatcagacgccgcctgattgagagcgatattgatggaacaatctcaggtgtttcaagtgttaactttgatcccatcgcgcaggagagaatttttgctgcgttgaaggctgcgaagttggactcaaaagcacaattcaagcaggatattgttcagcttcaagatcgactcaatcatgtgccagcactgttagacttcgctcgcttcaatactgttgatccgtttatccttgccacgcattctggcaactactggtcgctgctcagttcagtgaagtttgtcgatcacgctcccagcgaatcggagaagtactttctggatttccttaccggagagcttcttaacggcaagcgacctcatgagctgttgctgatccaggaactaatgaaacagcctgaaacttctactgaagaattccgtaagctcttgcaggcccaatcgactagttcagatgagcaaacaatcaactcggttgaaaggattttgagccaagaattctatacgggaccaaaccgcaagaagtttggcgaacatccgatcctctctgttcaaaaccgcacctactcttttactcccgagttccgacgtgccctcgacgaaagcctagaagtgacggaccgagatgaggctgctcagaattttaagtttcacgtccaagacatcatcgacactggtttgtttatcgccagaaacaatggattttggcaaggaaacctcgttgttggcgagagatactcccgacgagatgtctgccgaattctcaattgggaacgaaacaacgagagcacgatttatggatacaaagtggacagttacacatctacttgcccaatctttgtgacctatcacaaggctgatgatgtatccgaaagtactcgttaccaggatgaactcgtcgatccgaatacccttcattggtattcccgcggcaaccgaaagatcacgtctaatgagatcaagcccatcgctgcgaatgctgtggatcttcatgtttttgtgaagaaggacgatgccgaaggccttgatttcttctaccttggtcaagcgcattcagaaaacagcaaacagtcatcgatgcccggaaacaaaggagttgtgcaaccggtggtcacaatggatctacagttcgacacacccgtcgaacaaagcctgtttgagtacctgagcacaaatctcgccgtaacggagtaaccaccgcaaccaagcgtcga

SEQ ID NO: 1568 - protein, 971 aa, Corynebacterium glutamicum
MSPFDSKLGRDTHFGFLDKTTASQQLLNPSLISNEDPHTMLQAIKLELRTAQSFTFSVAFISSRGIALLKQALLDFKGKGRIITSRYLDFNDPTMFRELLTLENVEVLIHQGDGFHSKGYVFHHDVGITAVVGSSNLTDNALLVNREWNLKFSASKNGDIAFQLDDAINRQIERSTPLTPEWISEYEATRRVPERLVSQNIPLEDQSNAGTIVPNVMQEEALDALLSLTEKGEKRGVIISATGTGKTILAALATRMLKPERVLFVVHREQILDKARSEFIKVLERPAVDFGKMSGSTKELDKPFVFGTIQTLTKEATLSQISPTDFDLVIVDEVHRAGAESYLALLNHLQPQFLLGLTATPERTDGFNIYELFDFNVPYEIRLQAALESNMLVPFHYYGVTDFTLDSETTVTDTSKLSALVSEERVHHILEALKTYGHPENVRGLIFCSKTEEAEELSKLLDQSLFNGSLLKTKALSAKDSIPYREEVVAELESGDLDYILTVDIFNEGIDIPSVNQIVMIRSTQSSIVFTQQLGRGLRKAAGKDHLRVIDFIGNYANNYLIPIALFGDNSRNKNSIRRRLIESDIDGTISGVSSVNFDPIAQERIFAALKAAKLDSKAQFKQDIVQLQDRLNHVPALLDFARFNTVDPFILATHSGNYWSLLSSVKFVDHAPSESEKYFLDFLTGELLNGKRPHELLLIQELMKQPETSTEEFRKLLQAQSTSSDEQTINSVERILSQEFYTGPNRKKFGEHPILSVQNRTYSFTPEFRRALDESLEVTDRDEAAQNFKFHVQDIIDTGLFIARNNGFWQGNLVVGERYSRRDVCRILNWERNNESTIYGYKVDSYTSTCPIFVTYHKADDVSESTRYQDELVDPNTLHWYSRGNRKITSNEIKPIAANAVDLHVFVKKDDAEGLDFFYLGQAHSENSKQSSMPGNKGVVQPVVTMDLQFDTPVEQSLFEYLSTNLAVTE

SEQ ID NO: 1569 - DNA, 687 bp, Corynebacterium glutamicum
  CDS (101)..(664): RXA00058
atcactaggctatcttccggttcacctgaagttagtaacacaccggtcacagaagttccggctcgtgtaatctccgcttatctagctcaaaggaatacttatgaagttcttcgggttttatcgtcctattgctttaattgctggcattaccgtttcagcatctattctcacatccgtagctactgcagctgaatctccaactagctttcaagcgattacacctgcattctcttcatcatcggctccagaagcagacgcagaagcaaacaccagtgaagctaccgcagacctgctttacgtggcagaaaaccaactacttattaagctttctaacgccgtcgtcgaagatgttaacggcgaaatcttaatgaaagataataagggcactcttctggagaatttgacagctgaacttcaagcccaaccaggcttctcaatcgagaaagtcgattcccatactgctttgttgaccatgaatccagatgaggtgccagatttacaggactggcgatgcggagtcggcgctttgtcaggcggggtagcaggtgtggtggcaactggtctagctctcgccgctttgggagttgccacaggtggcacggggtttgctgtgcttgcagcagggggacttgctggatatggcactggcgctgtcgccaactgctaaggagaaataatgggaattgt

SEQ ID NO: 1570 - protein, 188 aa, Corynebacterium glutamicum
MKFFGFYRPIALIAGITVSASILTSVATAAESPTSFQAITPAFSSSSAPEADAEANTSEATADLLYVAENQLLIKLSNAVVEDVNGEILMKDNKGTLLENLTAELQAQPGFSIEKVDSHTALLTMNPDEVPDLQDWRCGVGALSGGVAGVVATGLALAALGVATGGTGFAVLAAGGLAGYGTGAVANC

SEQ ID NO: 1571 - DNA, 405 bp, Corynebacterium glutamicum
  CDS (101)..(382): RXA00059
ctggcaggcgattgttctcttactacttgcgctaggtacaggtggtgcctatctgctggccggtggtgatgtcactcaaactgcccgactggtgttgtgggtgttgaccggaatcttactggctatggtctctaccgccctacgaatccgcttcggatcaggggtagctatcgctgcaaccgtgctgtggacagttatctcaataaccttgggcggagatgtgctagccgagaccatgctctggcttgtagcagtaccatcctggccagaaacagcggatactactacccgcttccttattgcgatgctactgcaggcagttcttatcaccggcagcactatctgggctatccgagagatccgggattcagagcgccgtggctaagttcagcacctccgacaacg

SEQ ID NO: 1572 - protein, 94 aa, Corynebacterium glutamicum
VLTGILLAMVSTALRIRFGSGVAIAATVLWTVISITLGGDVLAETMLWLVAVPSWPETADTTTRFLIAMLLQAVLITGSTIWAIREIRDSERRG

SEQ ID NO: 1573 - DNA, 396 bp, Corynebacterium glutamicum
  CDS (101)..(373): RXA00065
atgcttctcagacgcctccctctccttcaaatccgccaccgattccagcgtcactcccatgcatgcccaaccgggacagatcttgccgtgcgtaggaattatggcgaatcttccccaagagggtttttctgtggtgcacggaattttggcggatccccgcatttggggcccggagattccgtatgttcgtgaagaagcaggtcaagtaaatgtggaagcacccgacgaggctggcgatctagcccgattgacgttgcctctgcagttgatcctgctcacggaggaagagtttgccatcgctctcaacgagggcagcgacgtcatgttcgaacgaatggcggagcaagaagtcgatcttctggatctgaaacgttaagacggtaggctcaattccgt

SEQ ID NO: 1574 - protein, 91 aa, Corynebacterium glutamicum
MANLPQEGFSVVHGILADPRIWGPEIPYVREEAGQVNVEAPDEAGDLARLTLPLQLILLTEEEFAIALNEGSDVMFERMAEQEVDLLDLKR

SEQ ID NO: 1575 - DNA, 705 bp, Corynebacterium glutamicum
  CDS (101)..(682): RXA00068
ggctgctaaacggcaaccaatagagcgataattcgctaaggcgaatgtaatcgcagcaacatatagcaccggcttaacaggccggtgctattctgttcgcatgacttcgaaggatctgattgtgacctcctatacgtcttggggcaagcgtttcaagaatgacgggaagctttttattaacctacttcgcagcaccactgatagtgctgatgaaaaggttttagccactttcggtgaagttcccagcaaatcatttgaaaccaccgcaacggttgatgagcagcagtgggaactgtccttcagtattgatggaacggcaactgccaagcttcctgatggtcgtgtgttcagcgcgaatgcaggtgagaagacctttaccaagtccaagcggattgaaatcgacatggacggcaccgcgatggctgctgttaatgaagataaaaacaattggattatcgacgattctgaagagaataaagtcgctcagtttaccggtatgaacaacggtgtgcgtcgcgcgattgtggagtttgagcctgacgtagaagtcacccaggagcaggaaattttcttgtcgtgggttgctcggaaaactctggaatcccgcatgttgggctccagttggggactgactctgtttttgatcattttgacgccaatcattattttcctcactttcagctaaaaggaccatgcaatggtaga

SEQ ID NO: 1576 - protein, 194 aa, Corynebacterium glutamicum
MTSKDLIVTSYTSWGKRFKNDGKLFINLLRSTTDSADEKVLATFGEVPSKSFETTATVDEQQWELSFSIDGTATAKLPDGRVFSANAGEKTFTKSKRIEIDMDGTAMAAVNEDKNNWIIDDSEENKVAQFTGMNNGVRRAIVEFEPDVEVTQEQEIFLSWVARKTLESRMLGSSWGLTLFLIILTPIIIFLTFS

SEQ ID NO: 1577 - DNA, 345 bp, Corynebacterium glutamicum
  CDS (101)..(322): RXA00079
gatagcgcgcgatcttcctaggctgcccgcttgggcttcaggtttagcaagcgggacgctttcgcttatcgacgccaactccctccatttggaatcccccatgggcctagttcacaccgaattcaccccaataaacacctacggaatcctcgaccacgtagtcaccctccccgacggaactaaagtgctcaaccctttccgagtcatcccccacgacaccggctccgaactcattttcaccgtccgccccaacgaaaacttcgaagaagattgccaagcagtcgcagcagacctcgaaaggctggtcgcactggccgaaaaatgaccccacagaatggtctctaa

SEQ ID NO: 1578 - protein, 74 aa, Corynebacterium glutamicum
MGLVHTEFTPINTYGILDHVVTLPDGTKVLNPFRVIPHDTGSELIFTVRPNENFEEDCQAVAADLERLVALAEK

SEQ ID NO: 1579 - DNA, 666 bp, Corynebacterium glutamicum
  CDS (80)..(643): RXA00082
cacttgaaggcgaagaactcgaccagtttgttgaagatgaaattgaccgaattgatcagctattcaagaagatgggctagtgaacgtcactgaacaatccggcgagtcccatatcgacatcccggaatcacaccagctgcccggacctcgtccagttggcgagggcactttctgggaaggccgctccgggctcatcatgcccgcaattcttacggcatttagtttgtatttgctcatcggtgttttaaacatggatgtgggcaatgcagcattcccaggacctcgattcttcccaacaatcctcggcatcgcgggtttgttggtggcagtggcattgaccattcaaaccatcaagtaccccatgcatccagaaaatgaatctggccgaagctggaaattccactctgattacgtctcactcgcgtgggcgatcggtggcttcttcgcctttgcagtcttgcttccatatcttggctgggtccttgctggctccttgttgttctggacaatgaccagggctttcggttccaaacgcccaggtttcgatgttcttgtttccctcatgatgagctccgtggtctacctcgcattcgatgtgggcttgggacttaatcttccttccggacttttgggtggtggcttttaatggatattttgtccctcttg

SEQ ID NO: 1580 - protein, 188 aa, Corynebacterium glutamicum
VNVTEQSGESHIDIPESHQLPGPRPVGEGTFWEGRSGLIMPAILTAFSLYLLIGVLNMDVGNAAFPGPRFFPTILGIAGLLVAVALTIQTIKYPMHPENESGRSWKFHSDYVSLAWAIGGFFAFAVLLPYLGWVLAGSLLFWTMTRAFGSKRPGFDVLVSLMMSSVVYLAFDVGLGLNLPSGLLGGGF

SEQ ID NO: 1581 - DNA, 423 bp, Corynebacterium glutamicum
  CDS (101)..(400): RXA00083
gaagatacagggggccacggtggggtggtgaacaagagcaggcacgaggcctggtagatacggattcgaccaagaaaacgtacaccactcaggagcactcgtgcttgcccttccatcctctatcatcgaccccctctggtgccagttcgccgcgctgatcccacccgtgaccgacacccacccacttcggtgccaccgcccacgcatcccggaccggatcatcttcgacaagctcatccaggtcctcgtcctcggcgcctcctatgccaagatcgccgacacgacatgctcggccaccaccttgcgcacccgccgggacgagtggatcaccgctggcatcttcgagcagctggaacagatctgtttggaattctacgaccgtatcgtcggactcgatctctaagttcggattggctcgaattg

SEQ ID NO: 1582 - protein, 100 aa, Corynebacterium glutamicum
VLALPSSIIDPLWCQFAALIPPVTDTHPLRCHRPRIPDRIIFDKLIQVLVLGASYAKIADTTCSATTLRTRRDEWITAGIFEQLEQICLEFYDRIVGLDL

SEQ ID NO: 1583 - DNA, 2346 bp, Corynebacterium glutamicum
  CDS (101)..(2323): RXA00093
aaagaatcgattccggtgccgcaggcctccttgtcacccacgaaccccgcttcgccgcgtgggcagaccgaacaatcatgcttagggatggtgaaatccagtgaccacacttctagcagcaacccgccccaccctgcgcgatgcctttaaacacccatggcgatcgctggcagccatcttgttggtggccgtaccgatgttcctggtgagtttctttcttacctatgatcaatcaatcaacaatgcagctagctatcctggttcccaggtacaagctcactatgacggagaaggagcctaccaactcctccaagaaaaccttccagaagacttccacctggaactctttgccaatggttatccagaagtctccttcggtgatgaagaagtcaatttctttgttgtgcaatcaacaaacgtacaacaagcctcatttcccgccgatgcactcgatgttttaggtgccacaatcggtgataccgtgaccattcacggcaccccggtggaagttcagtcgatttctcccacaaatatcttattgcccgaaggtactctgttttctcttgagaatttctccgaatcagaaactttttccggcacctggtacttccccggatcgaatttcaccgaagaaaaccgacaagcactagaagcagttggctttgaagttaatgaatatcggcgcggccccatatccgtcgacccaaatttgatcccaagctacatcatgggatttttatcgacgacaattctcgccgtcgttgcactcatgctgatctcaccagtatttacaatttccgcctcaaggcaaaccagaactttcgcactgctcgcctcacagggtgccacacctagacacattcggtgggcagtgcttacatatgggctcttcgcaggtcttgttggggcatccattggtttagttctggggcaaataggcatctacggctggtggaaatacacctatcctgaattctccctcaccaccccctggctagttcttgtaggtttttgggcgctggcaatcatcgcttcaacgattgctgcattcttaccggcagtttttgtcagtagatcaagcatcatcaacggaatctacggaggaatctccgacaaaatcatccggtggagccctcgaatgctcatcgggccaatcgtcttaattgcagctgcggtaatcgccttgtttatcggtgacggagagtggggaggcgtcgtcaagcaattatgcttcctggcagccgtcatcgccctgccggcctcagtgcctgcggtgttgtgggcgcttgggcgcctgcctggtttgacattcaaactagctacgcgcgatatgctgcgccgatcaatgcactccattcctgcgattggtgcgctggcggcagtgattatgcttggtacatttatgcaaacaactggacttgcaacccaagccagcgatagagaagctaccgcctcggtgtatcctgaggccgtattcttacgcggtgacacacaaatccctggactcatggggcaaaaaatcgatgtatacggtgataaccatggctttggtatctatgaactagatgtagatttttactcggccaactatgtgcccgcactgacctcattttttggcggaccagttattgccacgcccaagattttagacatgttcggtgtccacgaacaagccgacatctacgcgccatcaacctataattccgggctgcaagaatacgcaatataccccggcgatgaaacctacatgctagacaccgctgctgttttaccgccgctgtactcacatgttttattaagcccagaaacttttgaagaaatcggaggacaaacagaattcttgggaacaatcgtgcttccccaagaactagatgaccaaactgtacaagcaatcaatcggtcaagagatgcgcatttcagccacgacggccataattcttcacttgcttccagtgctgcactaactgcggtggcaattgtggtcgtttcccttgtgatcgtgctggctaatcgcaaactccaacagcacgcattgattgccatcggagcaacacctggaacaatctacaaagtcaatgccttaaatgcagcgttgcttgcccttgtcggaggcatcatgggccttgtctccggatggattgcagcgctgctgacaggcaccactgatgaaattgttgatggagcaattttgaactacggcacgcttgaacacatgatgctgccgtggcctctgttggtaagcctcctcgttgtggcgccgctggtgtgcgccgtgattggggctatagcttctccatcgggacgccaccaagaagcatcaatctaaccttgccggaggaaccgaaa

SEQ ID NO: 1584 - protein, 741 aa, Corynebacterium glutamicum
VTTLLAATRPTLRDAFKHPWRSLAAILLVAVPMFLVSFFLTYDQSINNAASYPGSQVQAHYDGEGAYQLLQENLPEDFHLELFANGYPEVSFGDEEVNFFVVQSTNVQQASFPADALDVLGATIGDTVTIHGTPVEVQSISPTNILLPEGTLFSLENFSESETFSGTWYFPGSNFTEENRQALEAVGFEVNEYRRGPISVDPNLIPSYIMGFLSTTILAVVALMLISPVFTISASRQTRTFALLASQGATPRHIRWAVLTYGLFAGLVGASIGLVLGQIGIYGWWKYTYPEFSLTTPWLVLVGFWALAIIASTIAAFLPAVFVSRSSIINGIYGGISDKIIRWSPRMLIGPIVLIAAAVIALFIGDGEWGGVVKQLCFLAAVIALPASVPAVLWALGRLPGLTFKLATRDMLRRSMHSIPAIGALAAVIMLGTFMQTTGLATQASDREATASVYPEAVFLRGDTQIPGLMGQKIDVYGDNHGFGIYELDVDFYSANYVPALTSFFGGPVIATPKILDMFGVHEQADIYAPSTYNSGLQEYAIYPGDETYMLDTAAVLPPLYSHVLLSPETFEEIGGQTEFLGTIVLPQELDDQTVQAINRSRDAHFSHDGHNSSLASSAALTAVAIVVVSLVIVLANRKLQQHALIAIGATPGTIYKVNALNAALLALVGGIMGLVSGWIAALLTGTTDEIVDGAILNYGTLEHMMLPWPLLVSLLVVAPLVCAVIGAIASPSGRHQEASI

SEQ ID NO: 1585 - DNA, 531 bp, Corynebacterium glutamicum
  CDS (101)..(508): RXA00101
taaaccgtgcaggagatgccgaaccccaatcgtgaaagccgagttgggggagcgaataatctggtggtgtccgcgctgccaaccgctaaactcgtgaagcatgagactaatactcaacctgatttggttattcttcggtggcatttggctcgcgttgggatacgtattcttcggaatcatcgcatgtatcttcatcgtgacgattcccgccggtatcgcaagcttccgcatggctaactacgcgctgtggccgtttggtaggacggttgttcgtaatcctaaagccggagggttttctgccctgagcaacggactgtggtttatcattgctggactgtggctggcgatcgggcacctcaccaccgcggctgcccaggcgatcaccatcatcggaattccactggcgatcgcaaacatccgaatgatccccgtgacgtgtttcccgttcggcaaagaaatctatgacagcaaccgcattcccttcggctacgaaccgatggttaagttttaattcggcgacggactaaacca

SEQ ID NO: 1586 - protein, 136 aa, Corynebacterium glutamicum
MRLILNLIWLFFGGIWLALGYVFFGIIACIFIVTIPAGIASFRMANYALWPFGRTVVRNPKAGGFSALSNGLWFIIAGLWLAIGHLTTAAAQAITIIGIPLAIANIRMIPVTCFPFGKEIYDSNRIPFGYEPMVKF

SEQ ID NO: 1587 - DNA, 643 bp, Corynebacterium glutamicum
  CDS (101)..(643): RXA00108
gaattgggttttgagcatcgtggcggtgcttgttgttgcaagtgccatcgtcatgatgattgcaaagaatcgtaaccagaaataagagggtttattcaccatgaagaagttttttgtcgcaggtgctgtactgagcagtgcgttggttatggcggcgtgttcgcctgctaatcaaagtgattccacctccacgagcgtggagactacttcctccagcagcacgcaggtaagcgatgctgtgatcaccacggaaaacgctgttgttcgtgcgtctgtggaggacagcgacatgacggcagtgttcgctacgttggtgaacaattctgatgatgagatcaacgtttctggctttactgctgatgttgatgctgccagctttgaggtccatgaggttgttgatggcgtcatgcaggaaaagccaggtggttttgtgatccctgcaggggagagcatcgagctggcaccaggtggcgatcatttgatgatcatggggcttgcgaacccaatcgaggctggcgatgaagtgacggtcactcttgaattggctgatggttctgaagttaagcttgatccgatcccggcgcgcaccattgctgctggtgatgaggattatggcgatctgggaactgaaggccacgagggc

SEQ ID NO: 1588 - protein, 181 aa, Corynebacterium glutamicum
MKKFFVAGAVLSSALVMAACSPANQSDSTSTSVETTSSSSTQVSDAVITTENAVVRASVEDSDMTAVFATLVNNSDDEINVSGFTADVDAASFEVHEVVDGVMQEKPGGFVIPAGESIELAPGGDHLMIMGLANPIEAGDEVTVTLELADGSEVKLDPIPARTIAAGDEDYGDLGTEGHEG

SEQ ID NO: 1589 - DNA, 672 bp, Corynebacterium glutamicum
  CDS (101)..(649): RXA00110
atatcgaatgtccagtcacgctaaacttcacccaagatgagatttcgtggcacgattgggaataacgaacgctaattttaaacactggaggagcttccacgtgagcaacaaagacggcctttttactgacggtaacagcacgtttgcacctaaggtggattcaattcccctcagcgatgtggataccagcgttagcggtgaagcctccatcggcacgctgatctccaacgcaacctcccaaatgtccagccttttccgcgcagaagttgagctggcgaagactgaactcgcaggcgaagccaagaaagctgccatcggcggcggcgcattcagcgttgctggcgtaatcgcactgtacagctccttcttctttttcttcttcgtcgcagcactgctgagcgagtggattaagccttgggcagcattcctcatcgtgttcctcttcatgctggtcatcgccgcagctctcgcactgttcggctggcgcaaggtgaagaagatgggcgctccgaagaacaccatccaatcggtcaaccaactgaagaacctggtcccaggtcaggcatccgagaagctggagaaggccaacaagcgtggcctctacacctccgcgtccttccacagccccggcgccatcactggcgaccactaaaaaaggagacttcgatggcc

SEQ ID NO: 1590 - protein, 183 aa, Corynebacterium glutamicum
VSNKDGLFTDGNSTFAPKVDSIPLSDVDTSVSGEASIGTLISNATSQMSSLFRAEVELAKTELAGEAKKAAIGGGAFSVAGVIALYSSFFFFFFVAALLSEWIKPWAAFLIVFLFMLVIAAALALFGWRKVKKMGAPKNTIQSVNQLKNLVPGQASEKLEKANKRGLYTSASFHSPGAITGDH

SEQ ID NO: 1591 - DNA, 714 bp, Corynebacterium glutamicum
  CDS (101)..(691): RXA00117
gttgatcccacagtatacccccacccctatcttgaataccccccagggtatatggcacacttggaatcgcccatcactttgagattgaaaaggacaaggtatgacttccgctcaaccgattacttccgtagatgcacagactctaaaatcgtggatcgataagcatgaaggactcaccgtcattgacgtccgcactgcacatgagttttcaaatttgcacattaaaggctcttacaacgtgcctctaactacacttgctgagcattccgaagagatttcctctcgtgttggagaacatgttgttttggtgtgtcaatccggcattcgagcaggtcaggcacaacaaaagctggcacctttgggaatttccaccgtggctgttttggagggtggcatcaatagttttgctaaggctgacggtgatgtggtccgcggaacccaggtgtgggatatcgaacgtcaggtgcgttttgccgctggatcattggtgctcgcagggcttgcgggaggtaaattcctttcaccaaaagttcgcaccctgtcgggaattattggtgcgggtctgacattttctggcgtttccaacacctgtgccatgggcaaagctctgtccgccttgccgtggaataaaactaagccagttcctaccgaaaccgagacattgagcaagcttccaagccctaaggagaactaaatgtctatcaccattactga

SEQ ID NO: 1592 - protein, 197 aa, Corynebacterium glutamicum
MTSAQPITSVDAQTLKSWIDKHEGLTVIDVRTAHEFSNLHIKGSYNVPLTTLAEHSEEISSRVGEHVVLVCQSGIRAGQAQQKLAPLGISTVAVLEGGINSFAKADGDVVRGTQVWDIERQVRFAAGSLVLAGLAGGKFLSPKVRTLSGIIGAGLTFSGVSNTCAMGKALSALPWNKTKPVPTETETLSKLPSPKEN

SEQ ID NO: 1593 - DNA, 378 bp, Corynebacterium glutamicum
  CDS (101)..(355): RXA00118
atgggcgattccaagtgtgccatataccctggggggtattcaagataggggtgggggtatactgtgggatcaacgttccagggcaacaaaaggagaaaaaatgcaactcaatcctgatgagatcaccccagtgctcaaccgactcaagcgcgcccaaggtcaactcaccggagtaatccgaatgcttgatgaaggcgaagactgtaaagccgtagtcacccaacttgccgcagtcacaaaagcgctggacagggcaggcttcgccatcattgccacaggtttggaacagtgcctcaccaaccctgatggcgacatggacaaaaaggaactagaaaaactgttcctgtcgctggcttaactatggcctagttcagggcg

SEQ ID NO: 1594 - protein, 85 aa, Corynebacterium glutamicum
MQLNPDEITPVLNRLKRAQGQLTGVIRMLDEGEDCKAVVTQLAAVTKALDRAGFAIIATGLEQCLTNPDGDMDKKELEKLFLSLA

SEQ ID NO: 1595 - DNA, 882 bp, Corynebacterium glutamicum
  CDS (101)..(859): RXA00119
actaatgagaactgtttttcaattggtgcaggatttccacaaggaagctaggggagaggggcttccaatcaagtggggtccatcgcgtggagaatttggcatgctggagtttcctgcagatgtcattcccgagaacatcaaacacattgcgcagacaaagttccagactgaagcaacttcggtggaggatattcgtcgtgcgattaacctgctgagtgatcaggcggagcgtgcgggtgcgtcctttaatcctggtttcattcttgcgcaggtgggctccaccatcgtggaggtttatggcggtgctccggttgcttggctggatgcggttgagctgttgattagtcctgatgtggagtgggttggggttcatggctcaaggaagctcgatattaatgtcagcggagaattgtccggggtgatttctgctggtgacaagttgggtgaactgcttggcgatgattggacaatcaacattgttcacggcgagtacaaaatccagatcgaagatgctcgaccaagtactgcattccttgcggacgcgactgaactgattaatcaggcaaactctgagattgttccgttccatgttcggatgctcagcaactcgaaaattgtgatgtctggctttagtgattattcactagcgggtgatgcgattacatctgcgggaaaactggctgaattggcgaggccttttgcccactggaaagaaaacgtcattcctacgatagaaatagccatggactatgaaccatcaccggtggcagatctttggcagggagattcttcggagacacctgagcctttcgacgattttgagcgcttattgcgggaagaaatgcttattcctgagatttagctggtcatagacctgctgtt

SEQ ID NO: 1596 - protein, 253 aa, Corynebacterium glutamicum
MLEFPADVIPENIKHIAQTKFQTEATSVEDIRRAINLLSDQAERAGASFNPGFILAQVGSTIVEVYGGAPVAWLDAVELLISPDVEWVGVHGSRKLDINVSGELSGVISAGDKLGELLGDDWTINIVHGEYKIQIEDARPSTAFLADATELINQANSEIVPFHVRMLSNSKIVMSGFSDYSLAGDAITSAGKLAELARPFAHWKENVIPTIEIAMDYEPSPVADLWQGDSSETPEPFDDFERLLREEMLIPEI

SEQ ID NO: 1597 - DNA, 834 bp, Corynebacterium glutamicum
  CDS (101)..(811): RXA00121
gatgtccaaatactgcgaaaccatcgaagcgtttcacaaccgtccggcatcagctttcggcgctgtcgaccccatcttctaaacaagaaaggcccctccaatgttgagcgatctgagctccatttttgacttccaagacctctccggcaccttctctgtcgtcgacgttctcatcactttggtcttgtccttcgtcctgacctccatcgtgggtgtggtgtaccaaaagacccaccgccacatctcctacagccagtcattcgtacaaacgttggtgctggtgggaatggtcattgcaatcatcatgctggtggtcggctccaacattgcacgtgcattcgccctggttggcgcgctttcggtgattcgattccgcaacgcagtgaaagaaacccgagatgtgggcttccttttccttgccatggcaatcggcatgacttgcggtacccgcttctacgttctggcgatcgctgcaaccatcgttgtctgtggcgttctgttcatcatgtaccgcttcgactggttcaaggctgatatccagcgccaggtcatcaaggtgcaggtcccagccgatggacaagctgattccggcaggtcctacgcagaagaagttgaactgatcctcgcacagtactgcacttcctttgagatgatgtccgctgaatctgtccgcggcggagccctgaccgagttctcctacaccgctcaaatgcgcaagaacgtgaagccacatgagctggtcgccaagatgcgcgatgtgaactacggccaaaaagcgactgtcctgaccggtcacgatcaaacggatgtatagaaaatgcctagctttaaatc

SEQ ID NO: 1598 - protein, 237 aa, Corynebacterium glutamicum
MLSDLSSIFDFQDLSGTFSVVDVLITLVLSFVLTSIVGVVYQKTHRHISYSQSFVQTLVLVGMVIAIIMLVVGSNIARAFALVGALSVIRFRNAVKETRDVGFLFLAMAIGMTCGTRFYVLAIAATIVVCGVLFIMYRFDWFKADIQRQVIKVQVPADGQADSGRSYAEEVELILAQYCTSFEMMSAESVRGGALTEFSYTAQMRKNVKPHELVAKMRDVNYGQKATVLTGHDQTDV

SEQ ID NO: 1599 - DNA, 1746 bp, Corynebacterium glutamicum
  CDS (101)..(1723): RXA00122
gatgcgcgatgtgaactacggccaaaaagcgactgtcctgaccggtcacgatcaaacggatgtatagaaaatgcctagctttaaatctgctcgatggaggatgaacagacgcctcttcctaggaacttccgcagctatcatcgctgtcggtggcgtgctcggtggagtgcaggttgtaccttatatttcctctggtgaaatccaaacgtcagcatcatcgactgccacgatcgatgtcggtgcaggcaatgtcgatatttttgatacctccgtttcccatgaaatcagcctgcaggtttcgcaggaaagcctcgatgagatgctcgcggactatcaagaagacggttccaaaacctgggtgaaagcaaccatcacgattgatggcgtgaccattgaaaacgtcggcatccgcctcaagggcaactccacgctgtccgggttgggtcgaacatctgaagaaggcggacctcaggcaccagaaggcgtcgaagagtttacagatctcagtgaagaggaaatcgcccagtttgaggaacagttcgcggcgcagcaagagactactgacgcttcagagaccggtgaaactgcggaaaatgaagagactcgcggccccggcggtggcatgggtggtggcggcatgggtggcatgacttcggtcgatgccgacgatgtcagcacctggccacttctgatcagcttcgacaaatacgaagacggccgcgtctaccaaggcatgacccaactggcactacgccccggcaccaccgtggtcaacgaagcaatggcgctggccctgaccgcagaaaccggccaggtctcgcagcaatccagcttcacaacgttttcgcttaacgacgagccctccaccactcgactccttttgaagcaccccgatgaaaattatgccgacgcgctcggcaacggagtcctcttcaaagcagattccaacagttccttcacctaccaaggcgaagaccaaactgaatacgacggacagttcaagcagatcaacggtgacggcaacggagacatccaaccgatcatcaacctgctgaaatggctcgacaccgcaagcgatgaagagtttgctgaacacctctctgactacgtcgatgtggaaagctttgctcgctacgttgccactcaaaacctgttggtaaattccgacgacatggctggtcccggtagtaattactacctgtggtacgactacgacaccggcctgatcagcgtgatctcttgggatttgaacctcgcaatgtccggctcaactgatgctggcccagatgatgaaatctccatgggcggaggtggcggtggcggaatgcgtcctggtggaacgaccgacactgaaattgaaggtactgcgaccgaggatatgcctgacatgggcaatatgcagcaacgtgaacgccctgaaggaatgccagacatgggtgagatgcctgatatgggtgaccgggaaggcggtggatcgatgggaggaaaccagctcaaggaacgtttcctcgcttccgatgcattcacggaaatctatgagcaggtgtactgggagctgtatgaagaaatgtatggttccggaactgccatcgagttgttggatgagattgcagcgtcaattccagaaactgatgcggtgactgcagatgagatcgctacggaagtggcgtcaatgcgggaatggatcactgcccgcacagaagcgttggctgctttgcaagagtgatcaaactagaaaaccaacaa

SEQ ID NO: 1600 - protein, 541 aa, Corynebacterium glutamicum
MNRRLFLGTSAAIIAVGGVLGGVQVVPYISSGEIQTSASSTATIDVGAGNVDIFDTSVSHEISLQVSQESLDEMLADYQEDGSKTWVKATITIDGVTIENVGIRLKGNSTLSGLGRTSEEGGPQAPEGVEEFTDLSEEEIAQFEEQFAAQQETTDASETGETAENEETRGPGGGMGGGGMGGMTSVDADDVSTWPLLISFDKYEDGRVYQGMTQLALRPGTTVVNEAMALALTAETGQVSQQSSFTTFSLNDEPSTTRLLLKHPDENYADALGNGVLFKADSNSSFTYQGEDQTEYDGQFKQINGDGNGDIQPIINLLKWLDTASDEEFAEHLSDYVDVESFARYVATQNLLVNSDDMAGPGSNYYLWYDYDTGLISVISWDLNLAMSGSTDAGPDDEISMGGGGGGGMRPGGTTDTEIEGTATEDMPDMGNMQQRERPEGMPDMGEMPDMGDREGGGSMGGNQLKERFLASDAFTEIYEQVYWELYEEMYGSGTAIELLDEIAASIPETDAVTADEIATEVASMREWITARTEALAALQE

SEQ ID NO: 1601 - DNA, 579 bp, Corynebacterium glutamicum
  CDS (101)..(556): RXA00127
ttgtggggcgccgggggcgtcgttatgcagtgactgccagcgtgtgtggaggaagccgccaacattggcgcggcttgatttagatttaccggtgtggacgttgtcgccgtatgacggcccgcatcgcaacgtgctcattgcgctgaaggagcacggccgtgcagaccttgtggcgtttgtgggcgcggtggtgggggcgtcgataagctatctggcggctcagggggaaattgagcacgacatcacgctggttccggcgcccacccgcgccacctcgcgacgccggcggggcggcgatccggttgagcgggtgtgcaatgcatcacgcttatcgacgtttccctgccttcaaatctcatcccgcacaccagactccgtcggtcaaactgcgcaacagcgaagactcaatatgcgagtggagttagtccgacaacctcggggttctgtcttgatcatcgacgatgtggtaacaacgggggcaactatttccgcatctgcaaacgttcttcgcgcagcgggtgtgcaggtcagaggagctttaacttattgccaagcgtgatcttggatataaaaggggcc

SEQ ID NO: 1602 - protein, 152 aa, Corynebacterium glutamicum
LSPYDGPHRNVLIALKEHGRADLVAFVGAVVGASISYLAAQGEIEHDITLVPAPTRATSRRRRGGDPVERVCNASRLSTFPCLQISSRTPDSVGQTAQQRRLNMRVELVRQPRGSVLIIDDVVTTGATISASANVLRAAGVQVRGALTYCQA

SEQ ID NO: 1603 - DNA, 693 bp, Corynebacterium glutamicum
  CDS (101)..(670): RXA00134
gcagctgtgctccaccagtgactaaaaacttgtctttcacgtgccccaccttatccgtgttccccacccctgtgcgtaacgacagctagaatctcaagttatggccgttcatttaaccaagatctatacgcgaaccggggacgatggaaccacggggctctcaaattttgagcgagttcccaaggacgatccccgccttattgcatacgccgactccgatgaagcaaactgtgcgattggccaagtgcttgcactcagcagccctacggaagatatggcaaccttattgcggactattcaaaatgaactttttgatgtgggcgcagacttagcaaccccgattgaggagaatccgaagtatcccccacttcgagttcttccggaatatatcgaacgacttgagaaggagtgcgataaatggaacgaggatgtgccggcgttggattccttcattttgccgggtggcacgccagcagcggcactcttgcacaccgcaagggtaattacgaggcgcgcggagagagcagcttggatagcggtgcgggaatttccgagcaccacctctaccttgccagcccaatacctgaatcgtcttagcgatctgctgtttattctttcccgtgttgccaacaatggcaatgatgtgaagtgggttccgggcggaaaaagatgaaaaccaccctgcgaccgtga

SEQ ID NO: 1604 - protein, 190 aa, Corynebacterium glutamicum
MAVHLTKIYTRTGDDGTTGLSNFERVPKDDPRLIAYADSDEANCAIGQVLALSSPTEDMATLLRTIQNELFDVGADLATPIEENPKYPPLRVLPEYIERLEKECDKWNEDVPALDSFILPGGTPAAALLHTARVITRRAERAAWIAVREFPSTTSTLPAQYLNRLSDLLFILSRVANNGNDVKWVPGGKR

SEQ ID NO: 1605 - DNA, 309 bp, Corynebacterium glutamicum
  CDS (101)..(286): RXA00140
ctcaacgatattcagctttccgcaatgctgaaaaacgccatcgatcacgtcctcgcgattcaagatgccgtagccaatgcaggcaaggaaatcggctaacatgtcggacgagtccatcgaagagcaggaaaaagaactcgcggcgctgaaggctcaaatcgatgaactggaaaagaaagacaagcagaacaagctaatcatcgagattttgtccaaggccgtcgaaaagaatgtggcagaggcagaagcgaaaagagcccgcaaatatccgcccaatcccctgtggtgaattctaaggcgtcgaacttt

SEQ ID NO: 1606 - protein, 62 aa, Corynebacterium glutamicum
MSDESIEEQEKELAALKAQIDELEKKDKQNKLIIEILSKAVEKNVAEAEAKRARKYPPNPLW

SEQ ID NO: 1607 - DNA, 585 bp, Corynebacterium glutamicum
  CDS (101)..(562): RXA00141
gtcggctcctacgttatgagctccatcgaatccgctgttcagtgcttcgaatggcttgagcagcaattcccagatctagtcacctggaaggacgaacaccatgaccactgattccaattctgcgacaatcccaaccccaaagccgattccagtgaccatcgaccgaatctccctcatcatgaaagaattcggcattgacctatccatcgccgatgaacaaggcaccggatcccaagtagccagcgccaacctcaacggccatcacgtcatgttcgctgtcatcggttcagtcctgatcgttcgtgccgatcgcgccaccgaaatgccagtctccgacggcaaccccgcatggcatctcgcctgcaaccaagtcaactgtttcaacttcgctgccaaggctgtcgtagttgatcgcaccgacaacatcgtgatccgcgccgagaaggatgtccccatcgccgctgggctcaacgatattcagctttccgcaatgctgaaaaacgccatcgatcacgtcctcgcgattcaagatgccgtagccaatgcaggcaaggaaatcggctaacatgtcggacgagtccatcg

SEQ ID NO: 1608 - protein, 154 aa, Corynebacterium glutamicum
MTTDSNSATIPTPKPIPVTIDRISLIMKEFGIDLSIADEQGTGSQVASANLNGHHVMFAVIGSVLIVRADRATEMPVSDGNPAWHLACNQVNCFNFAAKAVVVDRTDNIVIRAEKDVPIAAGLNDIQLSAMLKNAIDHVLAIQDAVANAGKEIG

SEQ ID NO: 1609 - DNA, 600 bp, Corynebacterium glutamicum
  CDS (101)..(577): RXA00142
atcctcaatttccgccgtaagcgcaacgactaaaaccaccatctgtagtgtggtggaaaagttacttttaaaaggattttggaaggactgaaactccccagtgcctcaatcacccacagcacacgaccccaacgacatccaggaatttaacctcgatgccgttgcagggattctccaggacgaaaaactggactaccgcatcgatgaacacgacggcgaaaaagtaatccgcaccggattcatcaacgccgccatcagcttcatcctcttagacggcagcttaaccatggaagccatgtggcgaggagccccctccaccgatgctgccgcacaagttctcgcggccaccaacgaatggaacctcacccagttcgcacccaccattcgattcttcgaactcaacgaaggcaccctcgccatcaatgcactgcgacacgtcgttgtttccgcaggcatgagccacaaccaagtcggctcctacgttatgagctccatcgaatccgctgttcagtgcttcgaatggcttgagcagcaattcccagatctagtcacctggaaggacgaacaccatgaccactgattccaattctgcgacaatcc

SEQ ID NO: 1610 - protein, 159 aa, Corynebacterium glutamicum
VPQSPTAHDPNDIQEFNLDAVAGILQDEKLDYRIDEHDGEKVIRTGFINAAISFILLDGSLTMEAMWRGAPSTDAAAQVLAATNEWNLTQFAPTIRFFELNEGTLAINALRHVVVSAGMSHNQVGSYVMSSIESAVQCFEWLEQQFPDLVTWKDEHHDH

SEQ ID NO: 1611 - DNA, 897 bp, Corynebacterium glutamicum
  CDS (101)..(874): RXA00150
agctgagcagggatcggcactagcttctactacgataacgagaactttgtttcaatacattcaaaatggcggaatattttgatcacgggggtgcaactgtatggtgttttctatgcatgacaaaggtgagacccaggagaatcctgcggacatgtcaggacgcctaaacacaccaatttccacggtctttcacttctttagctcacttttccatgacgctctgcgcagtgttgcccagtggagtgcgtggaagaaaatcgctgtatcggttgtcatcgtcgcaattatttccgtaacttttcttgtcgatgtccccccgatttcggtttatcgtgactgggcaaacaacgccggcgacgcttttgtcttagttttttgcgccttttatatcctcattactcagttccctatcccccgcacagttctcacactggcctccggcgtgctgttcgggccggttcttggatcagtcgtggcgctgggttccaccacagtgtcagcggtaatctcgctcctcattgttcggggtctgcttggcgattggatggcgccacgtttaacgcaccccgcagtctcacgcatcaatacccgacttgagcaacgtggatggctggcgattacctctttaagaatgatcgccgctatccccttttccatcctcaactatgttgcagccttgactagcgttcctgttttttcttttgccatcgctaccttgatcggatctgcaccaggaaccatcgtcaccgtcgttttgggagatgcagtcacaggttctggaaactggactgccgttgcattcacggtatttttagcgattttgggtgttttaggtatctttttagatcaaaagatgccagtcaagcctggaaagtagacaatataaggtagggttgg

SEQ ID NO: 1612 - protein, 258 aa, Corynebacterium glutamicum
MVFSMHDKGETQENPADMSGRLNTPISTVFHFFSSLFHDALRSVAQWSAWKKIAVSVVIVAIISVTFLVDVPPISVYRDWANNAGDAFVLVFCAFYILITQFPIPRTVLTLASGVLFGPVLGSVVALGSTTVSAVISLLIVRGLLGDWMAPRLTHPAVSRINTRLEQRGWLAITSLRMIAAIPFSILNYVAALTSVPVFSFAIATLIGSAPGTIVTVVLGDAVTGSGNWTAVAFTVFLAILGVLGIFLDQKMPVKPGK

SEQ ID NO: 1613 - DNA, 720 bp, Corynebacterium glutamicum
  CDS (101)..(697): RXA00151
aagtagacaatataaggtagggttggagaagattctttacttcttcactcattcgccctgacagcgaatccactacaataaacaaagggggcagccacccatgtgggcactgcatgccagataccgcggccgagacacacgacgagccgaattggttaaaagatttgcagaagctttgtccaccctcgaaggtgctggccagtttgaagtcattggtgtcgaagacatccgagcacacatcacctcaccgttaaccacatgtgatgttgtcatggcgctactcgcagctggcgattgggcaatcggaattggtgttatccccaccgttgacggaacagtcgatgaatcggatgaggccatcatcgaacaggtaaagaaaatttcctctgatgctctgcgccccaccgccaaggcgggaacggtcaaagttaggatcgccggaaccaaacgggacaatactcaagccttcaacatctccgctgcattcacgttgattgggcaagttctgtcaaagcgcaccatcgaaggacgcgaagccaccgcactcgtccgttctggactgaatcaaaatgaggcagcccaagagctcggtatttccaagcaggcaatgtcgcagcgattgcaggcggcaggttggcaggcggaatctgctggttggcaattggccgtaaacctcatcgagcaggctggcaagcgctagcaggcgatttaagagcctga

SEQ ID NO: 1614 - protein, 199 aa, Corynebacterium glutamicum
MWALHARYRGRDTRRAELVKRFAEALSTLEGAGQFEVIGVEDIRAHITSPLTTCDVVMALLAAGDWAIGIGVIPTVDGTVDESDEAIIEQVKKISSDALRPTAKAGTVKVRIAGTKRDNTQAFNISAAFTLIGQVLSKRTIEGREATALVRSGLNQNEAAQELGISKQAMSQRLQAAGWQAESAGWQLAVNLIEQAGKR

SEQ ID NO: 1615 - DNA, 549 bp, Corynebacterium glutamicum
  CDS (101)..(526): RXA00153
cctcgatttgagtaaagaggacgtcctcgcctgatttttcgggtgtgtttttgcgtggcgagccctgcctggcccttccaaattatgtagggtggcctgcgtgggagcaataatttggtttatcggagcattggttcttgctggcttggaattggcagtaggtgagttcaccttattgatgctcggcggtgcagctttggcaaccgccggcgtggcactcatcggtgtcccagtatgggctgaatttgtcaccttcgcggtggcctcagctgctctactgatgttcattaggccggccattagaaagcgtctgctgaaaccaaaggttctggactcttcaccacgagcacttgttggccaccgtgctgaagtgctcgaagatgtcggagcgaccagcgggcaggtccgcctggatggttcaatttggtccgcccgcagcatggatcccacacacaccttcgcggaaggtgaaattgtcagtgtcattgatatccaaggcacgaccgcgattgtatggaaagaagcctaaatttttaacaatcaaatagt

SEQ ID NO: 1616 - protein, 142 aa, Corynebacterium glutamicum
VGAIIWFIGALVLAGLELAVGEFTLLMLGGAALATAGVALIGVPVWAEFVTFAVASAALLMFIRPAIRKRLLKPKVLDSSPRALVGHRAEVLEDVGATSGQVRLDGSIWSARSMDPTHTFAEGEIVSVIDIQGTTAIVWKEA

SEQ ID NO: 1617 - DNA, 906 bp, Corynebacterium glutamicum
  CDS (101)..(883): RXA00155
gttgcgggagtgtccaccaaaaatattgcctgcataggggtctgaaaaactcatagctcaccaccctagtcaaagcactgcactacacttccctaacactatggaaattcgagcaaacgtttattcaccgcttcaaaatactgccgtctggctaggtgcgtggctctatgaattagtgcccaccgaagatgtcatcgatgcgttcgtcgatctcggcggcccgcacaccttcggcgacggcgggctgctcgatatgctgcgaactttaaaagaattaacaagcacgcttatcgacgcccccttccacggtccgattttaactctcgcactcagcggcccaggccaagtgccggcgttgccggcaggttcacgcgctgcggtcttggcctccgcctcgaaggagggggcgttggtgctgggcggcgtcgataagcagcattcttgggcgcttattcctacgcgcggtaaggatgccactgagtggaatttggtggaggtggagggctttttgccggcgattgcgactgtctcgcccggtgaggcggatcagctgctccgtcaggcgacagatcaggcggcaaatatcattgagttaagtggctacgcttcacttgcgccgaaatctttgaagaatccgcgactaaccgtgggcatgctgtcagatttttacgacaccccggggcttccctatgcagtcccagagaggtcggcgaagctttttgcgcgcgcagatcgcgtggctgccatcgcagagaccgtgcaggaaaccatcggcgatcacagcctggatccacagttgattttcctgtggagccatattcggaccgcgcgcatggctggggtgagttatgccctcgcagagtttgcgagggactatcactcctagttggcagctggcgccgctga

SEQ ID NO: 1618 - protein, 261 aa, Corynebacterium glutamicum
MEIRANVYSPLQNTAVWLGAWLYELVPTEDVIDAFVDLGGPHTFGDGGLLDMLRTLKELTSTLIDAPFHGPILTLALSGPGQVPALPAGSRAAVLASASKEGALVLGGVDKQHSWALIPTRGKDATEWNLVEVEGFLPAIATVSPGEADQLLRQATDQAANIIELSGYASLAPKSLKNPRLTVGMLSDFYDTPGLPYAVPERSAKLFARADRVAAIAETVQETIGDHSLDPQLIFLWSHIRTARMAGVSYALAEFARDYHS

SEQ ID NO: 1619 - DNA, 1305 bp, Corynebacterium glutamicum
  CDS (101)..(1282): RXA00159
cttagggggtaaccccacccctgtacaagttttcgtgctaccaaacacgccgtgctaggggtgtcgcatggtgcaatgatccccgctaacctgggattccatggagaatgttagttccgtcacgtcggatggttcggtagcggatgtgcatgccgaacggtggcaagaattgctcgcacgtttggatgccgatgcgccggatattgcggagggcaccgccgcaaagttgctcgctacgatcccgggctatgagctcgttgacgcggggccgatcagggagtcgtcgatacgcaatacggccttgattattcgcgtgattaacgcgggcaccgagccaaaggccgaggacttgcctgaggctttaaggcttgccgacgaacgtatagcgcaaaatgtgccgctgggaagtgtgctgcacggttttcggatgtctctgggggaaattctggagcatttggtgcagttgggcccggaatacaatattgatcccggcagaatgctgcgctggtccacactgatgtgggcggtcaatgatgccttttctacgcgtgccacaagggtgtaccgcgatcacgaggtcgccacggcgatcgccgattcggtgcgaaggtcagaatggatcggcaaagcggtctcggaaggctctgaactgtcagagcttttatggggtgctgcgatgtatgacgttcccgccgacactcctctaagagcattggcagccacctcacctgatcatgcgaaagctgaaacacagatccagaagtggactcagcgcgccggagtgcgggtgctggcatcggtgcagccaagcgtgatcgtggggatcgtgattggggagccgaagcgaaacgtggacggccctggttttgctgtgggtttgggtagggcagaggtgctctcaaagctggcggactcatataaggatgcatcccttgtattgaaggctgccgataatctgaaacttaatgaggtgcagcgggcacaagatttgtcatggaagttggctatccatgcaagcccacgggtgacggagattcttgcgcagaaatatgtgaagccactaagggaatctggcgagtttgctcatgagatcgtggaatctttgcgggcatatgtggacaaccagatgaatattcctgctgctgcgcgcagtattcctgtgcatgtgaatacgcttcgctatcggttgcgccggtttgaggagttaacgggctgctatttggaggatacatccacggtcattgaagtgtcgtgggtgctggaagtctttggccgggagctgtagaaaattgcacctatatatat

SEQ ID NO: 1620 - protein, 394 aa, Corynebacterium glutamicum
MENVSSVTSDGSVADVHAERWQELLARLDADAPDIAEGTAAKLLATIPGYELVDAGPIRESSIRNTALIIRVINAGTEPKAEDLPEALRLADERIAQNVPLGSVLHGFRMSLGEILEHLVQLGPEYNIDPGRMLRWSTLMWAVNDAFSTRATRVYRDHEVATAIADSVRRSEWIGKAVSEGSELSELLWGAAMYDVPADTPLRALAATSPDHAKAETQIQKWTQRAGVRVLASVQPSVIVGIVIGEPKRNVDGPGFAVGLGRAEVLSKLADSYKDASLVLKAADNLKLNEVQRAQDLSWKLAIHASPRVTEILAQKYVKPLRESGEFAHEIVESLRAYVDNQMNIPAAARSIPVHVNTLRYRLRRFEELTGCYLEDTSTVIEVSWVLEVFGREL

SEQ ID NO: 1621 - DNA, 585 bp, Corynebacterium glutamicum
  CDS (101)..(562): RXA00161
ttactatacatggtgtagtcccaaattaactaatgcgggtgaccaactgcaccgtaaaaaaaattcgcttatcgtaaatcagcaggtagaataacactctatgagcgagccagggccatccggggttaaagaaaagaagaaagtaaaggcaagtcacattgtctttcttctcatttgttttatcgcagcctgcgcgttggcgtggtggcagtggtcaagattccagtccgggtctggaactttccaaaaccttggctatgccttccagtggcctcttatcggagcattctttgtttatgcctaccgcaagtatttgcagtatgagaatgagtccattgagttagaaaacatggaagccaaaatgatggcggagcaaggcaaaacaccagttgcgcaatcagagcaggaagatagcttcgttcagctctctcaccgtccgagcctggtggaagatgacagcgtcaaggaaatcgacgaatccttcctgccgtctcgcccgacgatggatgtggaagagttcaacaggttgaatgatccgcatgcacggagacgtcgaaaagcataaacctggaacttttccgggcc

SEQ ID NO: 1622 - protein, 154 aa, Corynebacterium glutamicum
MSEPGPSGVKEKKKVKASHIVFLLICFIAACALAWWQWSRFQSGSGTFQNLGYAFQWPLIGAFFVYAYRKYLQYENESIELENMEAKMMAEQGKTPVAQSEQEDSFVQLSHRPSLVEDDSVKEIDESFLPSRPTMDVEEFNRLNDPHARRRRKA

SEQ ID NO: 1623 - DNA, 2196 bp, Corynebacterium glutamicum
  CDS (101)..(2173): RXA00169
tttgctgtgtctaagtgtgtggggtaattgtaatataattggtagaattttctctaattaatattttattaacttacggagaaagtttatgataaatatgatgtcgttgggtaatccagcagcaatgctcgctgcgtacaacaccagcacgcaggtggcaccgcagccacagctgggaccacgtgctggagaagttcaactcagtagcgaacagcaagccatgattgattatgtacttgctggcaaagatgtcattgttgatgccaccgtaggctcgggcaaaactaccgctattcaacgactgtgttcgatcatgggtgcagaccatgacgtgctgtatttgacgtattcgaagttgttgaaggtcgatgcacagcagcgcgttcgtggcgccaaggtgcagaactatcacggcattgtctatccgcatctactcaaggccggcatcaagtgtggtattagcgagtcgattcgggagtttaacaagaacttcaaacacatttctcgcacgttccccagttacgacctgctggttattgatgagtaccaggacatcaatgaggactatgcagaactgctgcgcaacattaagtctgtgaatccgcttatgcagattgtcatggtgggtgatttggaacaaaaagtccggtctgacaccacgttagatccacaagaatttgcagcacaattgtgtgaagatccagtcttcgcgccgtttacacagtcgtttcgaattggcgaggctatggcagcgggtttggctgatgcctggaataaaccgattgtgggtgccaataccgcacagcagattgaatataggtctttcgctgaggcagtggtgttgatccaaagcaccgagccgagcaaactgttgtgtttgggtagccgcaatgggcagatgtcagatgcgcttaatgtcgtggagaggaagtcgccggcaaagttcaataagaaaactgtgttcgcctctattcgcgatggtgattcccagattgcacaccctaatgacgctgcggtgtttaccacctttgattccagtaaaggtctagagcgcgatacctgcgtggtctttgactatgacgaagaattctgggacatgcgtcttggttaccccaatgttgatccagtggtcatgcgcaatgtgtttttggtggcagcatcacgcggtaaaaacaaggttgtttttgtacgtagcgattctcttcaagcagcgtatgaggctggtgcggactgggctgcagggctcgctgtgggtgtggtggacaacaatactgaggttgcacctgaggtagatgcccatacgccggcagaagaaagtaagggtgatgtgggtgaggttcagtcacagattgagcgcatgatgggttttatccctgtttcagtgtttaaagaactacctgagttggcgccgagcgaatatgcgcgaccgatctctgtgactgaagcctttgattttaagtacgcagagaatgtcgaagcatgttttgacctgcttgatgtcaagcgtctcgacaacggcaagggtgcagccattgaggtcaatcgcagtgacgggcttattgatctctcacccacagtgggaaactttcaggaagcagtgttcttcaaggactacaacgttcatacagcactatcggcgtacccgagtcagttcgcgaaaaatcttaaacgtttggtgaagaaaaacaatagcgtatggcgtaactgccttattgtcacagcagcgtccacagagcagatgcggtatgtcgatcaggtgcgcagctctatcccggttgctgcggagaaggcattggtctcacggctgagtacgaggctgaatgctgattcacgtaatcagattccactgatccttgacggcgaggcagtacagagcaaagtagtgcgcacgccaatgtcttttgcaggtgtcgcagatgcggtgcacaagggtgtgctttatgaattgaaattcgtctctgagttgacacatccgatgtttttgcagctcgcaatgtatttggtcatgtctgggatgaaggacggtattttgtggaacacccggacagatgaggcgtggcaggtgcgtgttcctgacccgaagcgttttcttaatgctgtggtgttgtgtgtctccaagcaggattaccgggtcggtaactttgatctgccgagcactggtggaggtgcgcgctaaatggtgttgatgtgtggggt

SEQ ID NO: 1624 - protein, 691 aa, Corynebacterium glutamicum
MSLGNPAAMLAAYNTSTQVAPQPQLGPRAGEVQLSSEQQAMIDYVLAGKDVIVDATVGSGKTTAIQRLCSIMGADHDVLYLTYSKLLKVDAQQRVRGAKVQNYHGIVYPHLLKAGIKCGISESIREFNKNFKHISRTFPSYDLLVIDEYQDINEDYAELLRNIKSVNPLMQIVMVGDLEQKVRSDTTLDPQEFAAQLCEDPVFAPFTQSFRIGEAMAAGLADAWNKPIVGANTAQQIEYRSFAEAVVLIQSTEPSKLLCLGSRNGQMSDALNVVERKSPAKFNKKTVFASIRDGDSQIAHPNDAAVFTTFDSSKGLERDTCVVFDYDEEFWDMRLGYPNVDPVVMRNVFLVAASRGKNKVVFVRSDSLQAAYEAGADWAAGLAVGVVDNNTEVAPEVDAHTPAEESKGDVGEVQSQIERMMGFIPVSVFKELPELAPSEYARPISVTEAFDFKYAENVEACFDLLDVKRLDNGKGAAIEVNRSDGLIDLSPTVGNFQEAVFFKDYNVHTALSAYPSQFAKNLKRLVKKNNSVWRNCLIVTAASTEQMRYVDQVRSSIPVAAEKALVSRLSTRLNADSRNQIPLILDGEAVQSKVVRTPMSFAGVADAVHKGVLYELKFVSELTHPMFLQLAMYLVMSGMKDGILWNTRTDEAWQVRVPDPKRFLNAVVLCVSKQDYRVGNFDLPSTGGGAR

SEQ ID NO: 1625 - DNA, 1977 bp, Corynebacterium glutamicum
  CDS (101)..(1954): RXA00170
taactaattctttacctatcctcagtttgtacatattttccgacaggtaaaggtttgatataagcggttggtacgaagactagtgggtgtttctgctgtcatgttgctggccatcggggttgcatctccggtagctcaagcacaagtggaagatcaatttgagcttgtaaaagaaatcagtgatgagcagtttgctgatgatggtgttgactatgttcccaataggaatgctccgactgttaaggaacaacttgaggatttcgaatcagcacatccagaagtagtcattgagtatcacgagcacgtcaacgatagtaaagacaatgttgaggaacttccgctacctaagcgggacatcgttgcaggggaaatgcgctcagatgtcatcgagttaccggagggggtgagcaaggacgaagctgatcaggtggaggttgcggaagcgcgacttaatgagggcgcacgattgatggctgcaactgggtgtgaggctatgtggccaacaggtttctcagtttgtggccggattcttgacgcttatcggcaggttggaggtcagttgtcatggcttgggccaccaaagtcaaacgagttgaccaatcccgacggtgttggcaaaagaagtgaatttgttgggggtgccatctattggcatccagacacaggcgcttatgcagtgaccctggacggtttgaggcagtgggggaccttgaactgggaatcagggccattggggtacccaacctctggtccgatggatacaaactatccccttactcagcgacagacttttcaaggtggtgacaactattacaacccattgactggcggtgctgtgtggggcgatattaaacagcgctacgaagaacttggcggctcgaatcatgccattggcatcccgatcactaatgagctacctagcggtactgagtatttttacaataatttcttcaatggaacaatttcgtggcgaaatgatcgtcagacacggtttatgtatttggctacgcagcgggtgtgggatgcgttgggtcgggagacgggtcgtttaggttttcctgaagcagatgaaacacctgaggtttctggtctattccatgtggtgaattttgcggagcgcggggtgattgcgtggaatggaatcctaggcgccagagagctgtatggtgatgtttactccctgtggctgcaataccaaaataccgatactcctttagggtggccgataccatcattgacatcattaaatgagtcactcgaacaagaattcaccagaggtgttgttttaggctcaggtgatgcactgacatggattcctgacgatgaagaaagaagtttggaggatttcctcccaattggaagtagcggctcatcctcatcgagccaagagatgaccctgttttcccagcgtgcacaatacgtggattgcaagaatcttcccgatttagatgagcagagaaaaactgaaaacaacattgaaaagaatggtggcccgatcaaaaaagagtatagttcgcgaggtttccccaccgagttcagatttgtcgtgagaaaagggcattatgaccgttacaggaatgaaggctggggatatttaaaaaactattgcaaacacaacttcgccaaccacgctatggctgaggccgtagtagataaagcggtgattgattatggctcatcgccaggaaccagctattacaagttcgagaaaacggtgtactttctagattgcagaacttatacattcaataagaactcaggatgtaaagaaatgcacgctccgcaatgggtgactattatttacaatcctcatactttcactggagcaaattcgaacagacccaagggggtaatttcagcatggtgtaattcaaccccacctggtggaatcgaacacgagcctgaaatttcccaatgtcctgatcatgtgaatctttataataagcttcgcatatgacagaaccccatcaactgtgc

SEQ ID NO: 1626 - protein, 618 aa, Corynebacterium glutamicum
MLLAIGVASPVAQAQVEDQFELVKEISDEQFADDGVDYVPNRNAPTVKEQLEDFESAHPEVVIEYHEHVNDSKDNVEELPLPKRDIVAGEMRSDVIELPEGVSKDEADQVEVAEARLNEGARLMAATGCEAMWPTGFSVCGRILDAYRQVGGQLSWLGPPKSNELTNPDGVGKRSEFVGGAIYWHPDTGAYAVTLDGLRQWGTLNWESGPLGYPTSGPMDTNYPLTQRQTFQGGDNYYNPLTGGAVWGDIKQRYEELGGSNHAIGIPITNELPSGTEYFYNNFFNGTISWRNDRQTRFMYLATQRVWDALGRETGRLGFPEADETPEVSGLFHVVNFAERGVIAWNGILGARELYGDVYSLWLQYQNTDTPLGWPIPSLTSLNESLEQEFTRGVVLGSGDALTWIPDDEERSLEDFLPIGSSGSSSSSQEMTLFSQRAQYVDCKNLPDLDEQRKTENNIEKNGGPIKKEYSSRGFPTEFRFVVRKGHYDRYRNEGWGYLKNYCKHNFANHAMAEAVVDKAVIDYGSSPGTSYYKFEKTVYFLDCRTYTFNKNSGCKEMHAPQWVTIIYNPHTFTGANSNRPKGVISAWCNSTPPGGIEHEPEISQCPDHVNLYNKLRI

SEQ ID NO: 1627 - DNA, 456 bp, Corynebacterium glutamicum
  CDS (101)..(433): RXA00173
tgccctgatccacacacaactgtgaagaaagaagccgcaatgtccaccacatccacctatgagagccgtaaggcagctattcgcgacgctattctcgcctatgtcaacaacaatcaaggctgctgcaccctacagccttcatgcccatgatctcgaacagcttgctgtagatctcactttagttaccacctttgatagcaatgctgcagttgatgtcacgccaacacatacagaagcacctggttttaccctgcatgagggcaccgatactgcgcctatggctccaaccctggtcgtacctatttccagcgacatctccacagccgtttcggaaatatctacattagtgcagcaggctcgcaccgacgcagcaagcgccattcatgaagcagaagctgaattttacaaccaacttgctgcggtccttgctcagtgatttaatgtggccgacacacc

SEQ ID NO: 1628 - protein, 111 aa, Corynebacterium glutamicum
MSTTIKAAAPYSLHAHDLEQLAVDLTLVTTFDSNAAVDVTPTHTEAPGFTLHEGTDTAPMAPTLVVPISSDISTAVSEISTLVQQARTDAASAIHEAEAEFYNQLAAVLAQ

SEQ ID NO: 1629 - DNA, 408 bp, Corynebacterium glutamicum
  CDS (101)..(385): RXA00174
gcggtgtggctgttaccaacaatcccgatggcactgaacaaggtgatgcacgccgctgggtaagccactgggaatcataaaaaagaaagtagcactagctatgcctaatcacccacctatttccaccttcgatgaccgtcgctctgctatgcgcgaaggcattactgattaccttgccaatacaaatgcaaatgggttaggcggttacagcatcagcgacacccacctcgacaatcttgctgagaaattcacccgcacacatggtgaagcacagtacgatgccggctttgatcccaatgatcttgaaccagagacttttgttcgtgacattgagatgagctgggatgagcgtgctattgatcgtgccctgatccacacacaactgtgaagaaagaagccgcaatgtcc

SEQ ID NO: 1630 - protein, 95 aa, Corynebacterium glutamicum
MPNHPPISTFDDRRSAMREGITDYLANTNANGLGGYSISDTHLDNLAEKFTRTHGEAQYDAGFDPNDLEPETFVRDIEMSWDERAIDRALIHTQL

SEQ ID NO: 1631 - DNA, 753 bp, Corynebacterium glutamicum
  CDS (101)..(730): RXA00175
agctcgacagccgtaaagaagttgtaggtctttttcgcttgggatactgatgctctcccaagcgaacatgggcgggagcccatgtcggggtgttgtgcgaatggctgtgtgtcaactacctcagcctgagaaaacaacacttataaagaaagaccttttactcatgacttctacaactaactccaccgccatgttcaacgaccaccttatccctatggcagagcttgatgaacaagctctgcgcgacagcgttggttcttgggcacagtacaagcacccgcttgaccagcgcaaagaaccagagctcgtccttattcgtcgcgtcaacagctcagagcgtgtgtgggtcttaagtttcactgacctgcgtgctgatgcaggtcttgtgcctcgtagcacaccgaatgctgacccctccaatatccgcaataccattttctctgtcgctgtccgcgatcttgtccttgatcgctcacttccccggctgcttaacctcaacgggcaaccaccagcaggtgaatgggaagaaggctttgtctacgtcgattatgaccagagcgacaccgtagatggctacctcattgagcacagcgaacctgtctccattgaaagtcaaaccaccggtgaaatgcactatttcgataaggtgccaggcggtgtggctgttaccaacaatcccgatggcactgaacaaggtgatgcacgccgctgggtaagccactgggaatcataaaaaagaaagtagcactagct

SEQ ID NO: 1632 - protein, 210 aa, Corynebacterium glutamicum
MAVCQLPQPEKTTLIKKDLLLMTSTTNSTAMFNDHLIPMAELDEQALRDSVGSWAQYKHPLDQRKEPELVLIRRVNSSERVWVLSFTDLRADAGLVPRSTPNADPSNIRNTIFSVAVRDLVLDRSLPRLLNLNGQPPAGEWEEGFVYVDYDQSDTVDGYLIEHSEPVSIESQTTGEMHYFDKVPGGVAVTNNPDGTEQGDARRWVSHWES

SEQ ID NO: 1633 - DNA, 582 bp, Corynebacterium glutamicum
  CDS (101)..(559): RXA00179
gcgggttcgccaaaccttggtgatctcgttagtgtatgtatcaagcattttctttttgcccaaccataattgaaaggtccaccagcccgtgaccaccatcatgatcgctattcacgctattgcagcaatcctgttcctaggaccagcaacagtagctaactctcagttccacgtccgcgcgtacgatgcacacaacggcaacacccaagccgctggctccgcaaaaacccttttcaagatttcccagtcctacggcatgctgtccctgctcgtgcctttgctgggtatcgccatcatgcttctcgattggtctttctacaagtctgaaggccagttccacgcagcaatcgctctcagtgttatcacctgggcgctgcttctcttcgttatcttcccacgccagaagaagatgatgggtgctcttgaccttctggaggacgatgagcaggctgcaaagacttacgagatcgaaaactgggacaaggcgaagagccagctgtccatgttcggcggcatctgggctctgctgtgggtcatcatcgctgtgctgatgttcatctaacacatctcaaattgccaaaa

SEQ ID NO: 1634 - protein, 153 aa, Corynebacterium glutamicum
MIAIHAIAAILFLGPATVANSQFHVRAYDAHNGNTQAAGSAKTLFKISQSYGMLSLLVPLLGIAIMLLDWSFYKSEGQFHAAIALSVITWALLLFVIFPRQKKMMGALDLLEDDEQAAKTYEIENWDKAKSQLSMFGGIWALLWVIIAVLMFI

SEQ ID NO: 1635 - DNA, 663 bp, Corynebacterium glutamicum
  CDS (101)..(640): RXA00180
aaacgaggatgttgatttcgctgacgcagctcagaagctttcgaaagaaagttaagccttagagggaaccaaacgccaaggcgatgagtctaacccgagtatgaagaactttattcgggtactcatcgcctttagtgttttcctctgtatatataccgttgctccccacattggccgaggtcctggagacctcgcaccagttacagcaatcccccaacgagccacagtcctaggctatgacagagcctccatgtttggcggatggttgggtggcgtgcgggaaggcatcgtggatgaagccggcgacactgatccatactccgggaatcgattagacctctctagtgccgaggtggatcatattctcccgctcagcgccgcctgggatctaggcgcacaccggtggagcgctggcgagagaatcagctttgccaacgaccccctcaacctcgtgctcgtctcaaaagctgagaaccaagaaaaatccgatcaacttcccagcgagtggctcccctctgatcgaagtgcacgatgttggtacgtggaacgccttttcgccgtggccaacgcatacgaacttccgttaccagaaaacgacattcgggttggacgaaaacagtgcgggttcgccaaaccttggtgatctcgttagtgtatgtatca

SEQ ID NO: 1636 - protein, 180 aa, Corynebacterium glutamicum
MKNFIRVLIAFSVFLCIYTVAPHIGRGPGDLAPVTAIPQRATVLGYDRASMFGGWLGGVREGIVDEAGDTDPYSGNRLDLSSAEVDHILPLSAAWDLGAHRWSAGERISFANDPLNLVLVSKAENQEKSDQLPSEWLPSDRSARCWYVERLFAVANAYELPLPENDIRVGRKQCGFAKPW

SEQ ID NO: 1637 - DNA, 975 bp, Corynebacterium glutamicum
  CDS (101)..(952): RXA00183
ctggccagcgccatcgtgggcgagggcgaaggctggatcaccgaactcaacccagaagaattggctatgctgatgagttaccgcgaaaaggagggtgcagatgactgaatcacgccgcgtgaaaatggataacgttatttacgccaattttggcagcaaacagcgcgtatctactcctgatgaccgcacccaggtgattaataaatcacgacacaaacaattcagcccagcgggtactcgtaccgtgatgttgacggagaaaaacgccgacagcggacgacggtcccgcggtgagcagtactaccgaaacggcaatgtcaccggcatgactgtgctggaaggccgcgtggaatgcactgtcgcgggctcccaaaacgagccgtttgttaccacagtgaccttcccataccgaagctcggaaaaactccgcgaagcctacgcagctattgcggatactcccaatggcctgcggcttgtgcgtgatggccatctgacctcctccatgctggatcacttggtgggaagtcctgatgagtcgatttattttgactgcacctgccccgaccgatcgcttgtgtgtaaacatgccgttgccagcgcgtatcacgttgccgagaagatgaccgcgaaccccggtctgatcttggatattcgtggtcaagggatggctggattagaagcactgattcggacctatcacaccaaggttgaaactgaacctgaagacaatgacagtttttggaacggcagggaacttcctgctttgcctgatccaaagattgcccctgctatcgacgattccgatatcaactacctccacaaggctttaaggatggtctcatacacctccctggagcagcttcgtgcggtcagtgatattgaagatatgtacgagattttggtagccaaccaccctgataaccagcaagtgtatgaggaagaagacactgattaaccagggcttatggttgtggt

SEQ ID NO: 1638 - protein, 284 aa, Corynebacterium glutamicum
MTESRRVKMDNVIYANFGSKQRVSTPDDRTQVINKSRHKQFSPAGTRTVMLTEKNADSGRRSRGEQYYRNGNVTGMTVLEGRVECTVAGSQNEPFVTTVTFPYRSSEKLREAYAAIADTPNGLRLVRDGHLTSSMLDHLVGSPDESIYFDCTCPDRSLVCKHAVASAYHVAEKMTANPGLILDIRGQGMAGLEALIRTYHTKVETEPEDNDSFWNGRELPALPDPKIAPAIDDSDINYLHKALRMVSYTSLEQLRAVSDIEDMYEILVANHPDNQQVYEEEDTD

SEQ ID NO: 1639 - DNA, 2751 bp, Corynebacterium glutamicum
  CDS (101)..(2728): RXA00185
attgcgagagctcgctgactctgtggtcaatggtgcagcgccggaagaagaccgcgatgcgctcaacctattgttccgactaagccgggaggtctaagacatgcgtattcatgaaatcatcattgacaatttccgagccatcgaacatctagaacttcgtgacattcctgaccagggcgttatcgtgatccacggtgacaatgagcaaggcaaatcttcaatccttgaagccataaaaacagttctgaatagtaaacacagaaccaccagcaagacgatcaaggccattcagcctgttgaccgtgatgttcccatcagcatcaccctcgaggcaaccgtaggcacggttcgattccgcatacacaaacgcttcctaaaatccacagccgcagaactgcaagtcatcgagccacgtccatccaaccaccgtggactagaagccgaagctgcactggcagaaatactggaaagccatttggacacctctttgcttgacgcattgtttatgaaacagggtgaagtagaagcaggtatcagcgctgtaggaattcctaccctgaccagcgctttgaacgctcaaaatggcaataccgaagatgccaccgaagacaccgcactcatggaggctgtagaaaaggaatacctaaagttctacaccaactccggaaaggcgaatacgaggttcctacagttttccaaacaggtggaaacccttcgtactgatttggatgaggctaacgctgaagtagcaaagctctcctcccatgttgaccgagttaaacgattggaaattgatcgggatcaggccacagcacagttacccaaggcagaggaagaactcgcagggaggaaagcagaactggaggaagcccaaaaggttaaggctcaagccacggaaatccttgcgcagttttcccgggcggaagaacagttagagcaggcaacaggagctcagaaacgacgtaaagaactccgcaataagctggaattagcacagacagaagtcgaaaaggctgaagcagggcaagagaacctggcgcaagaagcttcccgtgaagcagaagaattcctagccttaagtgaaaagttcgaggcagcgcgcgcagctgaaactctggccgttgaaaaggtgaaagcagcacgtcaatcggttgctggaatcaaaaaccgtgaccgtaaagaacacctcacggttatgcttggtgaacttgatcgaattgggcagcgcctctacgaattgcgcagcgtccagcactcatcggtgcgtgtgagccagcgtgatattgatgctctgcaaaaggcgatcaccgaggtcgatatccaaaggacgctcgttgaagcgcagcagggaagtattaccctcagtgcttccacacccaccgacattcaactaggtgatgacaccgtttcagctaccgacgctggaaccacagttgccctcgaccgagaactcaccgtcgtggtcggcgatgtcaccttggtgattaacccaggaaaaacagcagcggaaagtcgcaccgattttgaatccgccgaggcagcattggcggagctgcttgatcaactcgacgtctcagacttggaccagctcagggaacgtttcactgcccaagagcaacgagacgcggatattgcagaactggttcgcgaacaacagcgcatgagcggtgggacagaaacaacagttttacgtgccgagctagaaggcctgcacgtcccagaggatctagacccatcaatttctgtggatgatgcgcaaactcagttgaatgaggcagaagagtccagagagctcgctgcggaggcgcataaacacgcaaatgcagcacttgatggattgcgttcgcgtcccgtagataaagctctgacagttttcaacgctcagctcgcagcactgcagagaaacctctcttccgcacaagttgaattagaccgtgcagtggcagaaacctcggatgacgaagttgatgctgctgtacagcggtgcgctgaagctctagctggggtgcgggtacagaagcaggagattgaacaggtcttggcaaaaaccaacccagacatggctcaacgcttatgtgatgctgctgaagcaaatgtgcgatcgtataaaacggcagtgtctgatgccaccacagagttggtgcgcctggaaggcctcatcggtgtagctgcaggtgcgaaagaacgactagataaagttaagtctgcgctgacagcagctgaaaaccggtttgaatcagaacaacgtcgcgcccacgctgcacgtcgcctctatgccctcatggtgttctaccgtgatgaatcccgaaagcgctacgcagcacccttcgcggacaaactatccaggctggcagcatccgtatttggagaatcagcagactttgatcttgatgatgagctgaagatctccagtcgttccataggaccacgaacagtggaccttgccaatctttctggcggcgcaaaggaacagctggcaatcctcacccgctttgctatcgcagaattggtagcagaatcctccgcgcaaggtgctgtgcctgtgtttattgatgatgcattggggagcacagacccagagcgactgacccgcatatctactctgtttagtgatgcaggcaaggactctcaggtgtttgttctcacctgtgttccagaccggtacaactatgtagaggtcacccaaaagcacagcatcgagtcattgaaaactgccaacgctctgctgtagctgagcaaaaagccaagcaa

SEQ ID NO: 1640 - protein, 876 aa, Corynebacterium glutamicum
MRIHEIIIDNFRAIEHLELRDIPDQGVIVIHGDNEQGKSSILEAIKTVLNSKHRTTSKTIKAIQPVDRDVPISITLEATVGTVRFRIHKRFLKSTAAELQVIEPRPSNHRGLEAEAALAEILESHLDTSLLDALFMKQGEVEAGISAVGIPTLTSALNAQNGNTEDATEDTALMEAVEKEYLKFYTNSGKANTRFLQFSKQVETLRTDLDEANAEVAKLSSHVDRVKRLEIDRDQATAQLPKAEEELAGRKAELEEAQKVKAQATEILAQFSRAEEQLEQATGAQKRRKELRNKLELAQTEVEKAEAGQENLAQEASREAEEFLALSEKFEAARAAETLAVEKVKAARQSVAGIKNRDRKEHLTVMLGELDRIGQRLYELRSVQHSSVRVSQRDIDALQKAITEVDIQRTLVEAQQGSITLSASTPTDIQLGDDTVSATDAGTTVALDRELTVVVGDVTLVINPGKTAAESRTDFESAEAALAELLDQLDVSDLDQLRERFTAQEQRDADIAELVREQQRMSGGTETTVLRAELEGLHVPEDLDPSISVDDAQTQLNEAEESRELAAEAHKHANAALDGLRSRPVDKALTVFNAQLAALQRNLSSAQVELDRAVAETSDDEVDAAVQRCAEALAGVRVQKQEIEQVLAKTNPDMAQRLCDAAEANVRSYKTAVSDATTELVRLEGLIGVAAGAKERLDKVKSALTAAENRFESEQRRAHAARRLYALMVFYRDESRKRYAAPFADKLSRLAASVFGESADFDLDDELKISSRSIGPRTVDLANLSGGAKEQLAILTRFAIAELVAESSAQGAVPVFIDDALGSTDPERLTRISTLFSDAGKDSQVFVLTCVPDRYNYVEVTQKHSIESLKTANALL

SEQ ID NO: 1641 - DNA, 1542 bp, Corynebacterium glutamicum
  CDS (101)..(1519): RXA00199
acccagcaccattttttgtggtttgctctaagttatgggcgaatcagtaagtactgacaggtacactccgcagcagcgcacgcgttatcgccagctgctcatggaagatcttgagatttttgatcggcatttgcagcattccgattttgaggatcagggttccatcggcctcgagttggaactcaacctcgtggataagcatatgcaacctgctttggcaggccacgcggtgctttcccatttagacgatgagtaccagtcggagatcggtaactttaatgttgaaatgaaccacccgccactatccgttaaaggcgatgctttacgacgcctcgagcaaggcatcacctcgcgtctaggtcgcgtgcgcgcggccgccacatcggagaacgtgaacgtggcgatgatcggcacgctgcccaccatcaccccagaattcctcgaagatccggcatggatgacccaagaaaaccgctaccgtgcgctgagcaatgcggtgatggaatcgcgtggcgagttagtgcacatcaacatcgccgaccgtgaacaaatcatccacgatttcactgatctcgcccccgaatcaacttgcacgtctattcagttgcacctgcaattagcacccaataagtttgctgcagcgtggaatgcgtcgcaagcaatagctggtgttcaagcagctctttccgccaactccccacttttcctaggccgtcgggtgtggcatgaaagccgcattccagtgtttcaacaagctatcgatacgcgtactcctgaacttgtgaatcaaggagtccgccccagagtatggttcggcgaacgatggatcaccagtgtttttgatcttttcgaagaaaacgtacgctacttctcccctctcatcgcagaatcccgcgccctgtctggcacaccaatgatgaagggaaaatcccccgcactccactacctcaatctccacaacggaacggtgtggcgctggaaccgacccatttacgcaccgggggaagagcgctctcatctgcgtttggaaaaccgtctcctacctgcaggtcccacccccatcgacatcaccgccgatgccgctttctactacggtttggttaaatatctggccgaggaaaaccgccctgtctggtcacgtctcctattccctgatgcggaaaagaacttccaatccggtgcacgttcagggctgttcgcccgcatgacctggccaaccctcggacaagtcaacgttgcgaatctggtccaagagcacctcatccctcaagccagaatcggactggaacgactcgaagtaaacaaagaccttatcgaccaatacctgggcatcatcaccgaacgcgcgaagtcccgccaaaacggtgccacctggcagttgcgtagcctcaacaagctggaagcacacggaagcatgccgggttccgatgctcgaaaagcaggtcttgcagcaatgttgcaacagtatttacagaatcaagaaagcggccaacctgtccacacatgggctattggttcgtaaaacggcaaggaaagataata

SEQ ID NO: 1642 - protein, 473 aa, Corynebacterium glutamicum
MEDLEIFDRHLQHSDFEDQGSIGLELELNLVDKHMQPALAGHAVLSHLDDEYQSEIGNFNVEMNHPPLSVKGDALRRLEQGITSRLGRVRAAATSENVNVAMIGTLPTITPEFLEDPAWMTQENRYRALSNAVMESRGELVHINIADREQIIHDFTDLAPESTCTSIQLHLQLAPNKFAAAWNASQAIAGVQAALSANSPLFLGRRVWHESRIPVFQQAIDTRTPELVNQGVRPRVWFGERWITSVFDLFEENVRYFSPLIAESRALSGTPMMKGKSPALHYLNLHNGTVWRWNRPIYAPGEERSHLRLENRLLPAGPTPIDITADAAFYYGLVKYLAEENRPVWSRLLFPDAEKNFQSGARSGLFARMTWPTLGQVNVANLVQEHLIPQARIGLERLEVNKDLIDQYLGIITERAKSRQNGATWQLRSLNKLEAHGSMPGSDARKAGLAAMLQQYLQNQESGQPVHTWAIGS

SEQ ID NO: 1643 - DNA, 326 bp, Corynebacterium glutamicum
  CDS (1)..(303): RXA00200
cactacgccggagtcaccgagattcctgaataccgaatctccccagaccacggcggaaaatccaccctctccccattccaagactgggcaggcggcggatccatgggcacggccgaagcagtaaacaacgcctacgaaatcccgtcctacctccgcaacgactggggccgcgactggggttccatcgaacgctactcgctgcgcaccaactccaacggcgatgcacctaaggttgcagacatcaaccttgaaaccatccaacgttccggactctggaatccagggcatatgaaggtagatgaataagaccttcagtactggaagtt

SEQ ID NO: 1644 - protein, 101 aa, Corynebacterium glutamicum
HYAGVTEIPEYRISPDHGGKSTLSPFQDWAGGGSMGTAEAVNNAYEIPSYLRNDWGRDWGSIERYSLRTNSNGDAPKVADINLETIQRSGLWNPGHMKVDE

SEQ ID NO: 1645 - DNA, 441 bp, Corynebacterium glutamicum
  CDS (101)..(418): RXA00207
ctgcacaatttttggtcggacacatttttgcccccattgggttgtcggatcagatcaagaaaacccccgcggaaaaattttgtctctagactggctcaccatggaaatgaaattgaaaaaggcatcccaggtcagcactgccaccgtcgtcgcagcaggtttgatcggcggttggttgactgcccgtgaatccggcattcgcccactgggcaccattccattggcagcatccggagcgcttgctgcacgaagctggaatgaaaagaagggtcctgcagtagctactggcctgctggcaacctacgttggtgcatttggcctgtcccacccacttgccaagaagattggcgcgtggcctgcagttcttactgtgaccgctggcgctgctgcgattgcttacgcagtatctgactcccagtaataattacggtaaaaaaactt

SEQ ID NO: 1646 - protein, 106 aa, Corynebacterium glutamicum
MEMKLKKASQVSTATVVAAGLIGGWLTARESGIRPLGTIPLAASGALAARSWNEKKGPAVATGLLATYVGAFGLSHPLAKKIGAWPAVLTVTAGAAAIAYAVSDSQ

SEQ ID NO: 1647 - DNA, 786 bp, Corynebacterium glutamicum
  CDS (101)..(763): RXA00211
tgagccaaaatcaataaggtgtttttcagcctgaggtaaaaatacggtggtactgtcgaaaccaatcatcccctagttttgaaaagaaggaagcgagccaatgtcattcctgatccgcgtcctgttgtccgacaccccaggcagcctcgcgttactcgctgaagcccttgggattgtagaggccaatattcaatccgtggacgtggtggaacgcttccccaatggcacggtcatggacgatctggtgatctccatccctcgcgatgtcatggcagacaccatcatcaccgcagctgaagaagtcgacggcgtggagattgattccatccgcccattctccgggactgttgaccgccgcggacagatccaaatgctggctgctgttgctcaccaacgccgcgatatcaccgcagcgatggaagaaatggtcgatgtcatcccccgcaccatgacctctggttgggctttggtcattgatctaaaaggacccatcactcgcatcgctggttccctagcagcgcccgaagatgacggcaccgttccggagaacatcgttctcaaagaagctcgcatgctcaacccggaaaacgatccgtggattccagagtcctggacactgcttgattcttcccttgccatcgctccgatcggcaagcacggcctggctctgattatcggtcgccctggtggccctgatttcttggccagcgaagtggagcacttaggccaagtcggtgacattatcggagcaatgcttcaaaaataatctgagctgtttaaaaaatg

SEQ ID NO: 1648 - protein, 221 aa, Corynebacterium glutamicum
MSFLIRVLLSDTPGSLALLAEALGIVEANIQSVDVVERFPNGTVMDDLVISIPRDVMADTIITAAEEVDGVEIDSIRPFSGTVDRRGQIQMLAAVAHQRRDITAAMEEMVDVIPRTMTSGWALVIDLKGPITRIAGSLAAPEDDGTVPENIVLKEARMLNPENDPWIPESWTLLDSSLAIAPIGKHGLALIIGRPGGPDFLASEVEHLGQVGDIIGAMLQK

SEQ ID NO: 1649 - DNA, 1263 bp, Corynebacterium glutamicum
  CDS (101)..(1240): RXA00218
tctaaactcacgctagacttctaaaagatctaaagttcagttccaacacaagccagcactgcattccgcaaacccgactagaccatccaaggtgtcttctatgtcagctcgcaatccgttccgccccactttcggagtttcccccaccgtacttgcaggccgagactcacttctacagtctttcaaacttggtctcgcggaaggccccggaagcccctttagagcattgctgatttcgggatctcgtggcatgggtaaaactgtgttgctcaatgaatttgaagatgcagctgcgtctcaagggtggatcacgctgcgcgcctatccggataattccatggtggatggcttagttaattccgccatcccggaggcgctacagaatcttgacggaccgcagtccaaaagaatgctcagtggtgtggccattcctggtatcgctacggtgacggccattgctgatccaaccaagaaggatcccactcccacgctgatttccaggctccgcgagttggctactcgtttgcaaaagcacggctccggaattttgatcacccttgatgaactccaaagcgccaatgtggatcttttgcatgtgttggccactgcggtccaggatctcctacgggatgatttcgatatcgcattggtagcagcgggtctgccagagggaatcgatcgtcttctccagcatgagggcacaacctttatccgccgagccgaaagaatcctgctcaatcctgtcaaccatgaagattcggtggagatgttcctggataccgctgcggaaggccaacgccacatgacttccgaggccgccgaactcgcggcgcagatcagcaagggctacccctactccatgcagctgactggttctctggcatgggcgcgaagtactcttgacaactccgataccatccaggccgaacaagtagatgctgtccgcgacgaggttgtgcgccgcatgggcatgcaagtccacgagccaagcctgcaccaggtccctgatggtgagctgaccattttgtacgcgattgcccaactgtcaaaaaacggcgagatggtgtctactggagatatcgcacacctcatgggcgtcaagcccaacgccttgtcgatgcagagaaagcaacttctcagcagaggtctcgtagaggttcccaagtacggtttcctcaatttcactttgccgtacatgcgcgagcacctcctcaacagcccgcaccaccgaccaatcacataagacacaagcactaaaacagc

SEQ ID NO: 1650 - protein, 380 aa, Corynebacterium glutamicum
MSARNPFRPTFGVSPTVLAGRDSLLQSFKLGLAEGPGSPFRALLISGSRGMGKTVLLNEFEDAAASQGWITLRAYPDNSMVDGLVNSAIPEALQNLDGPQSKRMLSGVAIPGIATVTAIADPTKKDPTPTLISRLRELATRLQKHGSGILITLDELQSANVDLLHVLATAVQDLLRDDFDIALVAAGLPEGIDRLLQHEGTTFIRRAERILLNPVNHEDSVEMFLDTAAEGQRHMTSEAAELAAQISKGYPYSMQLTGSLAWARSTLDNSDTIQAEQVDAVRDEVVRRMGMQVHEPSLHQVPDGELTILYAIAQLSKNGEMVSTGDIAHLMGVKPNALSMQRKQLLSRGLVEVPKYGFLNFTLPYMREHLLNSPHHRPIT

SEQ ID NO: 1651 - DNA, 627 bp, Corynebacterium glutamicum
  CDS (101)..(604): RXA00220
agatcgtgccgagtttccggtttggatggggtttgggatgttaatgggagaggatcggcgtgatcgtgccggttttccttgcgttggtagtcttggggctatgagcgcattccacatccgagcggaacaatcgcacgatatcagcgcgattcatgatgttactgaagcggcctttacaggaattgagcattcagatggaacagagcaagatctcgtcgataagcttcgtgctgcaaaggcgctgagcctttcgctcgtcgctgaggcggatggcgaggtcattgggcatattgctgcctctgaggtgctgattggcggtggggtgcagggctggtttggcattgggcctgtcagtgttcggcccgataagcagcagcaaggcgtgggtattgcgctgatgggcagcgcgcttgatcagttgcgtgcggagggtgctggcggcatcgtgttgctgggggatccgggctattatcgacgcttcggttttgaggtcgtgcccgggctggtctatccggacgcgccagcggaattttttatggctgtgtgtttgaatgctccggcgtttccgcagggtgttgtggagtatcactcggcatttggagggtagagaccccatcgtggcgggcc

SEQ ID NO: 1652 - protein, 168 aa, Corynebacterium glutamicum
MSAFHIRAEQSHDISAIHDVTEAAFTGIEHSDGTEQDLVDKLRAAKALSLSLVAEADGEVIGHIAASEVLIGGGVQGWFGIGPVSVRPDKQQQGVGIALMGSALDQLRAEGAGGIVLLGDPGYYRRFGFEVVPGLVYPDAPAEFFMAVCLNAPAFPQGVVEYHSAFGG

SEQ ID NO: 1653 - DNA, 843 bp, Corynebacterium glutamicum
  CDS (101)..(820): RXA00230
aggtcttaccgcccctcaaatcctgcagattttccgtcgtcaatcagggacgaaagtacatcctatctatctagctccactagcacagataggaactccgttgattcatgagcaagacgttcagaagctgttaaactacatcacttcacactttggtgttgaccctgaaagatggtttcatcctgaaggctaccaaagcattgccctagcgattcttgactccatttactcgactggtaatcgctatacaggtgtactcaaccttgtcaatcgatactgcgggctgcgcgcaaatgaaggatcacaccctgaagccgatactgccactgatctcatcgagacattctaccggtggggaggggtcgacgaatttgttctcaaaacgaataatcggtggagaacttcctccaagattcacgcaccctataaggcatacgcagctttggaagcagcaaaggtacttgcgggtcattccatcgaatccatcagcgatgttgtcggcaggttcgattcgcgcgaaagccgtgaacactcagatatcgcgagagaatggttgatgataaccggccaaagtagtgcgttgacctggagttacttccttatgctcgtaggtgtcccaggagtgaaagcagaccgaatgatcgtccgtttcgtcactcacgtgctcgagcgtccgaaagagatttccaggcacgaagcttcacggttgattgaggaagttgcggacattatgtgcgtcaactacatctacctcgaccacaccatctggcggttccaatcagggcgcccctacctccaagaagactcctcccctttcgaataaatccatcacatttcacagtc

SEQ ID NO: 1654 - protein, 240 aa, Corynebacterium glutamicum
LIHEQDVQKLLNYITSHFGVDPERWFHPEGYQSIALAILDSIYSTGNRYTGVLNLVNRYCGLRANEGSHPEADTATDLIETFYRWGGVDEFVLKTNNRWRTSSKIHAPYKAYAALEAAKVLAGHSIESISDVVGRFDSRESREHSDIAREWLMITGQSSALTWSYFLMLVGVPGVKADRMIVRFVTHVLERPKEISRHEASRLIEEVADIMCVNYIYLDHTIWRFQSGRPYLQEDSSPFE

SEQ ID NO: 1655 - DNA, 517 bp, Corynebacterium glutamicum
  CDS (101)..(517): RXA00233
cgcctccagcagttgagggagaagttccaacacttgcaccaactgaggaagcaactgtgcaatagcgctttagacacagactcatgacagaatagaagacatgagtgtgaatgaagcagatctgaacgctgtcgaagagcaattgggaagggccccacgaggtgtcctcgatatttcttaccgcagccctgatggagtacccggtgtggtgatgaccgcaccaaaactggatgacggaaccccattcccaaccctgtactacttgacagatccacgcctgaccaccgaggcatcccgcctcgaggtcgcattggtaatgaagtggatgactgatcgcctttccaccgacgaagagcttcgtgccgactaccagcgcgcccacgagcacttcctggcaaagcgcaacgcaattgaagatctcggcacggatttttccggcggtggcatgcctgaccgagtgaagtgccttcacgtcctcattgactatgcactggcagaaggcccacaccatttcctt

SEQ ID NO: 1656 - protein, 139 aa, Corynebacterium glutamicum
MSVNEADLNAVEEQLGRAPRGVLDISYRSPDGVPGVVMTAPKLDDGTPFPTLYYLTDPRLTTEASRLEVALVMKWMTDRLSTDEELRADYQRAHEHFLAKRNAIEDLGTDFSGGGMPDRVKCLHVLIDYALAEGPHHFL

SEQ ID NO: 1657 - DNA, 663 bp, Corynebacterium glutamicum
  CDS (101)..(640): RXA00234
ttcagggctaaataaaagcgcttttcgacgcccggtaacctcaaggttgccgggcgtcgttgccttactactgttactggtgtgactatgatcgaggattatggcaaagcagaagaaaactcataaaggccttgttcctgtctcaagcagggaacgtgcttcagagtcagtttctgctacccgcgccccatttagattgggtgccgtcggcatcggtgcaatcgcactcgtagttcttctcatcctgtttgtcatcgcgattcctgtgcgtaactattttcagctgcgctccgacatcgcccaaacagaggcttccattgaagccaaagaacaacagatcaaacaactggaatctgacctcaacaggtaccaatcagaggcgtacatccgcgaacaagcacgcctgcgcctaggcgtcattgaacctggagaaaccgcgttcagaatcgtggacccagcactagataccgacacctcagtcacctctgacggcaacgaagagaaaccactgggagcttggtatgaaaacctctgggactcagtcaccaagccagaagcactcggcgaagaggaaattgcgcctccagcagttgagggagaagttccaacacttgcaccaactgaggaagcaactgtgcaatagcgctttagacacagactcat

SEQ ID NO: 1658 - protein, 180 aa, Corynebacterium glutamicum
MAKQKKTHKGLVPVSSRERASESVSATRAPFRLGAVGIGAIALVVLLILFVIAIPVRNYFQLRSDIAQTEASIEAKEQQIKQLESDLNRYQSEAYIREQARLRLGVIEPGETAFRIVDPALDTDTSVTSDGNEEKPLGAWYENLWDSVTKPEALGEEEIAPPAVEGEVPTLAPTEEATVQ

SEQ ID NO: 1659 - DNA, 501 bp, Corynebacterium glutamicum
  CDS (101)..(478): RXA00237
actggtagaagctttgatgatctacatcacaaatttacaatgtgtggtgagttattcatattacccaaggacttaaaccttaaaaggagccctaaaaatcatgaagctttcacaccgcatcgcagcaatggcagcaaccgcaggcatcacagtggcagcattcgcagcacctgcttccgcatccgacttcgcaaacctatcctccaccaacaaagaactgtcccctcagtacaactgggttgcttgcggcatccttgagggtggcctcaaagcagctggcgtccttgaagaaggccagtacaaccgcgagctcgcagaagcaatcgccgcaaagggtgaaggcttctggaccactcagttcccacaaatcggtgattggaacgaagatcaggcagcagcacttgccgaccgcgcacaaacctgtggcctagttaaggctgacacctacctttctgagctgtcctccaacttctcttcctaaaaggttcgggggtaacccca

SEQ ID NO: 1660 - protein, 126 aa, Corynebacterium glutamicum
MKLSHRIAAMAATAGITVAAFAAPASASDFANLSSTNKELSPQYNWVACGILEGGLKAAGVLEEGQYNRELAEAIAAKGEGFWTTQFPQIGDWNEDQAAALADRAQTCGLVKADTYLSELSSNFSS

SEQ ID NO: 1661 - DNA, 492 bp, Corynebacterium glutamicum
  CDS (101)..(469): RXA00238
aacagtcacataaatcacttcagtaacgtatgattttggactgttgtggcttttgccatatttatttcatttccatctcagtgatctcttaaggaaacccatgaagaaactacgtttcgccaccatcgctgccgctaccgttgccctgactgcgagccttaccccctcagcttccgcacaggatttcaaccaaatcatcgacaactttgattgcggcatccttcagaccgctatctacaccaccggcctggctcacgagaactccactcgctcagagctcgccgctaatctgcgcaactccgcagctgtcggccaactagacttcccattgaatatcgcggctaccggctactccgagcgcatcgctaaccgcgcactgacctgcggaatcgtgaaggaagatccacaggacttcctctcccagctgcagcttctgtcctctaacctatcttcttccttcttcactgcttagtttctcttgggcttttcctt

SEQ ID NO: 1662 - protein, 123 aa, Corynebacterium glutamicum
MKKLRFATIAAATVALTASLTPSASAQDFNQIIDNFDCGILQTAIYTTGLAHENSTRSELAANLRNSAAVGQLDFPLNIAATGYSERIANRALTCGIVKEDPQDFLSQLQLLSSNLSSSFFTA

SEQ ID NO: 1663 - DNA, 708 bp, Corynebacterium glutamicum
  CDS (101)..(685): RXA00239
acaaagcggatcagattaacaaggtccgtgacgctgtcgatgagcgcattggcaaaaacaacggcggcgaagagaatccagccaactagtattaggcgtcatgcgcgtcgtagttgttgatcctaaacaccccgtccttccagtctctttcctcgaggctgttcttgggcggggtgaacctgtttctatcgatcccgattttccatttgatattgaaaaatgggggatcaagacgtcgacaagcgcctcctggtttatcatcgcaaaaccgcaaagcacgctgcttatcgacgcgcccctcaaccctttgcatgaggccgtcggcgtcatgcgggcggccgtgggccgcggcgagtgggaacgcacgcaaacccatgagagtttgattccgtatctggaagaagaatcgcaggagtttattgaagcgattcatggtggcgatgatgagcacatgaaaagcgaactgggggatgttttgctgcaggtgctttttcatgcagaaatcgccgcccgtcagggtcgattcgacatttttgacgtggcggcgagtttcgtagccaagatgcaatctcgttcgccgtacctgttcgacggctctaccggaattgtggacaccgacgagcagcagcggctgtgggctcaaggaaaagcccaagagaaactaagcagtgaagaaggaagaagataggttagaggacagaagctgca

SEQ ID NO: 1664 - protein, 195 aa, Corynebacterium glutamicum
MRVVVVDPKHPVLPVSFLEAVLGRGEPVSIDPDFPFDIEKWGIKTSTSASWFIIAKPQSTLLIDAPLNPLHEAVGVMRAAVGRGEWERTQTHESLIPYLEEESQEFIEAIHGGDDEHMKSELGDVLLQVLFHAEIAARQGRFDIFDVAASFVAKMQSRSPYLFDGSTGIVDTDEQQRLWAQGKAQEKLSSEEGRR

SEQ ID NO: 1665 - DNA, 333 bp, Corynebacterium glutamicum
  CDS (101)..(310): RXA00240
tcatttaacgtagttgacgtacggcgaagtcgctaaacttcgcgtaatcttggggccaattaatcaagtgcagatgaattgtttagaaaggctggagaccatgggtatttttgacgaagctaagaagaaggcaaccgaattcctcgactctgattcaggcgagcagaagtccgatggactgctggataaggccgcagacaaagctaagggtctcctcggtgaagacaaagcggatcagattaacaaggtccgtgacgctgtcgatgagcgcattggcaaaaacaacggcggcgaagagaatccagccaactagtattaggcgtcatgcgcgtc

SEQ ID NO: 1666 - protein, 70 aa, Corynebacterium glutamicum
MGIFDEAKKKATEFLDSDSGEQKSDGLLDKAADKAKGLLGEDKADQINKVRDAVDERIGKNNGGEENPAN

SEQ ID NO: 1667 - DNA, 759 bp, Corynebacterium glutamicum
  CDS (101)..(736): RXA00244
agtgggaaagtgatgatgccacacaccgccggcggattacaggatggcagttcatcaggggtttaaacagtgaagatttggcagaaagcgagatggataaatgaatgatcagctgtgggaaggcgacactggaacgctgacttttgggtccaggaaagctctggtgcaattactcaaaggtcccatggtgaatgctttgcagcatgttgaagtgtggcgggctatcaccacagatcaagatgcgctcaatgctgtgcttaacaatttgttcctcgagttggttcttgatgaggatgcgggtgttgcatttactcggcctgccaatggtagacaagaagtattggttggaaataacaaaactgaagcgatgcccaaagtgctgcgcacggagacgctgtcgcattttgatacgttgatcattttgattctgcgccaagaactcaccatggcgccaccgggggaacgagtcattgtggatcgtgaagaaatccgcgaacaagtgttgctctaccgcgttgatgaagagcgagatgaagccaaactagctaagcgattcgacgctgcatttaggcgcatcgtggattattcattagctaaaaagacagagacacctgaacgttttgaggtctcaccagcactgcgccagatttttgatgccgacactgtggcaggtgtgcgcgctgagtacgaaaaatttaacaaagcagcccatgatggaaatgaagaggaacagaagtgaccagcgaacaagctttagat

SEQ ID NO: 1668 - protein, 212 aa, Corynebacterium glutamicum
MNDQLWEGDTGTLTFGSRKALVQLLKGPMVNALQHVEVWRAITTDQDALNAVLNNLFLELVLDEDAGVAFTRPANGRQEVLVGNNKTEAMPKVLRTETLSHFDTLIILILRQELTMAPPGERVIVDREEIREQVLLYRVDEERDEAKLAKRFDAAFRRIVDYSLAKKTETPERFEVSPALRQIFDADTVAGVRAEYEKFNKAAHDGNEEEQK

SEQ ID NO: 1669 - DNA, 1608 bp, Corynebacterium glutamicum
  CDS (101)..(1585): RXA00245
atgacctttgtttgaagttggtgcggtgatgggggagtgtgaccggattcgaacaggaatgtacgacacgtgtccaccccttctggaatagtcaattggcatgaccgttgtatcgcacgcgcttgggtttaagcgatttaggcaggaatccctggagctgtctttgttgcgcagtgacaactttccggtggtgctcgccgtggtagcgcagtattttccgcagggggctatcgctaagccggcctcagagctgtatcagctgctcagcgatgattttcgggtgctgcgtgaagaaggatttgagctgccgaaaagcccgtcggattatgtgagtgattgggtgaagtcccggtggtttgtgcgtcgtccgggtagttcgcagactggtgagaccgtggaaccgagtgaagagctgttggcggtgctggattcggtgcagcggtgggataacccgcatcgaagcatttcggcgtctcgaattgaatcgttgacgcaggcgttgcagactttggcgttggaatcggaccccagcacagcgaaacgtttagctgagttagagcgtgaacgcgacaggattgaacgccagattgaagcggtccacgctggtgaatttgaagtcctcaccaccgtgcagattggtgatcgggtagcagatattttggatctagcagcatctattcctgcagatttcgccagggtaaggcatgagctgagcgatctgaaccggaagctgcgcaggcagttgcttgatcctgaagattcccgtggtgatgttttggaagagatcttcaggggagttgatctgattggggattccgatgcggggcgcagcttcaatagtttctttgatgttttgctcgatcgggaacgctcaagtctgattgatcgatggatcagagaagttctgggacgcgatgaggctattgatctggattcaaaattaaggacagggctgtaccgaattttccgggatatggaggatgccagcttcgaggtcaacggggaaatgacagggctggctcgaagtttgcgtcactatgtcactaccgaggagttcgcagagagccgacgcatgattcagttgcttcgcgatacccgcagtgccgctgctaaggccgccgaggctggtgaagtgacctcactcaatcacatggacacaccactcgtgcgcattggtatggatgttcgctcgattgcggggttgaaactgaagaacccaggtgaagaacgcgtcgaagatttgcctgagccagttgaagaacaagaactagacactgaagtcttgatggaacaaattcgggcaagcgagattgattttgaggaattggaagaggctgtttctttagttcttgccgagcaatcgcacgccacgatcaccgaggtactagaacatttcccggcaacgcaaggtctcgccagcattgttggattgttatacctggcgatgcgtgatggtgttcccacaggtcgcgcgcaaatagtggagtgggaaagtgatgatgccacacaccgccggcggattacaggatggcagttcatcaggggtttaaacagtgaagatttggcagaaagcgagatggataaatgaatgatcagctgtgggaaggc

SEQ ID NO: 1670 - protein, 495 aa, Corynebacterium glutamicum
MTVVSHALGFKRFRQESLELSLLRSDNFPVVLAVVAQYFPQGAIAKPASELYQLLSDDFRVLREEGFELPKSPSDYVSDWVKSRWFVRRPGSSQTGETVEPSEELLAVLDSVQRWDNPHRSISASRIESLTQALQTLALESDPSTAKRLAELERERDRIERQIEAVHAGEFEVLTTVQIGDRVADILDLAASIPADFARVRHELSDLNRKLRRQLLDPEDSRGDVLEEIFRGVDLIGDSDAGRSFNSFFDVLLDRERSSLIDRWIREVLGRDEAIDLDSKLRTGLYRIFRDMEDASFEVNGEMTGLARSLRHYVTTEEFAESRRMIQLLRDTRSAAAKAAEAGEVTSLNHMDTPLVRIGMDVRSIAGLKLKNPGEERVEDLPEPVEEQELDTEVLMEQIRASEIDFEELEEAVSLVLAEQSHATITEVLEHFPATQGLASIVGLLYLAMRDGVPTGRAQIVEWESDDATHRRRITGWQFIRGLNSEDLAESEMDK

SEQ ID NO: 1671 - DNA, 846 bp, Corynebacterium glutamicum
  CDS (101)..(823): RXA00248
tccggcgataccctcgcagctggcttggttggccaccgcctacgcaataactggtcgatctagaccagtgtcttaggcaagaccccatttaggacacctcatgattcccctgattacgctttcccacggttcccgcaaaaagtccgcagctgcaggcattactgcgctgactcatgaggccggacgaatgctggaaacaccagccgtggaagcgcatttagagcttgctgaaccttcccttgatcaggttgtggcaacgctcagtgcggaaggtgtaaccagggcagcgttggttcctttgctgtttagcaatgcgtatcacgcaaagattgacgttcctgaggcagtaaaagatgcttcagaaaagtatggtgtggaacttctcgtgggtccgcatttgggcactggctccgatgtagccagcgtgcttgcgcagcggttgagtgcggacgcccccacagatgcccatgtgattttgtattccgttggcagctcacacgtgtccgccaatgaatcagtcatcgatcttgcccacaccattgctctcctcactggcttttcggttgaggtggtgcccgctaccggtgggccaggtgccggcggcgccggagtaatagaggtggcctcgaaacacaaggccgtccacatcctgccgctgtttgttacggaaggtttgctgctggatcgggctattgatcaatccgccaacatcgcagctgccaccggcacaaacttcacctattccgaacccctaactactgacctcgcaccacttgttgcagcccgttaccacgctgcattgagcgcactgctggcacatatctaagaccgctaaggaaatcagct

SEQ ID NO: 1672 - protein, 241 aa, Corynebacterium glutamicum
MIPLITLSHGSRKKSAAAGITALTHEAGRMLETPAVEAHLELAEPSLDQVVATLSAEGVTRAALVPLLFSNAYHAKIDVPEAVKDASEKYGVELLVGPHLGTGSDVASVLAQRLSADAPTDAHVILYSVGSSHVSANESVIDLAHTIALLTGFSVEVVPATGGPGAGGAGVIEVASKHKAVHILPLFVTEGLLLDRAIDQSANIAAATGTNFTYSEPLTTDLAPLVAARYHAALSALLAHI

SEQ ID NO: 1673 - DNA, 239 bp, Corynebacterium glutamicum
  CDS (1)..(216): RXA00250
gctttgggtgctgcgttgggtcagttcgatttcgtccgcaacaatattgatctgattttcttgctgatcgtgttcatttcggtggttcctggtttggtcggcatggcccgcaagctggctgacggccacaagcaagccaacaccgagccacaagaaaaccccgcagtccagacagccccagtaaaaacccaggaagcccaggaagccccccagaactaatctttccggtccgccagttc

SEQ ID NO: 1674 - protein, 72 aa, Corynebacterium glutamicum
ALGAALGQFDFVRNNIDLIFLLIVFISVVPGLVGMARKLADGHKQANTEPQENPAVQTAPVKTQEAQEAPQN

SEQ ID NO: 1675 - DNA, 366 bp, Corynebacterium glutamicum
  CDS (101)..(343): RXA00252
gcagcatgggggtgttggtggggccggggctgacagtgctgacgcggatgccgttgttggcttcttctttgcggaaggcgtcggcgagtccgcggagggcgtgtttgctggcggcgtagatggtgttgccggggtgtggtccgttgccggcgccggagttgatgtagatgacgcagccggatgccgcgcggagggcgggcaagagttggcgactcaactcggccgggacaatgacgttgagatcaaggtgtgcgtgccattcggccacactgccggcttcgatggtcgtgtcacgcgccaccgccgcggcgtgcaccagcgtatccacgtggtcgaggttttttagcttgtcgacgcctccctctt

SEQ ID NO: 1676 - protein, 81 aa, Corynebacterium glutamicum
VFAGGVDGVAGVWSVAGAGVDVDDAAGCRAEGGQELATQLGRDNDVEIKVCVPFGHTAGFDGRVTRHRRGVHQRIHVVEVF

SEQ ID NO: 1677 - DNA, 579 bp, Corynebacterium glutamicum
  CDS (101)..(556): RXA00257
catcatcaatggcgatgaaacgggtgcgctcagtacttgtgtatccatggctaatatcgggctacttcatactctgttgtaaacaaaggaagtttctatcatgaaaatcaagaaattcagcatcacagcgctagcctcagttctaatgctcacgggttgcgcgaccaatcacagctcacctctgtacagttatctgaatgcgtcaacatcaaccactgttgaacaagtacgtctcagcgatctttacggtgagcagtggaccgagttcgctcttgtctgcccctacaccacaaaagacgaggtaaaagaagagcttggtataaaaataaacacctacctcaccgattcgaccgatgacagtagtaacgatattgtgctcagggataaagacggttcatatgattggatctatttcaacagattcgacattgtgtacctctgcaacggctcagcggaaaatctaaaaatctaccccattgattcagttctagaatttgagcatagagacgactacggtacctggaaactgagcgctatcacagagccgggtaatcaataataacgcggacacttaagtac

SEQ ID NO: 1678 - protein, 152 aa, Corynebacterium glutamicum
MKIKKFSITALASVLMLTGCATNHSSPLYSYLNASTSTTVEQVRLSDLYGEQWTEFALVCPYTTKDEVKEELGIKINTYLTDSTDDSSNDIVLRDKDGSYDWIYFNRFDIVYLCNGSAENLKIYPIDSVLEFEHRDDYGTWKLSAITEPGNQ

SEQ ID NO: 1679 - DNA, 795 bp, Corynebacterium glutamicum
  CDS (101)..(772): RXA00258
taattaatataattaatgtagtttattaacctattatgcaatgacattttttaataattaaccacgtcacaacattctctcagatcacagaggttcgctcatgcgccacaccacgtcagccacatcaactacatctattattaagcgtgctatgaccattagtgccgctgttcttattgccagcgctgttggtctcacaaccagcgcaagttcgctcaatactctcagcgctacatcacctgaatcacccgatcaggcagccactgtgtcacaggctgaatcagatagtgaattagatgacggcatgaaaaagcttgcaaccaagatccttaatcgcgctgacaacgctgaaaataatgatgacaccggcaaaaacctcaacaatgatgataagaagctcaacacgaagcagccgcagcgccctgctgaaaaagttgcccaggcgatcgagctaagccttgataccaccacgaatgcagaaaagcctgataaaagttttcaccatgaaaaacccgtaaacgcctatgtcacaagtgtcagctacaacaaaagcaatgacacctggactatcaaaccatcagacagcgcggtgaatacaccgaccaatgatgctgagcgcatcagcaatatcatccaagaagctcgcgacctcggtctcagcgacgatgaatccttgacgcaacagatcgcatttcacgctcatgctgctaattatttagtcaccgaatgggtacttcgcggctatcagcttgctaacccgaaggtgcttccatgagaaaacaacgacgcatgatg

SEQ ID NO: 1680 - protein, 224 aa, Corynebacterium glutamicum
MRHTTSATSTTSIIKRAMTISAAVLIASAVGLTTSASSLNTLSATSPESPDQAATVSQAESDSELDDGMKKLATKILNRADNAENNDDTGKNLNNDDKKLNTKQPQRPAEKVAQAIELSLDTTTNAEKPDKSFHHEKPVNAYVTSVSYNKSNDTWTIKPSDSAVNTPTNDAERISNIIQEARDLGLSDDESLTQQIAFHAHAANYLVTEWVLRGYQLANPKVLP

SEQ ID NO: 1681 - DNA, 1299 bp, Corynebacterium glutamicum
  CDS (101)..(1276): RXA00260
gcaacagcggcttgcagatcagaaggcgcgagaggcgcgacagctgctagatattgaacgtcagcaggtgattgcagatcgctatgggccgttggtgaatatgcatagcgacgctgtgctagcgggtgcttcaataagagcaaaaataggtgctctcgcaactatttacggtgctcaaaacttagagaatgtcattcactcagttagttttactgacagacgtatttctcccgatggacaactgtcgaaagaattatttcgcgaagcttggagcgcaaaccttcttatccctgatccatcttctgatgtggaagcgtttgcgtggagcgaaaagaattccactgagctagcgggaggcatattcgttgagaaaatgctatttactgtcccggacacaggccgctccaataaccgtgtccagagcttctcagaagaacttcgtaaccacatttctttgaaagatatgtattctacacaacgtgaagagctattagaccttgcctacgagctcatggtgggggaagcagtacgttttgctaacttccgcctttatgatcagaatctcccaccacttactgaagcaaatatagacaaattgagagcccatctacgtgaggccgcagctagtgcgtcactaggagtgttatatctaatggtgtggcgatctgtaaaagacgcagctgcagcgcacactaaacatacaagaatgagcaaagaaaatgcgacaacgcatagtgttacaaaagtttctatctttgttgaccaattattaagcggaacattcccttgttcaaagccttttcacgaatcttcacaagtcccactgagtgaagccaccaagatagtttttaatttgattatggagtcaccgccgatggaaactgagccgagtgtgctgcgaaattccctccaagaacactcggattgggagctattgcaacagtgtgatgagaagattcctgatcgggagtttctgatggagtggttatatcaagaacagacgtggactgcagagcaattttttgatgctctagctatggtttcttctagcgagtttcgtatatgtgcacctggatgtgcgcatcaagtaagtgcagacatcgctacacaagtcttagaattccacgatcgagtgtctttccatgacgatcgtaaaagcgccatgcttgctgctgaagcaactattattggtaacaaaattggttcacaagcacgggccggagactttgttttaggtgaagtaatcaccaagctgcagaacatacctggtgaggtataacttctgcgtcgtccaattag

SEQ ID NO: 1682 - protein, 392 aa, Corynebacterium glutamicum
MHSDAVLAGASIRAKIGALATIYGAQNLENVIHSVSFTDRRISPDGQLSKELFREAWSANLLIPDPSSDVEAFAWSEKNSTELAGGIFVEKMLFTVPDTGRSNNRVQSFSEELRNHISLKDMYSTQREELLDLAYELMVGEAVRFANFRLYDQNLPPLTEANIDKLRAHLREAAASASLGVLYLMVWRSVKDAAAAHTKHTRMSKENATTHSVTKVSIFVDQLLSGTFPCSKPFHESSQVPLSEATKIVFNLIMESPPMETEPSVLRNSLQEHSDWELLQQCDEKIPDREFLMEWLYQEQTWTAEQFFDALAMVSSSEFRICAPGCAHQVSADIATQVLEFHDRVSFHDDRKSAMLAAEATIIGNKIGSQARAGDFVLGEVITKLQNIPGEV

SEQ ID NO: 1683 - DNA, 1236 bp, Corynebacterium glutamicum
  CDS (101)..(1213): RXA00273
tcggtcttggtggcggctccgtcattagttccagtaagtagttttttcactccctgttttgagtttttttctcacctttatatagataaggaatattcacatgtctttgaagcttaattctcgtcgtcttgcatccattgctgtcgctgttgcagtcggtgtctctggtgttgctgctgttggtgcggcaccagctacggctcagcaggtaggtgctggtaccccgattcacgttgtcaaccttgatcgcaccgttgttgatccagtgactggtgacatcaccttccacttcaccgacggcacttttgtcaccctcaaggcgggtgttgatggcaaggatggtaccgatggccaagatggtgtgatcggcaaggacgcaaccattgttgatgtcgctacggagtccaatggtgatgtcaagctcaccttctctgatggcaccgtcgtcaccattcctgcagctaaggacggtgtggatggtgaagatggcaaggatggcgaggacgctactgtggtgtctactgcgactgacgccaacggcaatatcgtcattacgttctctgatggctctgtgcttgttgttgctaacggtaaggacggcaacgatggctcagacggccaggatggtgctgatggtgaaaatggcaaggatggtgagaacggcgctaacgcgaccattgtcgatcagattgccaatgacgatggttccattaccattgtgttctccgatggttctgaggtcactatcccagcgccagctaagggtgccaccgatgagctggcacagtgtctgctgaacccgaagatgttgctgctggcagcaattcctgctgcaggtgctattgctaacgctgtggcaccggcgatcccacgtgttgttgaagatgtgcgtgcacagttcaatcttccaagcctcaacccccagtttgatcagtggctctacaacgcgaccaaggatattgatgcagggttgttgatctctggtgctaccggccttgctgtgctgtcggtgctcgctgatgatttctgtggcgacattgatgccgatgacaacgcagatggtgacgtggcggcagaaaagccaactggctcttctgggcttggatcatctgaacagagtgaaaaggttgatggtgacgacgatagtgtgatcgacactgaaactgatgcagatctcgaagtagaagaagaccctgagcttgttaacgcaggttaacgccagtgtaatgctggatt

SEQ ID NO: 1684 - protein, 371 aa, Corynebacterium glutamicum
MSLKLNSRRLASIAVAVAVGVSGVAAVGAAPATAQQVGAGTPIHVVNLDRTVVDPVTGDITFHFTDGTFVTLKAGVDGKDGTDGQDGVIGKDATIVDVATESNGDVKLTFSDGTVVTIPAAKDGVDGEDGKDGEDATVVSTATDANGNIVITFSDGSVLVVANGKDGNDGSDGQDGADGENGKDGENGANATIVDQIANDDGSITIVFSDGSEVTIPAPAKGATDELAQCLLNPKMLLLAAIPAAGAIANAVAPAIPRVVEDVRAQFNLPSLNPQFDQWLYNATKDIDAGLLISGATGLAVLSVLADDFCGDIDADDNADGDVAAEKPTGSSGLGSSEQSEKVDGDDDSVIDTETDADLEVEEDPELVNAG

SEQ ID NO: 1685 - DNA, 2733 bp, Corynebacterium glutamicum
  CDS (101)..(2710): RXA00274
agtttaaaagtcattaattactttatgggaaataataattaagttttcatcttttaactagttacagcatgttattaccttttatgaaaggcgtttcaccttgtctcttaatttgaagaagaattctgcgcgttctattaccgcgctgactgttgctggtctgggtctgtctattgttcctgcggcatctgcacaggatgttgcggatgacactaccaactccgattccacccgtgatgccatttgtgctgctgcaccgcttgttgcaggcgcagcagtgggtgttggtctgctgtctcagcagccagaattccagcatatggtgtcccagattcagtctgacgcacagcgcattgggcaggatctcagcaatcagttcaacaactctcttgaatcgctcaacattggcctcggtaacggcgtgcacggcccacagcagaacgctgtgcagggtattgatctcactgaagcagcacgaaccatggctggatggaatgacctggcggcacaggtgggccagactgcaggccctgctatcggcgctgttgctggtactgccggcctgatcgcactggttgactactgctggctggaaggcttcgacttcgcgggtggctccagtggcactgatggtgaaaatggtgttgatggtcaagatggtacctcgatcaccattactgagattaagactgatgatgacggcaataccattgttgtcttttccgatggttctgaaatcaccatcaccaatggtaaagacggcgctgctatcaccattgttaatacttaccgcgacgatgaaggtaatactgttgttgagttctctgacggttccaccattgttatcgacaagggtgaagacggtaaagatggagaagacggcaaggacggcgaagacggtaaggaccttaccgtaactgatacctacatcaacgatgatggagacaccgttgttgagctttccgatggttccacgatcattgtaaagaagggtaccgatggtaaggacggtgctgacggctctgacggtgctgatggagtcagcatcactgtggagaactcttatgttgatgcggacggcaacactgttgtcgaattctccgatggctccaatgtgaccatcaacaagggtgagaagggcgacaagggtgacgctggcgccgatggcgaagacggcgcagatggtgaatcaattactgttgttaacaccagcaacgatgctgaaggcaacactcttgttgagctctccgatggcactgttattaccattaataagggtgataagggtgacgctggcgccgatggtgaagatggaagtaatggcgcagatggcgagtccattacggtcatcgaaacccgtttcgatgcggacggcaacactgttgtggtgttctcgaacggcactgaaatcaccatcaacaagggtgagaagggcgacaagggagataccggcgaagacggtaaggacggactgaccccgtacatcggcccagatggtaactggtggatcggtgagaacaacacctgtactgctgcacgtggcaatgacggtaaagacggtgacaccccacgcatcggtgataatggtaattggtggatcggcatcgttgataccggcgttcctgctcgtggtcaggatggcgccaacggagccgatggtgctaacaccgttgagatcattaatggctactggtacatcaatggtgaaaataccggtgtcaaggcagttggtgaaaatggcaccaacggagccgatggacaagacggtgaaaatggaaccaacggtgctaacaccgttgagatcattaatggctactggtacatcaatggtgaaaataccggtgtcaaggcgcagggtccaaagggcgataagggtgacactggtgacacgggcgctccgggcgagggttccggtaatgtggacattgagatccgagaatcgagttatccaggtggtggccaggccaccatcatcattcttgatcaatttgaatatgaaatcccgcacactgttattggtgacaacggtaactggtacatcggtgaaaaggatactggtatcccagctcagggtggcactggaacacctggtgaggatggcctcacaccacacattggcgacaacggtaactggtggatcggtgataccgatacaggtgtctctgcaagcccgacccccgttggtgaggcggtagcgggtgtcactgatgtggtcttcaacactagtgatgaacccaagaccattactgcaacgatcaatggtgaagaatatgattacacccttccaccacatagtgctgttgtgttctacgctacaggttcaccaatggcatattctctaccgaatgcatcgggcctcactgttataggtactgaagagactcctggtttcaccactattcgattcagtgaccattccactgtgaccattccacatggacgagatggcaccaacggtactaacgaactgacggtaaggatggtctcaccccgcacatcggtgagaacggaaactggtggatcggcgaaaaggacactggtatttcgacaacctttggcggtggcggcaaccctggtaccggcaatgactgcatcacggtcccaggtgatgatcttggattcccagatgatgctgaggccggtgcagagaccggtgcagatgccgaaggtactattgactaaaggtcatagagcaacgaccatgactgattaaagtcggaacacaacccctag

SEQ ID NO: 1686 - protein, 870 aa, Corynebacterium glutamicum
LSLNLKKNSARSITALTVAGLGLSIVPAASAQDVADDTTNSDSTRDAICAAAPLVAGAAVGVGLLSQQPEFQHMVSQIQSDAQRIGQDLSNQFNNSLESLNIGLGNGVHGPQQNAVQGIDLTEAARTMAGWNDLAAQVGQTAGPAIGAVAGTAGLIALVDYCWLEGFDFAGGSSGTDGENGVDGQDGTSITITEIKTDDDGNTIVVFSDGSEITITNGKDGAAITIVNTYRDDEGNTVVEFSDGSTIVIDKGEDGKDGEDGKDGEDGKDLTVTDTYINDDGDTVVELSDGSTIIVKKGTDGKDGADGSDGADGVSITVENSYVDADGNTVVEFSDGSNVTINKGEKGDKGDAGADGEDGADGESITVVNTSNDAEGNTLVELSDGTVITINKGDKGDAGADGEDGSNGADGESITVIETRFDADGNTVVVFSNGTEITINKGEKGDKGDTGEDGKDGLTPYIGPDGNWWIGENNTCTAARGNDGKDGDTPRIGDNGNWWIGIVDTGVPARGQDGANGADGANTVEIINGYWYINGENTGVKAVGENGTNGADGQDGENGTNGANTVEIINGYWYINGENTGVKAQGPKGDKGDTGDTGAPGEGSGNVDIEIRESSYPGGGQATIIILDQFEYEIPHTVIGDNGNWYIGEKDTGIPAQGGTGTPGEDGLTPHIGDNGNWWIGDTDTGVSASPTPVGEAVAGVTDVVFNTSDEPKTITATINGEEYDYTLPPHSAVVFYATGSPMAYSLPNASGLTVIGTEETPGFTTIRFSDHSTVTIPHGRDGTNGTNELTVRMVSPRTSVRTETGGSAKRTLVFRQPLAVAATLVPAMTASRSQVMILDSQMMLRPVQRPVQMPKVLLTKGHRATTMTD

SEQ ID NO: 1687 - DNA, 582 bp, Corynebacterium glutamicum
  CDS (101)..(559): RXA00275
ctgacgcagacgttgcacagctcgcaaccgctattgacgaacagaaccgccccacaaagagctgttccctacggcagatcgcaaggaactattcgcctggttggataagcgtcgcccagaattaagcgacgatttcatcaaagcttttgatgatttccttcattcttttgcgtgcctggacaaaacaacgatcaccctattggcgcaatcaccggtgcgcacatccactggctatacaggtacttttatcggcatccccaataatgaaccactgtccgaagagcccacccccaccatttacattgtgcacgataatcacacagggataatccacagttaccccgcacgaatgattaatcttaaatctgagctcggttccgctgagatgattcacgaggcaatctgggggtcaccccatcaacagcagttaatctcatggtatgagacttactacaccaacatctactatggttttaacccacccactgaaccacataagagtcttgagatttttgctcaagacttctgtctgaccccaccagagaaacctccttttttctaaggcaaggcccgtggcacaca

SEQ ID NO: 1688 - protein, 153 aa, Corynebacterium glutamicum
LDKRRPELSDDFIKAFDDFLHSFACLDKTTITLLAQSPVRTSTGYTGTFIGIPNNEPLSEEPTPTIYIVHDNHTGIIHSYPARMINLKSELGSAEMIHEAIWGSPHQQQLISWYETYYTNIYYGFNPPTEPHKSLEIFAQDFCLTPPEKPPFF

SEQ ID NO: 1689 - DNA, 465 bp, Corynebacterium glutamicum
  CDS (101)..(442): RXA00276
ggcacactaccctatgactacaccgcaacccagcaaacctgcgccatggtcgcttgcctataagtatcaagccatcagcaatgatgattttgacaaccatatggatgacctcagcagtcgccaagaccatgaagcctacggcacgtacaaccccgataacggtgtcatgcccgatcatgtcatcgtgccttcaccctatgaaccatatgatgatgctgcgccgattgatcctttcgactacgacgaagatcttctcgatgagattaaagaagagcgcgctgcacatgcggttgacgcacaagtaacagaaacaactaaagctgacgcagacgttgcacagctcgcaaccgctattgacgaacagaaccgccccacaaagagctgttccctacggcagatcgcaaggaactattcgcctggttggataagcgtcgcccagaattaagcgacgatttcatcaaagct

SEQ ID NO: 1690 - protein, 114 aa, Corynebacterium glutamicum
MDDLSSRQDHEAYGTYNPDNGVMPDHVIVPSPYEPYDDAAPIDPFDYDEDLLDEIKEERAAHAVDAQVTETTKADADVAQLATAIDEQNRPTKSCSLRQIARNYSPGWISVAQN

SEQ ID NO: 1691 - DNA, 1509 bp, Corynebacterium glutamicum
  CDS (101)..(1486): RXA00279
tggggagcattcagaggtgcctaatcctctggatgattctgcggtgcaaaattcagccccacattcagccccacattcagctcggacccggttggagtttttggataccgatgactcgcctgatcattggcttgatccgttaacggagaaggatacttctaagcgcactctcgttaattcgattgttcaggaaactttcggccagcctatttttgttgcccgcaagatttgggctttcgtcaatacgtcgccgggccggatgacgttgatgacgattatcatttcgatcgccatttttgctgctggttacgccatgtcggtgtcttcggatactaggcagtccaatttggatgatttgatcactaatgcggagcctgtttcctataacgcgcatgtgctgtatacatcattgtcggttgctgataccactgctaccactggttttgttcaggctggtgtggagggcccggtgaatcgggtgaagtatcacactgctattgatcgtgctgcggttgctgctactcatactgcggcgtctgcggatagtagtaatgagcatttgatggagttggtgctggagattcagcgtcagttgccggtgtatacggggttggtggaaactgctcggactaataaccgtgcgggtaatcccgtgggtgtggcctatatgtctgaggccagcgcgatgatgcgtaatgaaattttgccgatggcgtctgagctttacaacctgacgagtcgtgcggtgtctgatcagcagcgttcggtgacgggtccgcagtggtttccgctgtctggattgcttgcggctcttgccatgttgattgttgcgcagtggtggttgatgcggattacgcgcaggcgcatcaacaaggggtttgccctggccacggtgatgatgatgacggcaacgttatgggtgtcagctgcaaactgggcgacgtggcaggctggcacgaagggttttgaggaagcgtcggggccgttgaattccatgactacggctcgtatttatgcgcagcagacccgcacgacggagacgttgtcgttggtgcgtaggcagtcgattcagggcagtggcactggttttaccgcaacgattaatcagattaagcgtgcgctggatgagtatgaaaccactgcgcagtcacagactccggagcatcagcagttgattacggcgattcgtaatgcgattgctgcatggactgccgatcacgatgagttcacggtgttgttggcgtctggtgattacaacggtgcggtcaatgcggtgctcaacaaagatgaggagggccagaccagctttgatgagctcgatactgcgctggctgagctgatcgcggattctcgcagctccatgcgttcctatatccagtcgggcctgcaggccacggagttggtgtccgtcatggtgatgattctgtctgtcgtttctgtgttggctttgtgggtcggcatccgcccccgtttgcaggagtacttataaatgcacgcttttcgacgccc

SEQ ID NO: 1692 - protein, 462 aa, Corynebacterium glutamicum
LDTDDSPDHWLDPLTEKDTSKRTLVNSIVQETFGQPIFVARKIWAFVNTSPGRMTLMTIIISIAIFAAGYAMSVSSDTRQSNLDDLITNAEPVSYNAHVLYTSLSVADTTATTGFVQAGVEGPVNRVKYHTAIDRAAVAATHTAASADSSNEHLMELVLEIQRQLPVYTGLVETARTNNRAGNPVGVAYMSEASAMMRNEILPMASELYNLTSRAVSDQQRSVTGPQWFPLSGLLAALAMLIVAQWWLMRITRRRINKGFALATVMMMTATLWVSAANWATWQAGTKGFEEASGPLNSMTTARIYAQQTRTTETLSLVRRQSIQGSGTGFTATINQIKRALDEYETTAQSQTPEHQQLITAIRNAIAAWTADHDEFTVLLASGDYNGAVNAVLNKDEEGQTSFDELDTALAELIADSRSSMRSYIQSGLQATELVSVMVMILSVVSVLALWVGIRPRLQEYL

SEQ ID NO: 1693 - DNA, 789 bp, Corynebacterium glutamicum
  CDS (1)..(789): RXA00282
atgagccgcgacgaccagacgaacaacaacggtgagggcgacgacacatcgcgcgagcagtcctgggatcaatcctggcagaacctaaataaggattcccagtacggtccgacctcgcatccggaggacgcgccgggaggattccagggaaacggccagggtaacagccggggcaacgctcagggcaatggtcagggcaatggtcagggctttggcccgggtaatgcttcgggatatggaggctacggtcagccatacccgcagactccgtaccagaattcctaccaaggttatggcgctacttcaccgcagaacgacgtggcgctggaagcgagcaacggcaaagtcgacatcatgcgggcgattcgcttcggattcaaagccacgtttgccaatccagcagtgtggattttgggcaccgtcggtcttggccttgcgttcatgattgtgagtgggttgcttggctacttatcatttttgatcgaccctaatgcgggcacgacgacttctggtttttcggtttccgagaccctgttgaacgtagctatcggaatcatcaccttcgcaataaccatttgcgtcatgcgcggtgcactgctttctgttgatggacacaaagttcgcttcggtgatttctttaaacccatcaatgttggtcaaacagtgattctgatggtggggctgggtatcttcggcatcatcctgggcaccttcaccacttttctcactcaaaatctggtgtcgtttaatgacgctgccggtaccgttgaggtcaataacagcggttta

SEQ ID NO: 1694 - protein, 263 aa, Corynebacterium glutamicum
MSRDDQTNNNGEGDDTSREQSWDQSWQNLNKDSQYGPTSHPEDAPGGFQGNGQGNSRGNAQGNGQGNGQGFGPGNASGYGGYGQPYPQTPYQNSYQGYGATSPQNDVALEASNGKVDIMRAIRFGFKATFANPAVWILGTVGLGLAFMIVSGLLGYLSFLIDPNAGTTTSGFSVSETLLNVAIGIITFAITICVMRGALLSVDGHKVRFGDFFKPINVGQTVILMVGLGIFGIILGTFTTFLTQNLVSFNDAAGTVEVNNSGL

SEQ ID NO: 1695 - DNA, 536 bp, Corynebacterium glutamicum
  CDS (1)..(513): RXA00285
ggaactgaattgggcgcattgttactgcgtgtcctcaacagggaagaaatgatggacagattcgcacgggagctgggttttttcgtcgacaagcagcttgaagaggtcgagcgcatcaactgtcaccataactacacggtccaggaggagcactacggcgagaccatttggctcacccgtaagggtgccgtgttggcggacgaaggcacgccggcgttgattccggggtcgatgggcaccgcgtcgtacgtgggcagtggcaagggcaacgccgaggcactgcggtcggcgccgcatggggcgggccggaggatgtaccgcaaccaggctaaaaagcgcttctcgacggccgacctggattctcggatggcgggcatcgtctaccggcccggcaaggagtggatcgatgaaattcccgacgcttacaaagacatcgatcaggtgatggccgatgctgccgatttggtgacaattcgccataaattgcgccagatcgtcaacgtgaaaggcacctaaagcgcattacggtaaagtgc

SEQ ID NO: 1696 - protein, 171 aa, Corynebacterium glutamicum
GTELGALLLRVLNREEMMDRFARELGFFVDKQLEEVERINCHHNYTVQEEHYGETIWLTRKGAVLADEGTPALIPGSMGTASYVGSGKGNAEALRSAPHGAGRRMYRNQAKKRFSTADLDSRMAGIVYRPGKEWIDEIPDAYKDIDQVMADAADLVTIRHKLRQIVNVKGT

SEQ ID NO: 1697 - DNA, 687 bp, Corynebacterium glutamicum
  CDS (101)..(664): RXA00286
ccataaattgcgccagatcgtcaacgtgaaaggcacctaaagcgcattacggtaaagtgcgagaggtattttgacgggtttagattgagggatgtggatagtgctgaaaatcccacggctgcttctacgccgtgtgcttccggtactcatcaccttggcgctcctgtgcggactggtgcttgcgtggtttatctatcctgcgaaggctgagcccaaaaaagatgatgtagttctggtgctggccggttccagcgatggtcgacacgaatatggtgccgagcttgttgaagaaggctacgccagcaattacgtcgtctccaacccgagtggctccaaagacaaagtgggatatgcccactgcgcaggaaagtcacggccaaaaaatgcggaaagtttctgcatggatccttaccccgtgatcacctccggcgaagcccgcacgtttaacgagcttgccaaaaaggaaggctgggaaagcgtattggtagtgaccagccgcacgcacacccaacgcgttcgcaccatgtttgaccagtgctataccggtgattccacagtgctcaacgtcaacagcctaggacgtaccgggcttcacaatgcagtactccacgagattggcggcttcattaaattttggattaccgctccgtgcgcggacacaaactaaggacgttccagctccaacag

SEQ ID NO: 1698 - protein, 188 aa, Corynebacterium glutamicum
VLKIPRLLLRRVLPVLITLALLCGLVLAWFIYPAKAEPKKDDVVLVLAGSSDGRHEYGAELVEEGYASNYVVSNPSGSKDKVGYAHCAGKSRPKNAESFCMDPYPVITSGEARTFNELAKKEGWESVLVVTSRTHTQRVRTMFDQCYTGDSTVLNVNSLGRTGLHNAVLHEIGGFIKFWITAPCADTN

SEQ ID NO: 1699 - DNA, 552 bp, Corynebacterium glutamicum
  CDS (101)..(529): RXA00294
ttgttggtgtgaggttgggttttgtcatcctgaatgcttcatttctaccctcgtgggtaaagttggtgccgaatcaacaatctcttttggaggaactttaatgagcatttccaacgcaatcctgcgtggtgtgtctggcgcttatattctgcagtccggctacggaaaacttggattgcctaatgaggccgctgctggcattcagggtctagctgcaacgggtatcccagcggtggctgatatggattcagatactttcggtaagtttgttgcctactcggagttgggtatcggtggagctttgcttgctccatttatccctagccgtcttgcaggtttgggtcttggtgctttctctacaggtttgttggccatttacttccgtaacccagcgatgactcaagacgacggaatccgcccttcccaggatggaaccggattgtctaaggatcttttccttgctgctattgcgggtgctttggtgttcgcacctgctaagaagcgtaagaaggcgaagaacaagtctaagtaagcttgcttgaacggcgcttg

SEQ ID NO: 1700 - protein, 143 aa, Corynebacterium glutamicum
MSISNAILRGVSGAYILQSGYGKLGLPNEAAAGIQGLAATGIPAVADMDSDTFGKFVAYSELGIGGALLAPFIPSRLAGLGLGAFSTGLLAIYFRNPAMTQDDGIRPSQDGTGLSKDLFLAAIAGALVFAPAKKRKKAKNKSK

SEQ ID NO: 1701 - DNA, 1035 bp, Corynebacterium glutamicum
  CDS (101)..(1012): RXA00297
aacaaggcaccggaaaacaagcaacgcaccttgcagaggtggtcttaagcatcttggagcaaaacaacatggcacaataacgatcatgcaacaggtgctcatgggtttcacggtggtgttcatcgtcatcggaataggttggattctcggtagaagagacaccttgggcacacatgcccagaaacctttgagcctgtttgtctattacgtggccaccccagcgttgttgtttgatcgggtcaccaagtcagatacctcgacgattttctctctgaacttcgtggtcattgcactctctgcgttgatcgtaggtttcctgtttttcctactcatgcggttcgtgatcaaaagaactgccgcagtatcggtgatcggcatgctagctgcgtcctacgccaacgccggtaacctgggtatccctttggcagcctatattttggatgatttcaccgtggtgattcccgtgattttgttccaggtggcgttctacgcaccgatcaccatgaccatcatggagatgctgaccaacaagaaatccaccaacttggtgcgcaacctcctggtcacgccactaaccaacaccatggtgctcgcagcgattgccggtattgctgtgtctttgacttcgatgagcgtgcccgtggtgattgctcagccagtggaaatgttggcgaatgcttcagtgccactggctttggtggtgttcggactgtccttgtccaagagcaagatcctggaaaaggggcaggtatccaggcgcgatgtgtttacggcggcactgttcaagaatgttctgcacccaattgttgcgggacttttagccttagcctttggtatggaaggtactgccttgttgtcggcggtgattctcggtgcactgccaacagcgcagaatgtctacacctacgcgttgcgatttagaacagctgaatcgatggcgagagacacaggggtggtcaccacactcatttccttccccgtattggtggcggtctccattatctttggatcttagggttagcattagtggtcatg

SEQ ID NO: 1702 - protein, 304 aa, Corynebacterium glutamicum
MGFTVVFIVIGIGWILGRRDTLGTHAQKPLSLFVYYVATPALLFDRVTKSDTSTIFSLNFVVIALSALIVGFLFFLLMRFVIKRTAAVSVIGMLAASYANAGNLGIPLAAYILDDFTVVIPVILFQVAFYAPITMTIMEMLTNKKSTNLVRNLLVTPLTNTMVLAAIAGIAVSLTSMSVPVVIAQPVEMLANASVPLALVVFGLSLSKSKILEKGQVSRRDVFTAALFKNVLHPIVAGLLALAFGMEGTALLSAVILGALPTAQNVYTYALRFRTAESMARDTGVVTTLISFPVLVAVSIIFGS

SEQ ID NO: 1703 - DNA, 303 bp, Corynebacterium glutamicum
  CDS (101)..(280): RXA00320
aacagacccactctagccgttgcgggttcttattgaggtctatagtggggtgctacacactacaaaccgtgatttgtttcgtgattggagctgagcccacatggctaaagaagatttgaagtggttctacgatctggcaaccggcaaggtttttcaaggcaaggtttccggctttgaaacccgcatgggcccatatgacactgaagaggaagcccatcacgccatctccattgcggcagcccgaaccaaggcagccgaaatttgggacgacaaggaagactaaaaaaaactggggtcacactt

SEQ ID NO: 1704 - protein, 60 aa, Corynebacterium glutamicum
MAKEDLKWFYDLATGKVFQGKVSGFETRMGPYDTEEEAHHAISIAAARTKAAEIWDDKED

SEQ ID NO: 1705 - DNA, 1938 bp, Corynebacterium glutamicum
  CDS (101)..(1915): RXA00321
caaagacaacacaggttccctatgaaaacggggaacctgtttcacctactttttaatcacgcttcacaatcacataagtctttaaaggatggatacaacaatgggccagcatctagaagtggaaactaagttttccgtcagtgaatcaactcagattccacaacttgaggctatcgcagaagtcgaccacattgatcgcaccgaaatccaccaactaagcgctgtttactttgacaccgtagatttgcgcctcacccgcgcaaaaattaccctccgtcgccgcaccggtggaaacgatgccggctggcacattaagttccccggaaccatcggtcgccgtgaagtccaagccccacttgatggcgaaggcgcaacagaaaccctccctccacgtgagctcttgggacacatccgagcgctgatccaaggccgtgagctgacccctatcgcccaggtggataatgaacgccacatgtcttacctcgcggatgaggacggcgcagtcatcgcagaattctgcgacgatcatgtatccaccgtgtcccaccttccaggtggcgtgcgcaagcagtggcgtgagtgggaattcgaactcgctgatggcaccctcgccgaagaagccatctcagtactgctgcaatctgcacagtcagtcctgaccgcagctggagcttttgtctccaacagcccatccaaacttgtttcggcgctggacgaatcagtcaaccacgcgccaaagcctccacagatggcgcagctggacaagaatgacccagcacgtggtgttcttgcagcaatcgcagccaacgcctcaaagatcgccgaatacgatcctcgagtacgcgccgatgaatatgattcagtccaccagatgcgcgtagctacccgagaactacgcagccacctccaaacctttgagggcatcctcggcggcgaagactacctcaacctggaaaaggaactgaaggttctcgccaacatcttgggtcgcgcacgcgatgctgaagttgtggaagagcgcctcagcaacctgattaacactgaggttggcgactccatcgaggaggagactaagaaggaactgcttgaagatcttggtgcagaataccgtcgtgagcatgagcgagtagttcgtgcgctggataatgatcgctacactgatcttcttcaggcactggaaaacctccttgttgatccaccgctgatcacagaagtcgaagaacccgaagctaccgaagcccctgagtccgctgagactaccgagtccactgacgtctctgaagcaaccgaagaagcagacgcagaagctgagtctgtcgaagaagctactgagcaggaagaatcagcagacgcgcctgaatctgcagatctggacgctctcgatgaggagtactcccctggttcccaagcgccggtggaggagccgaaggaaccgaagaaggttgatgctgctctcgtacttctagagcaccttgataaggcgcacgtgaagctcgtcaagctggaaaagaaggctcgctcacagtgggatgatctcagcattccgatgctggagcgggaagaaaacttccacaacctgcgcaaggctgccaagaagcttcgctacagtgcagaggcagtgggcaaagcaaccaccgttgagacgaagaaactgtacaaggcgtgcagtggtttgcagtcagttcttggcgattaccaagatgccattacttcccgtaatgagctgttgcgccgagctcaggttgcccgccgccaaggccgggataccttcgcatacggaatcctctaccagcacgaacaaaccctgtcgagggaatacctgactggttattccgatgcgttcaagagcgtagaaaaagcctatgcaaagctggctgaagataccgccaagcgttcaaagaagaacaagcgtaagtaaacgcaggcaataaaaaactg

SEQ ID NO: 1706 - protein, 605 aa, Corynebacterium glutamicum
MGQHLEVETKFSVSESTQIPQLEAIAEVDHIDRTEIHQLSAVYFDTVDLRLTRAKITLRRRTGGNDAGWHIKFPGTIGRREVQAPLDGEGATETLPPRELLGHIRALIQGRELTPIAQVDNERHMSYLADEDGAVIAEFCDDHVSTVSHLPGGVRKQWREWEFELADGTLAEEAISVLLQSAQSVLTAAGAFVSNSPSKLVSALDESVNHAPKPPQMAQLDKNDPARGVLAAIAANASKIAEYDPRVRADEYDSVHQMRVATRELRSHLQTFEGILGGEDYLNLEKELKVLANILGRARDAEVVEERLSNLINTEVGDSIEEETKKELLEDLGAEYRREHERVVRALDNDRYTDLLQALENLLVDPPLITEVEEPEATEAPESAETTESTDVSEATEEADAEAESVEEATEQEESADAPESADLDALDEEYSPGSQAPVEEPKEPKKVDAALVLLEHLDKAHVKLVKLEKKARSQWDDLSIPMLEREENFHNLRKAAKKLRYSAEAVGKATTVETKKLYKACSGLQSVLGDYQDAITSRNELLRRAQVARRQGRDTFAYGILYQHEQTLSREYLTGYSDAFKSVEKAYAKLAEDTAKRSKKNKRK

SEQ ID NO: 1707 - DNA, 1227 bp, Corynebacterium glutamicum
  CDS (101)..(1204): RXA00322
cgcggttttttgatgacacgggggtgggaggtgtccagcttgggtggttcactgagaaccgcaccgaaattagaacactcctacgaataaggaaaccgcaatgactctctcccacttctccgacaacgtcaccgacgcacaagactcttaccgtcagattttagaagaaagcatcatcagccacctaggtttctgtgcgcttcgtgggtggactcccgccgatctccgccatgagttttccgccgatattgatccactcctgtttcacgcgctacctgagattgcttactcctgctccgatgagatgtacacactgtgggtgaacggaacgcgtgccgccgaaactagccacttgccggtgatgaccctggagaagattctcaccgagctaccgaagctaagtaccttgcctgactgggcaatgctcgcagagctccacgccttagacaatcaagacaccagcccaatgaccccggcacaggccaaagcgcatcatcgtatcaccgcacttttgaaaaaggcagagtccaccaacttcgaagaagaagccgaagcattgatccttaaagcagagacacttcgacagcagtaccggattgaatcactgctgattaattcctatgaccaagatgtccaagctcgatcttctacgattcgtgcatctcgggtgtatctggaagctccatggatccgacaccaatacaaactgctcaatgccattgctcgggtgcattccagcgaagcgctgctgatcaccaaatctggcatctgcaccctcttcggcgagcaagatgacgtagcccacattattgatctgttcaacagtcttaatcgacaacgtgcccacttcatgaaaacgtcagcaggtgcccgaattgcccaattaaatggcgaaacaagctcatatcgccgtagttttatgatctcctacgccagccaaatctctagacttctcatctcagcaaaagaggatgcattcaacgaactagctggtcaggcaccactagctcacagcgccatcgttcctgtcctagagaacagaagtgtgaggtcaaaggaagcactgaaggaaaccttcccgaatatgcggacaatgaccttcaaatcgaccaaccgacgaggcattattgacggatttaatgctgccaatgaatcccaccttggcggggaatctgccagcttggaagactcaacattcatgttctagagcgggtgaaagccccattt

SEQ ID NO: 1708 - protein, 368 aa, Corynebacterium glutamicum
MTLSHFSDNVTDAQDSYRQILEESIISHLGFCALRGWTPADLRHEFSADIDPLLFHALPEIAYSCSDEMYTLWVNGTRAAETSHLPVMTLEKILTELPKLSTLPDWAMLAELHALDNQDTSPMTPAQAKAHHRITALLKKAESTNFEEEAEALILKAETLRQQYRIESLLINSYDQDVQARSSTIRASRVYLEAPWIRHQYKLLNAIARVHSSEALLITKSGICTLFGEQDDVAHIIDLFNSLNRQRAHFMKTSAGARIAQLNGETSSYRRSFMISYASQISRLLISAKEDAFNELAGQAPLAHSAIVPVLENRSVRSKEALKETFPNMRTMTFKSTNRRGIIDGFNAANESHLGGESASLEDSTFMF

SEQ ID NO: 1709 - DNA, 768 bp, Corynebacterium glutamicum
  CDS (101)..(745): RXA00325
aggatttctctgaggaatctagacgcagattaacttccgcttggcagcgaccgggataacaccgcggttgcggccacgcaggctcacaaaggacaccactatgacaagcattattgcaagcaacagcgacctatcggaggcgctgcgcacccacactgcgcaggcccatgaagaggccgagcactcaacgtttatgaatgatctgctcaccgggaagctcgatgcgcaggcatttatcaagttgcaggagcaatcatggttgttctacaccgctttggaagctgcagctcgtgcatgtgcagaggattcccgtgcggctggtctgctggacccacgcctcgagcgcaaggaaacgttggaagctgatctggataagctgcacgaaaacaccacctggcgtgacaacgtcacggccactgcagcgacagcgtcttatgtggaacgtcttgaaagcatcgaagcggccaaggatttccctcgtttggttgctcatcactatgtccgctacctgggtgatttgtccggtgggcaggttattgcacgtctggtgaacagggaatatggagtttcggaagaggcgttgagcttctactgctttgaagatcttggcaagctcaaaccgtacaaggataattaccgtgcagagcttgatgctttggaattaacagcagaggagcgtgctgcgttgctggatgaagcatctgatgcgttcaggtttaatcagcaagtttttcaggctcttgcttaaccgaaggtgaagtcttggcg

SEQ ID NO: 1710 - protein, 215 aa, Corynebacterium glutamicum
MTSIIASNSDLSEALRTHTAQAHEEAEHSTFMNDLLTGKLDAQAFIKLQEQSWLFYTALEAAARACAEDSRAAGLLDPRLERKETLEADLDKLHENTTWRDNVTATAATASYVERLESIEAAKDFPRLVAHHYVRYLGDLSGGQVIARLVNREYGVSEEALSFYCFEDLGKLKPYKDNYRAELDALELTAEERAALLDEASDAFRFNQQVFQALA

SEQ ID NO: 1711 - DNA, 603 bp, Corynebacterium glutamicum
  CDS (101)..(580): RXA00326
cctgatctttgcccctaagtggtttacgggctggaaaatggtacgtagtctcgggtgtaaagcacacttcggtactcgacaggaagttaggaattccaccatggcaatcaagctgtccattgacctatcagatgcaacattcgcagaactttcggcagtcatcggttacgcacatcagttgggtgttgatgcggatgagaagctcacctttgaaggtacagtccttaacattgaattcgacggcgaccttcagtttgatgatgtttttgatgcctttgatgaggcggaaattgagctcgacaaccctcgcgaagacggccccatctacgcagatgatctgatcgatgaggatgaggactaccgcgcacagaccaagagccagatcaacgacgaggttatcaacgagatccgcgatggtatttcaagcttcgttgatggcatcgtaaatggccttggccagggtcgccgcggtggacgttacggtgatttcggtgggccacgcggccctcgcggtccacgcaatgacggtccattcggcccatttggaccattcggtccgggataccgcggtccgcgtttctagcggttacggtcgggttttag

SEQ ID NO: 1712 - protein, 160 aa, Corynebacterium glutamicum
MAIKLSIDLSDATFAELSAVIGYAHQLGVDADEKLTFEGTVLNIEFDGDLQFDDVFDAFDEAEIELDNPREDGPIYADDLIDEDEDYRAQTKSQINDEVINEIRDGISSFVDGIVNGLGQGRRGGRYGDFGGPRGPRGPRNDGPFGPFGPFGPGYRGPRF

SEQ ID NO: 1713 - DNA, 594 bp, Corynebacterium glutamicum
  CDS (101)..(571): RXA00336
ttaggatcttaaaggtaggaaattgcgctttgcgacgtcgaaaagcaacgccttttgactgcagtatccgccctctacatgtttggatttgattgtaacaatggcaaagccgaagagaagttggcttgacggacccgaaattccagctgattttgacgatcctgatgcacccggcaggtggcctggcgaaaagttggggcttcctcaagaaggggccggctctctgtcctcagtggctcgtcgtatcggcggggtctgcgtggactggggtgtttcctgggttattgctattgtgctgtccaatttcacggatgtgctgggcgatgtagcgacatccacgctcattattttcgtgatcctgggttggcttaccggttggatctttgctcgcaccccaggtcatgccgtgtttggcatgggccttgcgcgtgtggatgcagaggaacgtgtgggctggtggcgtgcgctggttcgcccactgctgacgatcttgattctgcctgccgtgatggtggatgctgacggccgtgggctccacgacaaggcaacgggaactgcagttatccgcgggtaatttgtcttgagtgaaattta

SEQ ID NO: 1714 - protein, 157 aa, Corynebacterium glutamicum
MAKPKRSWLDGPEIPADFDDPDAPGRWPGEKLGLPQEGAGSLSSVARRIGGVCVDWGVSWVIAIVLSNFTDVLGDVATSTLIIFVILGWLTGWIFARTPGHAVFGMGLARVDAEERVGWWRALVRPLLTILILPAVMVDADGRGLHDKATGTAVIRG

SEQ ID NO: 1715 - DNA, 525 bp, Corynebacterium glutamicum
  CDS (1)..(525): RXA00337
gatgtggagggaggcgtcgaaaagcattctttaagcactgcggacattgcagctcgcgcacacgcccatatgaaatcccatgatgttttggggcggcagactacgccgcctcagccggagggcggcgttgctgcccggttgggcgggattgcgtggacaatgatccataagcaaatgctttcgcgtgacacaaaaggcctggatatcaccgtgttgagcaccattcctgagggggtggggctgggtgaaaattccgccatggatgtggcgctcgcattggcgctgtatcgggaaaatattgaggaagcccccacgaaggcgcgcattgcggacatttgttcgcagtccgcattcatgttcagtgagacttcagtgttgcgtgcgcggcacaccgaggcgttgcggggtgaaactggacacatttcggtggttgattacgccgatggttcggtcactcaggcgccacatccggtgagtcgttccgctggtttgtcggcatttgttgctgctgcgcaaactgaaact

SEQ ID NO: 1716 - protein, 175 aa, Corynebacterium glutamicum
DVEGGVEKHSLSTADIAARAHAHMKSHDVLGRQTTPPQPEGGVAARLGGIAWTMIHKQMLSRDTKGLDITVLSTIPEGVGLGENSAMDVALALALYRENIEEAPTKARIADICSQSAFMFSETSVLRARHTEALRGETGHISVVDYADGSVTQAPHPVSRSAGLSAFVAAAQTET

SEQ ID NO: 1717 - DNA, 840 bp, Corynebacterium glutamicum
  CDS (101)..(817): RXA00339
acaggttgaagttgatgtgatttcgatccgcacagacccctggaccatgtctgcgcgagcagtgaactaaattcttgagaactaaaaaaggagaacttcaatgaagctggacccatctctgcacaaaaccctgctgcagctcgccaccaccctgcgcacccaaaacgccaactccgcaccgaagaccaccccggagcaggaagctgtagacaaggctgtcgctgaactttcccgcaaccgcgacgctgcatccgctggacaaatggctgtcgatgacatggaaaacgaaatcctgcgcattcagtccgacgaacgcaaactgcgccgccgcaagaaagacggccaggacgcactcggtgcagaaactgacgaagagcgtcgccgcgacctcaaccacgacgtctacactgcgaagtcccgcatcgctgacctcatgagcgaactgcaagaagctcacaatgaaatccatgcgctgcgcaacaaccgcgacctcgcacagtctcgcgtcaaagacaccgaacgcaaagttgccgacgcccgcgcagccgcagaagccgccgcagcagcaaccccagaaggtgaagacccagcagtagtcatcgcacacctggaagagaaacttccctccgaagcactggcagaattccatgcacaacgcctcgaaaacggcgtaggcgcagcactcttcaacggccgctcctgcagcggatgcgccatggttctccctgcaaccggtatctccgacatccgcaacacccccaaagatgaggttccacagtgcccagaatgtggctcttacctcatcactgacatctcttagaaagaccacccagtgaaatt

SEQ ID NO: 1718 - protein, 239 aa, Corynebacterium glutamicum
MKLDPSLHKTLLQLATTLRTQNANSAPKTTPEQEAVDKAVAELSRNRDAASAGQMAVDDMENEILRIQSDERKLRRRKKDGQDALGAETDEERRRDLNHDVYTAKSRIADLMSELQEAHNEIHALRNNRDLAQSRVKDTERKVADARAAAEAAAAATPEGEDPAVVIAHLEEKLPSEALAEFHAQRLENGVGAALFNGRSCSGCAMVLPATGISDIRNTPKDEVPQCPECGSYLITDIS

SEQ ID NO: 1719 - DNA, 1082 bp, Corynebacterium glutamicum
  CDS (1)..(1059): RXA00349
gagaaaatcctggacgagttggagcaatcccctgcgtcttatggtttccctgttgcgttgcttggctggccaatgatgggtggtgctgttgctgtgctgttgggtggtggatgccaggtttccctaattgcttttattaccgcgttcacgatcattgccacgacgtcatttttgggaaagaagggtttgcctactttcttccaaaatgttgttggtggttttattgccacgctgcctgcatcgattgcttattctttggcgttgcaatttggtcttgagatcaaaccgagccagatcatcgcatctggaattgttgtgctgttggcaggtttgacactcgtgcaatctctgcaggacggcatcacgggcgctccggtgacagcaagtgcacgatttttcgaaacactcctgtttaccggcggcattgttgctggcgtgggtttgggcattcagctttctgaaatcttgcatgtcatgttgcctgccatggagtccgctgcagcacctaattattcgtctacattcgcccgcattatcgctggtggcgtcaccgcagcggccttcgcagtgggttgttacgcggagtggtcctcggtgattattgcggggcttactgcgctgatgggttctgcgttttattacctcttcgttgtttatttaggccccgtctctgccgctgcgattgctgcaacagcagttggtttcactggtggtttgcttgcccgtcgattcttgattccaccgttgattgtggcgattgccggcatcacaccaatgcttccaggtctagcaatttaccgcggaatgtacgccaccctgaatgatcaaacactcatgggtttcaccaacattgcggttgctttagccactgcttcatcacttgccgctggcgtggttttgggtgagtggattgcccgcaggctacgtcgtccaccacgcttcaacccataccgtgcatttaccaaggcgaatgagttctccttccaggaggaagctgagcagaatcagcgccggcagagaaaacgtccaaagactaatcagagattcggtaataaaaggtaaaaatcaacctgcttaggcgt

SEQ ID NO: 1720 - protein, 353 aa, Corynebacterium glutamicum
EKILDELEQSPASYGFPVALLGWPMMGGAVAVLLGGGCQVSLIAFITAFTIIATTSFLGKKGLPTFFQNVVGGFIATLPASIAYSLALQFGLEIKPSQIIASGIVVLLAGLTLVQSLQDGITGAPVTASARFFETLLFTGGIVAGVGLGIQLSEILHVMLPAMESAAAPNYSSTFARIIAGGVTAAAFAVGCYAEWSSVIIAGLTALMGSAFYYLFVVYLGPVSAAAIAATAVGFTGGLLARRFLIPPLIVAIAGITPMLPGLAIYRGMYATLNDQTLMGFTNIAVALATASSLAAGVVLGEWIARRLRRPPRFNPYRAFTKANEFSFQEEAEQNQRRQRKRPKTNQRFGNKR

SEQ ID NO: 1721 - DNA, 149 bp, Corynebacterium glutamicum
  CDS (1)..(126): RXA00355
atcgctttcggtcgcgcagctcaccgcatgaagcagcagggccaaagcggagctttcaccgtcctcgaagttgctccatacctgctctccccagagaacttggacgatctgatcgcacgcgacgtctaatttagctcgaggggcaagga

SEQ ID NO: 1722 - protein, 42 aa, Corynebacterium glutamicum
IAFGRAAHRMKQQGQSGAFTVLEVAPYLLSPENLDDLIARDV

SEQ ID NO: 1723 - DNA, 624 bp, Corynebacterium glutamicum
  CDS (101)..(601): RXA00375
cagcctgtcaaaatgctcaccgactacgcaccagaagacgctaaacggtaagtactgaagaatttttaaagacgacggagatttcaccacaatgccaagcatgttcccatcacccgcaactggcggagatgacatcaaccgacgccccctgaatgaaccaaacgcagatgcaaccaccatccccactgcactaaaagtggtgttctggatgctgtttgccactgcagcgttcatgatttttacaggcctggtgatgtacaccgccggatacacgggacctgatgatgtggatgagagctacaaagccgttgtggtgaacaaccaggagttcatcggtggcatcaatgcctttgctggcgtcgtgattgctgcacttacttcacaactgccaaagggcggcaagaatccgcgccgtcttttgttggccatcatgttgttggtattgctgacagatctgttgtcttttgccacccgcgctggaggcttcgcactcgcaatcatcgcagtcttgttggctttggaagcactcttgatgttccgcccagcagtcaatgatcacattgaccgaaatcatatggctcgtgtaatgaatcgcgagaagtagaacggttcgaccgtactttt

SEQ ID NO: 1724 - protein, 167 aa, Corynebacterium glutamicum
MFPSPATGGDDINRRPLNEPNADATTIPTALKVVFWMLFATAAFMIFTGLVMYTAGYTGPDDVDESYKAVVVNNQEFIGGINAFAGVVIAALTSQLPKGGKNPRRLLLAIMLLVLLTDLLSFATRAGGFALAIIAVLLALEALLMFRPAVNDHIDRNHMARVMNREK

SEQ ID NO: 1725 - DNA, 744 bp, Corynebacterium glutamicum
  CDS (101)..(721): RXA00380
caggcaatgcgacctcgcctcagtgacatccttggtgttccaagacgatcaaattgtcggcgtgcattacaacgaaccagctcaggagatttgatcactcgtgcgtttgaccaaactagcagcaacaatcggctgcgtgacactcagcggacttgcgctagtagcctgcagcagtgacagtaccgctggtactgacgctgttgctgtcggcggaaccttccaattccactccccggatggaaagatggaaattttctacgacgaggctgaccgtcaacaactccccgacattggtggagattccctcatggaagagggcacacagatcaacctgtctgatttcgaaaaccaagttgtcatcctcaatgcgtgggggcagtggtgtgcaccgtgccgctccgaatccgatgatctccagattatccatgaggaactccaagctgccggaaacggcgacacccctggtggcaccgtgttgggtatcaatgtgcgtgattactcccgcgacatcgcccaagactttgtcaccgacaacggccttgattacccaagcatttacgatccaccatttatgacagcagcatccctcggtggtgttcccgcatcggtgatcccaaccaccatcgtgctggataaacagcaccgccccgcagcagtgttcttgcgcgaagtcacctccaaagatgtgttggatgttgcgttgccattggtagatgaggcctaaatgtctgagattgtggtagc

SEQ ID NO: 1726 - protein, 207 aa, Corynebacterium glutamicum
VRLTKLAATIGCVTLSGLALVACSSDSTAGTDAVAVGGTFQFHSPDGKMEIFYDEADRQQLPDIGGDSLMEEGTQINLSDFENQVVILNAWGQWCAPCRSESDDLQIIHEELQAAGNGDTPGGTVLGINVRDYSRDIAQDFVTDNGLDYPSIYDPPFMTAASLGGVPASVIPTTIVLDKQHRPAAVFLREVTSKDVLDVALPLVDEA

SEQ ID NO: 1727 - DNA, 836 bp, Corynebacterium glutamicum
  CDS (1)..(813): RXA00387
caaaacgacccagaaacctgggaagactacgaacttcgcgtcaaccacccactgcgcatcgaaggcgaccgcgtctaccttcagggccacggcttcgccccaacattcaccgtgacctggccaaatggcgagacccgcacccagaccgtgcagtggcgcccagacgacccgaccttcttcctgtcctcaggcgtggtccgtttcgatccacccgccggcatgtacccagacctttacgagcgccgccaaaaccagttggccatccagggacttttcgcaccgaccgcggaatgggaaggcgacaacaacgaactgctgacctcctcctacccggcgatgcgtgacccagccgtggcgatcgatatttaccgcggcgacaatggcctcgataccggcatcggacagtcattgttcagcctggactctagtctcatgcacagcggcgtgctgcaaaaaattgagcgcgtcaacctccaaatcggcgacaccgtcaccctggatgatggcaccaccgtctccttcgacggcgcgtcagaatttgccaactaccagatcagccgcgaccccacacaaaactgggtgctggtcaccaccgtgatttcgctggtctccctggttggatccctgatgatccgacgccgccgcatttgggtgcgtttctatccacaagaaaacggaaccacccgcgtggaaaccggcggacttgcccgcaccgaccgcgcaggctggggtggcgaatacgagaaattccaccgcgaactgctgggtctgaaggaggaagatgaagacgaagagtacttcgaccacgacgactaacaccgcaatttaaaggcttt

SEQ ID NO: 1728 - protein, 271 aa, Corynebacterium glutamicum
QNDPETWEDYELRVNHPLRIEGDRVYLQGHGFAPTFTVTWPNGETRTQTVQWRPDDPTFFLSSGVVRFDPPAGMYPDLYERRQNQLAIQGLFAPTAEWEGDNNELLTSSYPAMRDPAVAIDIYRGDNGLDTGIGQSLFSLDSSLMHSGVLQKIERVNLQIGDTVTLDDGTTVSFDGASEFANYQISRDPTQNWVLVTTVISLVSLVGSLMIRRRRIWVRFYPQENGTTRVETGGLARTDRAGWGGEYEKFHRELLGLKEEDEDEEYFDHDD

SEQ ID NO: 1729 - DNA, 987 bp, Corynebacterium glutamicum
  CDS (101)..(964): RXA00392
tgcttgaaatacgttcggcaggctatgggggagtgtgaaacgctattgtgaaatgaatagataggttccatagtcgatcgaggaggagtcgcagaagtttatgtgggttggttatgcggttcgacagatcgccagtgtttttcttactcttttgcgcatgctgccactagcagcgcgaaatcgagttgccaggggacgcatcccggaaaccggcgatgtggtgatctcattgaccacccatgggaagcgaattaactacgttcacttcaccatcgaatcgatcgcacgcggccatgtgaaagcaccaattgtgctgtggttggacaaaccagactttgatgcgccgtggcctgccaccattaagcgacttgtcgcccgcggtctgcaagtacggtgcagcgacggcttctacggcccccacaccaaatactggaaccaattccgagaaatccacggcaccggcgtgcgtgtcgccaccgtcgacgatgacatgatctaccccgagtggttcctgcagcgcttgctttttattggcgacctgcgcatggatgcggttgtcgcctaccgggcgcacagaattgagcttcgcgacgaccgaatgctcccgtacgttaaatggagtgccgcagacacctcaaaagcgtcattcctgcactttgccacgggagtgtcaggcgttttgtaccccgtgaccttcattgattatgtggtctcccagggcgatgtattccttgagaactgcaagcgcgccgatgacgtatggctgcatgcctgcgcactgcgctctgatcaccctattcgccaggtctacgctcagccccgacacttcgctgtcgtgcccaccacccaagtgggagcactagttgttggcaacaccctcatgggtggaaatgatgagcagatcgccaaagtgtacaccgatgaagatgtggcaaaactagttgcagccagcaagaatgaagactaaaacagcttcgcgatagcacg

SEQ ID NO: 1730 - protein, 288 aa, Corynebacterium glutamicum
MWVGYAVRQIASVFLTLLRMLPLAARNRVARGRIPETGDVVISLTTHGKRINYVHFTIESIARGHVKAPIVLWLDKPDFDAPWPATIKRLVARGLQVRCSDGFYGPHTKYWNQFREIHGTGVRVATVDDDMIYPEWFLQRLLFIGDLRMDAVVAYRAHRIELRDDRMLPYVKWSAADTSKASFLHFATGVSGVLYPVTFIDYVVSQGDVFLENCKRADDVWLHACALRSDHPIRQVYAQPRHFAVVPTTQVGALVVGNTLMGGNDEQIAKVYTDEDVAKLVAASKNED

SEQ ID NO: 1731 - DNA, 456 bp, Corynebacterium glutamicum
  CDS (101)..(433): RXA00394
acccacttgaacctctccttaaatatttgcttcaacctcccacaatacggaactttgaggcattcttgggtatcggtatgtattgagtagggttgaatatgtgagtgagtccaatacccccaatctccagacacaccaagcgccggaattaaacccggaactacaaaaagctgcccggaaaaacgtgctgatttacggtctggcacgtttgcttctgttcgtcgtgctgaccttgattattcatagcctggctctgctgattagtgcgcctgtgccactcgttatgtctgcgatgctggctctgattgtggcgttcccattgtccatgctggtgttcagcaaactgcgcatgaatgccacccaggctgtttcccagtgggatgcacagcgcaaggcccacaaggaatgggttcgaagcgagctggcggaccgctaaaaaattcccctcgttctttg

SEQ ID NO: 1732 - protein, 111 aa, Corynebacterium glutamicum
VSESNTPNLQTHQAPELNPELQKAARKNVLIYGLARLLLFVVLTLIIHSLALLISAPVPLVMSAMLALIVAFPLSMLVFSKLRMNATQAVSQWDAQRKAHKEWVRSELADR

SEQ ID NO: 1733 - DNA, 423 bp, Corynebacterium glutamicum
  CDS (101)..(400): RXA00395
actcacatattcaaccctactcaatacataccgatacccaagaatgcctcaaagttccgtattgtgggaggttgaagcaaatatttaaggagaggttcaagtgggtaggcttttgctgattattttggttatcgtcgcaatcgtcttgctgtggaaggccttcaagccatctacatggaagcgtaacgcggagatcaatcagggccaggcacctcgtgcagtgaaaggccccgacgatgatgaagaattcttgtggaatattgaaaagaatcgcttcaaacagcgtcgcgccgacgaggctgcccaattagaagaggaagaacgtctcaaacgggccagggaacgctacgcaaagcctgaaagctcagaagaaggtccagagaagcccactgaggattcttaaaagggcttctttaaaaagat

SEQ ID NO: 1734 - protein, 100 aa, Corynebacterium glutamicum
VGRLLLIILVIVAIVLLWKAFKPSTWKRNAEINQGQAPRAVKGPDDDEEFLWNIEKNRFKQRRADEAAQLEEEERLKRARERYAKPESSEEGPEKPTEDS

SEQ ID NO: 1735 - DNA, 594 bp, Corynebacterium glutamicum
  CDS (101)..(571): RXA00396
atcccttggcgctacaacggtgtagccattggtaccgaggatctgtggtacatcggcgcagacaagacctacattttgagccagcgctaaggagaacccagtgacagaaattgcagaaaaccttcagcgcttgggtattgaattacctgatctaccagcaccgcagtattcctacgtaccgttcaaccgccaaggaaacaccctctatgtatcggggcagatttcacgaaccgcagcgggagacatcctcgccggacgagttggcgaagacgcaacattagaagaaggaatccacgccgcagaggtagccaccatcaatctgctggccagaatccaccaatccatcggtttagacaatgtggcccaaattctgaaactgaatgtgtgggtcaatagctccgatgactttattcagcagcctcaagtggccgacggtgcatcccagctccttgaggcagtgttgggtgaggccggaaaacatgcacgcacagcactacccacaaatactctcccccagggagcactagtggaattggatgctgtcgttgcggtcaccgaggccgccgaagtttaggacgcgtgggcgaaaatttc

SEQ ID NO: 1736 - protein, 157 aa, Corynebacterium glutamicum
VTEIAENLQRLGIELPDLPAPQYSYVPFNRQGNTLYVSGQISRTAAGDILAGRVGEDATLEEGIHAAEVATINLLARIHQSIGLDNVAQILKLNVWVNSSDDFIQQPQVADGASQLLEAVLGEAGKHARTALPTNTLPQGALVELDAVVAVTEAAEV

SEQ ID NO: 1737 - DNA, 563 bp, Corynebacterium glutamicum
  CDS (1)..(540): RXA00397
aacctgcactcctccaacagaatgctcttccctggacctcctgtggatttcccgatcaacgcagaaacccgatgcattcagctcgacgccggtgttgcagtaaagaaggacggcgtggtgctgggtacctcagatatggcgaggtccctgcctcgaaccgccgctggccaagaagcctatgagtacttcttcaaggtggttcgtgaaggcatcatcgggcagctgcgcccgggcgtgatctgcgctgacgtgcacgaagcaacccttgattacctaagcccgcagctacctcgcatgattgacatcggaatgctgggtgccgacaccgatttcaacaccatctaccgcaagcgcaatgttggccacctcatgggcaagcaggaatcctttgccaatgagcttcgccctggatacaagcacattcttcaccacggctcctatggtgccgcggagatcccttggcgctacaacggtgtagccattggtaccgaggatctgtggtacatcggcgcagacaagacctacattttgagccagcgctaaggagaacccagtgacagaaa

SEQ ID NO: 1738 - protein, 180 aa, Corynebacterium glutamicum
NLHSSNRMLFPGPPVDFPINAETRCIQLDAGVAVKKDGVVLGTSDMARSLPRTAAGQEAYEYFFKVVREGIIGQLRPGVICADVHEATLDYLSPQLPRMIDIGMLGADTDFNTIYRKRNVGHLMGKQESFANELRPGYKHILHHGSYGAAEIPWRYNGVAIGTEDLWYIGADKTYILSQR

SEQ ID NO: 1739 - DNA, 704 bp, Corynebacterium glutamicum
  CDS (1)..(681): RXA00398
tacctccccgagcctttcaccgtggaggattacactgcgcgtgttgaaggcctcgaagttgctggcggagcgattgtttccggttctttccaggctttcgaccagggctacctcaaagatgctctcgcagtgcttggcccaggctatgtcggtgtcactcagatccccgcagatacctctgatcaggagattcttgatctggacaaagctggcgtgaaggctgtgcgtttaaacttgaagcgcggtggttcggcaggtcttgacgatctcgagaccttggcacgccgagtccacgacctagccggttggcacaccgaactctatgtggatgctcgcgaactagacgagttggaatcaaccttggcctccctccctgctgtcagcattgatcacttagggctccaccgcgatggacttcccgcacttcttcgcttggtagaaaatggcattaaagtcaaagcaaccggattcggacgggtagaactagatccaactgaagtcatccaggcaatcatggctgtcgatcccactgctttgatgatcggaactgatcttccatccacccgcactaagcgacctttcgaagacgctgacctagatttgatcgctgaaacggttggcgaagatcatgtcgacaacgtcttctggaacaacgctgcagcgttctacctcggagaccagtagttttaagacccgaaatgtct

SEQ ID NO: 1740 - protein, 227 aa, Corynebacterium glutamicum
YLPEPFTVEDYTARVEGLEVAGGAIVSGSFQAFDQGYLKDALAVLGPGYVGVTQIPADTSDQEILDLDKAGVKAVRLNLKRGGSAGLDDLETLARRVHDLAGWHTELYVDARELDELESTLASLPAVSIDHLGLHRDGLPALLRLVENGIKVKATGFGRVELDPTEVIQAIMAVDPTALMIGTDLPSTRTKRPFEDADLDLIAETVGEDHVDNVFWNNAAAFYLGDQ

SEQ ID NO: 1741 - DNA, 570 bp, Corynebacterium glutamicum
  CDS (101)..(547): RXA00408
gggggagtttctcagccgtggctcacgagattttcgataatttggcaaagtggacattatgacaaatacgcacaggcgaaccccagaaccacatgagggcatgaatccagtgtcaccaaaactgaccacggccaggtacctcacccgcattccatggctgctgatcagcgcgattgtgtttggggtgcttggagtttttgtgtcttcgtggttttacgccggtgtgatcgtagttgccgtcattcttatctggcagctgtggctgatcccgcagcaggtcaagcgactgggatggctggaaacctccgatgagctgctgatcaccaagggaaaactgtggcacaccttcacggttgttccctatggccgcatccagtttgttgatgtcaccgcaggtcccctcgagcgcgcgtttggcatgaaacaagtgcaattgcataccgcgtcggcgtcctctgactccaccattcaaggcctgcctgtcgcggaagccgatgccttacgtgagcgactggctattaaggcccgggagaggatgagcggactatgagcagccttgaagggtttcga

SEQ ID NO: 1742 - protein, 149 aa, Corynebacterium glutamicum
MNPVSPKLTTARYLTRIPWLLISAIVFGVLGVFVSSWFYAGVIVVAVILIWQLWLIPQQVKRLGWLETSDELLITKGKLWHTFTVVPYGRIQFVDVTAGPLERAFGMKQVQLHTASASSDSTIQGLPVAEADALRERLAIKARERMSGL

SEQ ID NO: 1743 - DNA, 1536 bp, Corynebacterium glutamicum
  CDS (101)..(1513): RXA00409
cggcgtcctctgactccaccattcaaggcctgcctgtcgcggaagccgatgccttacgtgagcgactggctattaaggcccgggagaggatgagcggactatgagcagccttgaagggtttcgaaaagtccaccgcgccaccccattccttcgcatctggaccatcatcgtcgcagttctcgcggcattcgcattcaattccggcgcatccgttttaagtttcatctggggtgtcgtcaccggcgaatacggattcgcagtgctgccgattctattgaccgtcggtggcgccgtcattgtggtggcactggcctggattatcaccggaatttggtggaaagccgtcggattccgcatcaccaatgaagaggtgcagctgcaacgcggagtgatcagcaaagacctccgcaccgcccgatttgaccgtatccaagccgttgacctggtggaatcattcatcgcccgtatcttccgactggcagaagtccgcatcgaaaccgccggcggcagcgactccgccatcagcattggctttttaagaaaaagcgaggccgaggccctaaaaagggagcttctcgacgcctcccagcactcagtcgccaccaccccagccggagttccggctgagcctggggtaggggagaccgttgtagttgagagcgcgggcgatgttctggttccacaaatccccgtgcaacgcaccctcgccagcaccgccttatcactagcaaccatcatcaccgcgatcggtattgtgattttgctcttcgttcctttcggagtgagcattgccgtgccgttctttgtaggcatggtgccagcggtctggaacttgatcgataagtcgtggcaattcaccgcaacacagcgcaacgatgtcctgcatgtcagctatggacttgccaaccgccgcaaacaatcaatcccactgggacgcatccacgcagtgaaactaaaacagccattgctgtggcgactggttggctggtggaccgtgaccgtgcctgtagttggctacggcgacaccacccaaggcggaacctccaaaatcttgcccgtgggttccaaagaactcgcactaaaagtccttgaagcggtggggccactaaacagcgccgacatcgccgaatctgcagacccatcacatatgagcagaccccagtacacaccaccagttgctgcacgcctgctcacaccagtcgatcggacccgccaaggcgtcacgttgattggtgtggctggtgcccctggtgcggtggtcgtgcatgaaggcagattcatgccacgtatgtctgtgattgatacctcccacatccaagaactcacccttaaacacgggccgatccaaagaatactgggactctccaccgttgtgtttaacctggtccaagggccagtgggaatggccgcatcggatctcagtgcagctgatggaaaagaacttctcaacattctccgcaacagaaaactacccgcactggaatcagctccgctgggacaaaacagcctggactaaggtgtaatcatgcacatctc

SEQ ID NO: 1744 - protein, 471 aa, Corynebacterium glutamicum
MSSLEGFRKVHRATPFLRIWTIIVAVLAAFAFNSGASVLSFIWGVVTGEYGFAVLPILLTVGGAVIVVALAWIITGIWWKAVGFRITNEEVQLQRGVISKDLRTARFDRIQAVDLVESFIARIFRLAEVRIETAGGSDSAISIGFLRKSEAEALKRELLDASQHSVATTPAGVPAEPGVGETVVVESAGDVLVPQIPVQRTLASTALSLATIITAIGIVILLFVPFGVSIAVPFFVGMVPAVWNLIDKSWQFTATQRNDVLHVSYGLANRRKQSIPLGRIHAVKLKQPLLWRLVGWWTVTVPVVGYGDTTQGGTSKILPVGSKELALKVLEAVGPLNSADIAESADPSHMSRPQYTPPVAARLLTPVDRTRQGVTLIGVAGAPGAVVVHEGRFMPRMSVIDTSHIQELTLKHGPIQRILGLSTVVFNLVQGPVGMAASDLSAADGKELLNILRNRKLPALESAPLGQNSLD

SEQ ID NO: 1745 - DNA, 798 bp, Corynebacterium glutamicum
  CDS (101)..(775): RXA00411
catttggcaaaatgactgttcgactcaccggcaacaccgctgcgattgaagagttctatcaaaccttgaccaagaccacgaccatcaaggagatcacccgatgaacgagatgatcctcgcagctgactggaaccggctaggacccaccttccaaacagccatcattgacaccctgttgatggtcatcatcaccatggtggtggctggcttactgggtcttgtcgtcggcctgctgctttacaccacccgcgctggtggaatcttgaagaacaaggtcatctacaccattttgaatgtgctggtgaactttgttcgacccatcccattcattattttgatcgccgccatcaagccactaacggtcgccgtcatgggcacctccatcggccgagatgccggcatcttcgtcatggttgtcgcagcgattttctctgtggctcgaatcgtggagcaaaacttggtctccattgatcctggtgtcatcgaggcagctcgctccatgggtgcgtccccgatgcgcatcatcgccaccgtgatcattccagaagcacttggaccattggttctgggttacaccttcctgttcatcgcgatcgtcgatatgtccgcaatggtcggctacatcggtggcggtggtcttggtgacttcgccattgtttacggctaccgcgccttcgacaacgaagttatgtacgttgccgtcctggttatcgtcatcatcgtgcaggcagcccagcttctgggcaattggctgtccaagaagatcatgcgccgctaaacctcttgcatagaaaaacc

SEQ ID NO: 1746 - protein, 225 aa, Corynebacterium glutamicum
MNEMILAADWNRLGPTFQTAIIDTLLMVIITMVVAGLLGLVVGLLLYTTRAGGILKNKVIYTILNVLVNFVRPIPFIILIAAIKPLTVAVMGTSIGRDAGIFVMVVAAIFSVARIVEQNLVSIDPGVIEAARSMGASPMRIIATVIIPEALGPLVLGYTFLFIAIVDMSAMVGYIGGGGLGDFAIVYGYRAFDNEVMYVAVLVIVIIVQAAQLLGNWLSKKIMRR

SEQ ID NO: 1747 - DNA, 576 bp, Corynebacterium glutamicum
  CDS (101)..(553): RXA00423
agttctttgaaaaacgtggcgcttccaggccattcacctgcactggcatggtgtacgccgcttttatttacgcaatctgtgagctggaggcccgcacaaaatgacctatcccgtgttgagtgttttggataattctggcgatcacaacatcatctggcatgtgcaaacttatcccgcggcgctgcccaccggggcgtggattgccgatgagcaacaactgactgacctgctgaaagacacagtagtgttccttacccctgggagcaccgctccggaaaatgcccccgtggcgacgatagaaggggtgcgggttgacgtcgataagcaggtggcagagtacaacaaacatgggatccgcctgcccagcttgggcgcgcgcactgtggaggcgcagtaccgcggcgagccggaggcagaggctgcgtggcgcacggcgatggagctcgtagagatcgcaggcggctggctagaaattgaagccaagcgccgggcgcggaaggcgctggctgaggccttcggcgcggaggtccagccactgccgcttgacaccgaataggacaaatgggtctatcctgg

SEQ ID NO: 1748 - protein, 151 aa, Corynebacterium glutamicum
MTYPVLSVLDNSGDHNIIWHVQTYPAALPTGAWIADEQQLTDLLKDTVVFLTPGSTAPENAPVATIEGVRVDVDKQVAEYNKHGIRLPSLGARTVEAQYRGEPEAEAAWRTAMELVEIAGGWLEIEAKRRARKALAEAFGAEVQPLPLDTE

SEQ ID NO: 1749 - DNA, 594 bp, Corynebacterium glutamicum
  CDS (101)..(571): RXA00424
gcgatgtggacctcgggagccttggcttttttgaatctttcaaacatgcccaccaccttaatcagtgagtagtcttggcaacatggataccaggatgagattgcaggtagcagcaggttccgcgctgattggtgctggggttgcggttaatgattacgtacaaagcccagtccgccgggccatcagttatggtgcgttggcgctttctggggcgacggtgattgcgatgggtcaggacccgactggggagcggtccatcattgcgaaagattccgcgacgatggttgatcaaatccgccaggagatcggcgatttgggtgtcacgcctggtccagaatctgatgtggatgccatcacggagcgaggtccgctggtgacgtggctgttgcttgctgtttttgtcgtggcatttttcaccttggcgtatttctccatgcgcatggatgtggcggtgatgagaaggatcgctaagttctttgaaaaacgtggcgcttccaggccattcacctgcactggcatggtgtacgccgcttttatttacgcaatctgtgagctggaggcccgcacaaaatgacctatcccgtgttgagtgtt

SEQ ID NO: 1750 - protein, 157 aa, Corynebacterium glutamicum
LQVAAGSALIGAGVAVNDYVQSPVRRAISYGALALSGATVIAMGQDPTGERSIIAKDSATMVDQIRQEIGDLGVTPGPESDVDAITERGPLVTWLLLAVFVVAFFTLAYFSMRMDVAVMRRIAKFFEKRGASRPFTCTGMVYAAFIYAICELEARTK

SEQ ID NO: 1751 - DNA, 348 bp, Corynebacterium glutamicum
  CDS (101)..(325): RXA00425
accgcaaccccagcaccaatcagcgcggaacctgctgctacctgcaatctcatcctggtatccatgttgccaagactactcactgattaaggtggtgggcatgtttgaaagattcaaaaaagccaaggctcccgaggtccacatcgcggcggaacgcaccaaccttccgcttaacgatttcatgacccgcctcttcgcccaggaactccccctgctcgatagcacctcacgttcagaggtctaccgcctgcttcgggaatacgacggcccaacaattagctcccaggaagaaatccccgcagagattcgtgaactcatggatctttaggcaataaatgtgagattgga

SEQ ID NO: 1752 - protein, 75 aa, Corynebacterium glutamicum
MFERFKKAKAPEVHIAAERTNLPLNDFMTRLFAQELPLLDSTSRSEVYRLLREYDGPTISSQEEIPAEIRELMDL

SEQ ID NO: 1753 - DNA, 756 bp, Corynebacterium glutamicum
  CDS (101)..(733): RXA00428
agcgtcgcagggatcggcgcgatcttcctccttccgatcggcatcatcatgtgcctcatcgccggattcaaccgctactacgcagcccttaaggtctaaaatgcccggtctagttctctccacaaacgtcgcccatatccaacaagacccaggtggcgatgaccgcatcagcggcatcaacaaactccccgtcgccaccggcatcgatgtattcatccccggacccaactacggcgacggctccggcgtagtcggcgacgccatcggcgattccctccaccacggcggcgcccacaaagccatctacgcctacagccgcgaagaactcgacttctttgaccccacctaccgcaacggatacttcggcgaaaacctcaccaccagcggaatcgtgttggaagacctcctgatcaaccaacaagtgcgcatcggcaccacgctgctcgaagtctccattccccgccgaccctgccgcacgttcgcccactggctcgacatcaaaggctggctaaaaaccttcacccaacgcggcctccccggcagctacttccgagtcatcgaagaaggccacatcaaccccggcgaccccattgaagttctgcaggcccccgaccacgacatcaccatgtccatggccttccgtgcaaaaatgggaaacaaagacctcgcgcgccgggttgttgcagccaactgtctcccagcgcgctaccacgaggaactactaaaactgatctagggcctattgaatttctcgtc

SEQ ID NO: 1754 - protein, 211 aa, Corynebacterium glutamicum
MPGLVLSTNVAHIQQDPGGDDRISGINKLPVATGIDVFIPGPNYGDGSGVVGDAIGDSLHHGGAHKAIYAYSREELDFFDPTYRNGYFGENLTTSGIVLEDLLINQQVRIGTTLLEVSIPRRPCRTFAHWLDIKGWLKTFTQRGLPGSYFRVIEEGHINPGDPIEVLQAPDHDITMSMAFRAKMGNKDLARRVVAANCLPARYHEELLKLI

SEQ ID NO: 1755 - DNA, 525 bp, Corynebacterium glutamicum
  CDS (101)..(502): RXA00429
cgatggtggtcgccttcgtgatcgcccaaggcacccggaacggtcatcaacttcatcgtccaaagaaccatcattttccgagtgaagtaaggtacccctcatgaagaccttcaatcccaccatgattgccggactcatcggcgtactctacttcgtgctgctcaccctgattttctccatccaagacatggaactagcagcagaaatcgccttcggaatcgtcaccatcgtcggcctgatcgcggtgtgggacaacttccgcgaccgcaacaactccacctggaaaacctggaccggcctcgtcggcggactgctaatcgccgtccccggaatctgccttcttgtgggaaacctcgtgctcctcgcagtcgacggcaacccctcaaccatggtgaacaccctgctcagcgtcgcagggatcggcgcgatcttcctccttccgatcggcatcatcatgtgcctcatcgccggattcaaccgctactacgcagcccttaaggtctaaaatgcccggtctagttctct

SEQ ID NO: 1756 - protein, 134 aa, Corynebacterium glutamicum
MKTFNPTMIAGLIGVLYFVLLTLIFSIQDMELAAEIAFGIVTIVGLIAVWDNFRDRNNSTWKTWTGLVGGLLIAVPGICLLVGNLVLLAVDGNPSTMVNTLLSVAGIGAIFLLPIGIIMCLIAGFNRYYAALKV

SEQ ID NO: 1757 - DNA, 534 bp, Corynebacterium glutamicum
  CDS (101)..(511): RXA00430
tgcccccgtggatcgcctggacatttatagggagctgctgtgtttctaggtattgtgtaacctcgtgtccgaaaatcttgatgttacgatcgtccgaccaatgagcctgaaaacccaagctttccggttcatcctcaccggtggcctctcagccatcgtggacctcggcctgctgtcacttttgcagctagtgttcggccttcccgtacctgttgcccgcacgatctccttcatcgccggcaccaccaccgcctacatgatcaaccgccggtggaccttccaagcagaaagctccacctccaggttccttgctgtggtggccctctacggcgtgaccttcctgatcaacattggactgcaaaccctctgctccgcattgtttgagaattggggctggaacgaagccgtcgcgatggtggtcgccttcgtgatcgcccaaggcacccggaacggtcatcaacttcatcgtccaaagaaccatcattttccgagtgaagtaaggtacccctcatgaagaccttcaatcccaccatg

SEQ ID NO: 1758 - protein, 137 aa, Corynebacterium glutamicum
MSLKTQAFRFILTGGLSAIVDLGLLSLLQLVFGLPVPVARTISFIAGTTTAYMINRRWTFQAESSTSRFLAVVALYGVTFLINIGLQTLCSALFENWGWNEAVAMVVAFVIAQGTRNGHQLHRPKNHHFPSEVRYPS

SEQ ID NO: 1759 - DNA, 648 bp, Corynebacterium glutamicum
  CDS (101)..(625): RXA00433
gtctccagcgactcaaacatcaaaaattgatatttgcgacaagttgaaatcatacccgatagtctcgaacatactaaatcacctaatcagggggaattacatggatgtgttaaagatcgccatcatcgctgcagccatgattggtgtgccggttctggtggttttcctcattgtgtttgcggtgcacaagttggctaaggaagtgccgcggtctggtcgtcgtccgggtattgggttggggttgttgcttggttttgttgcggggctcatcgtgtggtttgtgtggttgagttggggtggttattacgagaatgagtttgggcagatgcaaggtccgtatcgtccgtggcaggttgttgcttgtggtgtcacgatggtcgcggtcactgtgattcttggtctgtggactaggtggactgcgtctggtccgttttattcggcgttgggtggtgcgtcggggtttagtttcgcgtgggccatggatgccattcctcaggatgaaaccggattgtcggcgtttggcttagtgatggtcattgttggtgttggtgcggggctaaatgtggtggcaactctgacgtcaatcggcgcaacgatctggaataaccggctaccctcgaatgcatgactaaaaccacgcgccaaacc

SEQ ID NO: 1760 - protein, 175 aa, Corynebacterium glutamicum
MDVLKIAIIAAAMIGVPVLVVFLIVFAVHKLAKEVPRSGRRPGIGLGLLLGFVAGLIVWFVWLSWGGYYENEFGQMQGPYRPWQVVACGVTMVAVTVILGLWTRWTASGPFYSALGGASGFSFAWAMDAIPQDETGLSAFGLVMVIVGVGAGLNVVATLTSIGATIWNNRLPSNA

SEQ ID NO: 1761 - DNA, 615 bp, Corynebacterium glutamicum
  CDS (101)..(592): RXA00451
ggatccgccgatgaggccgaggcccaggatgcatactgggcgggaaatgtctttggtagtcacctgacaagtgtggcacatacctactacggttatctctatgaacactgaagaggatggcctgagctttgcagttacggctaccttagttgaaggtaaatggcaggtacgcgagtttgaggatcacttctccaagctctctacctctattaatgcggttcgctcgctgcgtagcgaggggccggcgtttgcgctgttgtgcgttgatgatgaatattttgtgatggtgcgtcccaccccaagtagggtattccttttcctttcggatgcgccgatggctgtcgacgatgatttcgccgccgcggtgatggatgaactcgatgcggatcttccagatatcaaccctgatgatttggacgacatcgatccatggccagaaggtgatttcgatattttggcggatttggggctgtctgaggaggttctttccgtgatttgcgatgacatggatttggatccttccgaacaattgctgcgcatcgcggaagaactcggttttgataatgatctggctcgggtggtgggattcgactagtgggcgttttacctgtgcag

SEQ ID NO: 1762 - protein, 164 aa, Corynebacterium glutamicum
MNTEEDGLSFAVTATLVEGKWQVREFEDHFSKLSTSINAVRSLRSEGPAFALLCVDDEYFVMVRPTPSRVFLFLSDAPMAVDDDFAAAVMDELDADLPDINPDDLDDIDPWPEGDFDILADLGLSEEVLSVICDDMDLDPSEQLLRIAEELGFDNDLARVVGFD

SEQ ID NO: 1763 - DNA, 1203 bp, Corynebacterium glutamicum
  CDS (101)..(1180): RXA00457
aaactctcatgttggtttcatcgtggtttcatgaggcgggatttaactagagattgttagccaatcggccagacacttcctcctagaaaggtccctcctcatgaccattgctcttgaacacccagtactgcactccacggcgatcgcgttgcctgctcgttttcaggcgagctatacgacgcgtttggtggcggtgggcgtcgataagcgtccttctgatttttggttggaaacagccggcacgccgcaggcgggcgatgtggtgattgcgcgggtgacggcgattaataatcacaagcgggtggagacgccggagtcgcgcaaggccattttgtttgagggggtgttggtgatgttggcgtatgggcaccggtatgcggcggatcagtttttagcgcatgtaccggaggatttggggccatgccatttggtggcggctggtggcatcgcgggaacggtgacggcgctgcacgatcgggtggatgaacccacagagattgaaccgttgggattgctcaccaatgcgcgcggaactgtgaatgtacgggactttgcggcttttgataatcctttgaaagtggaggctcccaacaagcgtgcgcaggtgatcgcggtgctgggaacgtcgatgaactctggaaaatccaccacgcttgcctgcttggtcaatggtttggctgcggcggggcagaaggtggcggctggaaagatcacgggcactggtgctggaaatgaccgcatgatttatcacgatgctggtgctcacagcgttattgatttcaccgactttggctacccaactacgttcaagctgaatttcgcggagattcgtgcgctgagcgtcaacatgattaatgtgctggctgattctggtgcggataccgtgatcgtggaaatcgcggacggaatttatcagggcgaaacctcgcggctgttgcgcgatcaagtgttccaggaagccgtggatcatgtggtgttctccgctgttgatgccttgggcgcgaaggccggtgtgcaggaactgcaggcggcggggcttcatgtggctgcggcctccggagtgatgacggcttcgccgctggccaccgcggaagctgccgctgtgcttgaagttccagtggtgcccacttttgatctcaccaacccggagatcgtcacagcggtgctaacggatcatgcctagcttatggcgtgctcgtcgca

SEQ ID NO: 1764 - protein, 360 aa, Corynebacterium glutamicum
MTIALEHPVLHSTAIALPARFQASYTTRLVAVGVDKRPSDFWLETAGTPQAGDVVIARVTAINNHKRVETPESRKAILFEGVLVMLAYGHRYAADQFLAHVPEDLGPCHLVAAGGIAGTVTALHDRVDEPTEIEPLGLLTNARGTVNVRDFAAFDNPLKVEAPNKRAQVIAVLGTSMNSGKSTTLACLVNGLAAAGQKVAAGKITGTGAGNDRMIYHDAGAHSVIDFTDFGYPTTFKLNFAEIRALSVNMINVLADSGADTVIVEIADGIYQGETSRLLRDQVFQEAVDHVVFSAVDALGAKAGVQELQAAGLHVAAASGVMTASPLATAEAAAVLEVPVVPTFDLTNPEIVTAVLTDHA

SEQ ID NO: 1765 - DNA, 1503 bp, Corynebacterium glutamicum
  CDS (101)..(1480): RXA00462
tgaagccttgtcattttctacatgtgcatccgctttgactaccgcccttttccgcccagtccttttagaaaccagcaacacagaaagcaagtgatcatttatggaagctattgccatactatttgtcattggggcgattcttgtcgtcgcggtcattgtcctcggtattttcttcttaacttcacgcacctggatcaaggtggctgcagctgatgaagcgctcattgtctctgcgaagaagaagggggaatcgcaggtcattgtccacggcaaagctgtggtaatgcctattacccagactcaccagaagatctctctgcgttcccgtcaggtaaatatgcaggtgacggcacaaagcgatgacaatgtcacgttgaatgtcgaggctgttgcgctggtgaagatcggttccgaagctgagtttattcgtcgcgctgcccagcgcttcgcttccagtgacaaagaaattgttcggttcacacaggatcagctggaaggtgtgcttcgtggtgtcgtggcgcagcaaacagtcacgtcgctcatgcgtgagcgtaaaaaattctccgagcagatcgctgaaacagtcatccccgagctagagaagcagggtttgattcttgactccttccagattcgtggcatcaccgatgatgtgggatacatcaaatccctcggcgcaccggaaattcaggcaaagaagcaggctgcggaaattgcagaaactgaagctgctcgtgcgatcgctaaatcacgcattgctaaccaagaggcagatctggttgaacagacccaacttgatgccaacaaggctgccgctgatgctcaggtcggtgaagcccgtgcccaggctatgcaggctgaacgccttgccgatgaaaaagctcgactagaggttcttcgccaacaggctgaaaataagcagatcgagctggaagccgaagtgaacaaggtggccgacgctgaacgctaccgccgcaagcaggaagtcgaagccgatactttcgagcaaaccaggcgcgcacaggctcaggtcgaaatcgcagaagccgaagctaccgctgcaaaggttcgtgcaatggctgaagccgaagctgttcgattgaagggacaggcagaggcagacgctatcaaggcaaaggccgaggcctaccgcgaaaaccaagaagcactactcgcccagcaagccatggaaatcctgccggaactcatgagcaacttcgcctctggatacgcaaacattggatccatgacagtgctctccggtggagaaggatccgagaattccgtgggttcacgttttgccggtgaacaagcacttggactgaaatccattattgaatcagtcaagcaaaccaccggcattgatctagctgagatcatccaaggccgtgctgctggacatgcacagggctccgctcagggtgcagcgattgctgaagcgctttcacgcgatgaaactgtggaagatcgctctgaaaaataatctagctgcccagcgcatcg

SEQ ID NO: 1766 - protein, 460 aa, Corynebacterium glutamicum
MEAIAILFVIGAILVVAVIVLGIFFLTSRTWIKVAAADEALIVSAKKKGESQVIVHGKAVVMPITQTHQKISLRSRQVNMQVTAQSDDNVTLNVEAVALVKIGSEAEFIRRAAQRFASSDKEIVRFTQDQLEGVLRGVVAQQTVTSLMRERKKFSEQIAETVIPELEKQGLILDSFQIRGITDDVGYIKSLGAPEIQAKKQAAEIAETEAARAIAKSRIANQEADLVEQTQLDANKAAADAQVGEARAQAMQAERLADEKARLEVLRQQAENKQIELEAEVNKVADAERYRRKQEVEADTFEQTRRAQAQVEIAEAEATAAKVRAMAEAEAVRLKGQAEADAIKAKAEAYRENQEALLAQQAMEILPELMSNFASGYANIGSMTVLSGGEGSENSVGSRFAGEQALGLKSIIESVKQTTGIDLAEIIQGRAAGHAQGSAQGAAIAEALSRDETVEDRSEK

SEQ ID NO: 1767 - DNA, 945 bp, Corynebacterium glutamicum
  CDS (101)..(922): RXA00463
taccacgctagtcgccagcactctcggattaagcggatgtacctccgtaacttccagtgctacgagctcccctgaaccgccgactaaagttgcggcggcaatgcagacaacgactggggagacgtcgataagcaatgaaacctcgtttaacgcctcacgcgaaacctcgctgacggcgctgggtttcttggactatcttgacgaggagcaacgcgccgccttgctcggtgaaggcctggacatcagcacgctgacctgggccaaccaggttaccgcgctgcgtgtgctggaatccctcttcaatgagcatgcatacgagctggtttctgcagtgattcagcatgtagctcaagaacctggcgataatccacaccactttctgaagttctcgcctgaaccatccaccgagaattcttgggaattgaccctggatggaccaactgtcggattgaaagtcactttcgatccggacggtcagatcactttcaaggatgctcatttgggcctgagcccagctgaggtcgttagtgtcactgaggcgttagatacctcctattcggaatcgcaaatcaaaaaagctgcggaacaactggtgggaagcctcaatccaacccagcaggcagcgctccaaggatccggtttgcgaggagcacagctcactgaagagcaaaagaccctgttcttaaagatgacctccaactggatcgaccttgccaatggcgattccggctctgaacagcaagaagaaatcgctgatacgttcagtgatacctacatcatttggaatgagcagaaagatggctcagcattcttccagatgaaaggccctgagctcgacttcagctataaagagagcgtgcctgaaaacgctgaactctctgcacggggagtccccaatattcagacctcttttcagtcaccttaactggcattggtttagtttgg

SEQ ID NO: 1768 - protein, 274 aa, Corynebacterium glutamicum
MQTTTGETSISNETSFNASRETSLTALGFLDYLDEEQRAALLGEGLDISTLTWANQVTALRVLESLFNEHAYELVSAVIQHVAQEPGDNPHHFLKFSPEPSTENSWELTLDGPTVGLKVTFDPDGQITFKDAHLGLSPAEVVSVTEALDTSYSESQIKKAAEQLVGSLNPTQQAALQGSGLRGAQLTEEQKTLFLKMTSNWIDLANGDSGSEQQEEIADTFSDTYIIWNEQKDGSAFFQMKGPELDFSYKESVPENAELSARGVPNIQTSFQSP

SEQ ID NO: 1769 - DNA, 942 bp, Corynebacterium glutamicum
  CDS (101)..(919): RXA00468
ggcagaattttgctcaagttgcctaaatcaagcacccgttcgaataagtgtccaccctttggtttattcttgaactcacttaagttttgaatttttagttgtgaaagtagttgatgcacaagtggttatggggccaacccacgctatgagcggtgcagccgtggggcttgctgttgctcaaattctcccagcagaatggggtggggttaccaccgccacggaggcttttatttatgcgggtttagcggcgggtgcagcgctgctcccggaccttgattcaccgcaggccacggtgtcgcgttcttttggtccgattacccaagtgatttcgcgttttacagagaatatttgccaaactttcgtcaatgtcaccaggggcaggaaagacaaacactgcaacaacgggcaccgcacgttgacacatacggtgtggagcgctgctgccacaggcgctggtgccacagcgctaattggcgcctatggaaaacctgcggtgattggtttgctgtttttcttcctcgggctcgccattagaggtctcatgcctgaatggtcaaagaacgcagattggcttttagttactggagcttccgctgcattagcagtgggagtatggaattatgctcccgaaagttcattcggcattgtgttaggctccgccattacagttggaagcctgacccacttggctggcgatatggccactaaggccggtatcccagcatttgccccggtcattccgctgaagggcaaacgctggtggaacctcaaattgcctaagtttttaagcattcgtgccaacggtcctgccgataagttcttactgttcgtattctcggtggcggtcatcattcagattggtttggtctcatcgggaaatatgagcaccattatgatgaatctgcttagtcctgcactgtaattaatggcagttgcgtttcg

SEQ ID NO: 1770 - protein, 273 aa, Corynebacterium glutamicum
VKVVDAQVVMGPTHAMSGAAVGLAVAQILPAEWGGVTTATEAFIYAGLAAGAALLPDLDSPQATVSRSFGPITQVISRFTENICQTFVNVTRGRKDKHCNNGHRTLTHTVWSAAATGAGATALIGAYGKPAVIGLLFFFLGLAIRGLMPEWSKNADWLLVTGASAALAVGVWNYAPESSFGIVLGSAITVGSLTHLAGDMATKAGIPAFAPVIPLKGKRWWNLKLPKFLSIRANGPADKFLLFVFSVAVIIQIGLVSSGNMSTIMMNLLSPAL

SEQ ID NO: 1771 - DNA, 1299 bp, Corynebacterium glutamicum
  CDS (101)..(1276): RXA00469
tgcccctgcgacaccaaaccatcagggaagaccctgaacgccaccttttcagggctttcccccattcacttatcagcctcaacactccacaatagagtctatgagtacttttcaggagccccaccacaaccagggattcatcccttttgcccaacctggttatgaagctccaacaccacaccttgcaactggtacttttcagcaaatgtggcagacccgccccgcacgcatccctgccaagcaaggtggtcacgccaaagtagctggtgtctgtgaaggcattggtgtgcgttatcaaatcgacccggtgctcattcgtctatttttcgtggtcactggtgtcttcggcgccggtgtcgcagcctatctcattgcatggctgtgcatgccccgctactccgttccggtctcccccatcgaagctctctggaccccgggccacaccaaagaccgcaaccacggctggtggctggtcatcgcgttctttatgttctcaggtgttttatcctccggcgctggaggaatatccggcccagcagcagccattacttacctttgccttttagccatgtggtgggcgttgcataagaaacaaccacttccaccccgcggactactcaccactgaattcactgtttctgaggatgccaccatgaaaaacgaagatctctacccacgaccccaaccagatctaagcactatcacccccgttgagggctactatgcacccttcgcgcaacaaacccccgaagcgcctcattgggatccacttgcccaaaaccaatacaacacctgggatgtacaagtccctccacaaaagcctcagaaaaagcgccatgtgtggccatggattgtcggcggtgtagttggtaccggagttgtcatgagcgccctcgcaggcctgtttatttcaaatatcgatcccatctactttgaagacgaccctggaatcggcgatgtcaatctcatccccaccaacgatgaactcctcagcagctacacctctggtgtgggcgaaatgaacctagatttcagcaacctcacccaacttgatcaggaacaaaacgttcaaatcacctcaggtatcggtgaagtcatggtgaccctgcctgatgacgtgccagtaagcttgagttgctccgccggtgtgggcacagcgcgctgtgatgttggagacctcgccgcccacaatgctgatttggaaggtccgatgttgaatctggttgtaaattctggaatcggcgatgtgaaggtggagttcgctgatcagaatgactagcccgaccctatgtgagtagt

SEQ ID NO: 1772 - protein, 392 aa, Corynebacterium glutamicum
MSTFQEPHHNQGFIPFAQPGYEAPTPHLATGTFQQMWQTRPARIPAKQGGHAKVAGVCEGIGVRYQIDPVLIRLFFVVTGVFGAGVAAYLIAWLCMPRYSVPVSPIEALWTPGHTKDRNHGWWLVIAFFMFSGVLSSGAGGISGPAAAITYLCLLAMWWALHKKQPLPPRGLLTTEFTVSEDATMKNEDLYPRPQPDLSTITPVEGYYAPFAQQTPEAPHWDPLAQNQYNTWDVQVPPQKPQKKRHVWPWIVGGVVGTGVVMSALAGLFISNIDPIYFEDDPGIGDVNLIPTNDELLSSYTSGVGEMNLDFSNLTQLDQEQNVQITSGIGEVMVTLPDDVPVSLSCSAGVGTARCDVGDLAAHNADLEGPMLNLVVNSGIGDVKVEFADQND

SEQ ID NO: 1773 - DNA, 984 bp, Corynebacterium glutamicum
  CDS (101)..(961): RXA00472
gtctaaacgctcccgtgctttcgccacagcattaatcgccttgggcctagggctatcttcctgctctactacggaagataccgctatatcggagacgacagtgtctagtgttgcaacgaaaacaacctcgactctgcctgaaatgaactccgcagtatcagcagacggcgtgacgatcactatcgattctgccttcacgacagactctgtagaaatggaatccctagacagaccttctggcgacatccaacccgagatgtctagagaagacggaatctttgtcgtagtcgaaaccactataaagaacgagagtggagcagatatggacatcacctgtgcatccactggttcaactgtctatgcagaaatctccactaatcaagaggccgtataccaaccaatacgcgatttattcctcatcccaggaaacccggaatgcaaccataatctaggatccggtttcgacgcaccaatgacttgggtatttcaaatccctaaagatgccactgcggagcgatttggattcacacatagtgagctcggtgatgggaaactaacttggattgcactcaatgatttgagtaattcggagccagctactgaatcaactatgcgagacgaagcagcaatcgatccgagcacccctcagcaaactccagtacaggaaactgtgatctcacaaaacaccattgaaactcctgtagcccctgctcctgcggtacctgcttatggcgcttcttgccctgtctcgatgctccagcagccaagtcaagctgcagatggttcagctttggtctgcatttatgcaggaacccccaacccaatctgggtctacggcccagaacctctcggagtcgggactgctacaccgggtggggcatgcgaaggatacgaggccggtgggcaagatgcttctggaaatataatgatgtgctcaggcggacaatgggtctatgggccataaatctaaaatcaaagagtgca

SEQ ID NO: 1774 - protein, 287 aa, Corynebacterium glutamicum
VSSVATKTTSTLPEMNSAVSADGVTITIDSAFTTDSVEMESLDRPSGDIQPEMSREDGIFVVVETTIKNESGADMDITCASTGSTVYAEISTNQEAVYQPIRDLFLIPGNPECNHNLGSGFDAPMTWVFQIPKDATAERFGFTHSELGDGKLTWIALNDLSNSEPATESTMRDEAAIDPSTPQQTPVQETVISQNTIETPVAPAPAVPAYGASCPVSMLQQPSQAADGSALVCIYAGTPNPIWVYGPEPLGVGTATPGGACEGYEAGGQDASGNIMMCSGGQWVYGP

SEQ ID NO: 1775 - DNA, 1701 bp, Corynebacterium glutamicum
  CDS (101)..(1678): RXA00474
gtgtgcgcagcggaaaagtcctgatcagtaggcctcaggatgcagcattgcttgagcctgaacagccaacaacgttgcgggcggtcccatgacgcgggtgatggcattgtggtttccggattggcctgtgcaggcggttcatttggatgaagatgctcccgcgcacaataaacctgtggcgattgctgcgcattaccgcatccaggtgtgtggcgtggctgcgcgcaagcgtggggtgcgtcgtgggatgaaggttcggcaggcgcaggctgtgtgccctgagctggaggttgttgacgcggatgcagatcgtgatgcccggatgtttgagggcatcgtggcatcgctcggtgaggttgcctccagcgtcgaggtgcttcgtccgggtctggtcgcggtcgatgcgggagctgccgcgcgctattacggttcagaggacatcgctgctcagatgcttatcgacgccgccctgcgccaaggcatcgacgttttcgccggggttgcggatgagatcacgacggccgtcatcgcggcgagggcgaatggtgggactgtggtgaagagggaggcgtcgagaagctttttacagcagcaacccctgggcgtgctggcggccgaggaagcgctgggttgtgaggcggaggtggtgcgcgcgctggcggatctgggcatgcgcacgcttggtgagctggcggaactgccggtagaagccgtggcgacgcgtttcggcaacgctggtctgcggtgtcacaacattgcgcgtgccaggcacgatcgtaaggtcgcgccaccgatcacgcatgcagattgggaggtttcgcatgtgccggaggagcctattttgcgtgtcgacgccgcctcgtttgttgcgcgcaaccttgcctcgcgcctgcatcaactgctgagcaaaggtggcgtggtgtgccaattgctcaaggtcacagccgatttcagtactggtgatacggtgagcagaatttggcgtaccggtgaacctttaacggaacaggcaactgcggatcgggtgcgttggcagttggatgggtggttgactgcgcgcggtgtgcattccgatgatccgaatgagcacgatgggattacggcgttgtggcttattcctttggaatgtgtgccaccggatatggccagcggcggattgtgggataccgggcgcagccagcagcatgtggccagacaagtcattgagcgtgtgcaatcaagcttgggcgtggatgcggtgctgcagcctgttccggctggtggtcggggagtagaagaacgcattcattttgttccctatggtgaaaaacgtgatgctatccgcaatccagcggggtcgtggccagggaaaataccaggtccgctgcctgctcggttgggcggtgggatcaaccacccggcctcgcaagtgaccatgattgatacagaagggcagcgtatttacgtcaccgcagaggcattgctcagctcgtcgccgtatgccttgtcctgggggccggcccgctatttgatcactggctgggctgggccatggccggtggatgatcgatggtgggagaaaaacggcacaaaatatgcccgcctccaagtggtgggacgggcagtatctgaagaaaggcagctcaatgcgtggctgttgatgtggaaagacaacaagtggcggattgaggccacatattaggaaactactgcgctaaaaca

SEQ ID NO: 1776 - protein, 526 aa, Corynebacterium glutamicum
MALWFPDWPVQAVHLDEDAPAHNKPVAIAAHYRIQVCGVAARKRGVRRGMKVRQAQAVCPELEVVDADADRDARMFEGIVASLGEVASSVEVLRPGLVAVDAGAAARYYGSEDIAAQMLIDAALRQGIDVFAGVADEITTAVIAARANGGTVVKREASRSFLQQQPLGVLAAEEALGCEAEVVRALADLGMRTLGELAELPVEAVATRFGNAGLRCHNIARARHDRKVAPPITHADWEVSHVPEEPILRVDAASFVARNLASRLHQLLSKGGVVCQLLKVTADFSTGDTVSRIWRTGEPLTEQATADRVRWQLDGWLTARGVHSDDPNEHDGITALWLIPLECVPPDMASGGLWDTGRSQQHVARQVIERVQSSLGVDAVLQPVPAGGRGVEERIHFVPYGEKRDAIRNPAGSWPGKIPGPLPARLGGGINHPASQVTMIDTEGQRIYVTAEALLSSSPYALSWGPARYLITGWAGPWPVDDRWWEKNGTKYARLQVVGRAVSEERQLNAWLLMWKDNKWRIEATY

SEQ ID NO: 1777 - DNA, 783 bp, Corynebacterium glutamicum
  CDS (101)..(760): RXA00475
ggggtgtctgtaattttcacgtctcctggcgtttttaagacgaattacaacaattcgttcacgattgagcgaaattgggcgtcttgcttaggtttcgggggtgacccagggttacggtgtgtgcatgattgtgcagccaacttctcattcaaagcatcgtgcccgcctgaagactctagcgattgtcggcgctagcgcgttgactcttgcgggttgtggaacctccaattccaccaccaacgatgcttcttctgtaacccaaactatgtccgcaactgcggatggcgcacagttgtccaacgaagcttccaccggcccaaccgcattgggcgaagccgatgtagcaatgaagactctccgacctgatgcgcctgcacagctcatggtcaccgatgttcggattggctctcacagtggctttgaccgcgtggtatttgatctcactggcaccggaactcctggttggttcattgattacacctccaatcccacccagcagggcagcggaaacaccatcaacttcacgggcgatacagcgctgaacgtaaatattgacggtactgtttatcctttcgatttgggccttgaggatccagagatcggcaccgtggatggctccggcagcattgtcacccaggtcgtcagcgcaggtacttttgagggacgctcccagttcgtcatcggcctcaacggcaagcaccgctactcggtcactgagttgcaggatccgcaccgtctcgttgtggatgttttagcgcagtagtttcctaatatgtggcctca

SEQ ID NO: 1778 - protein, 220 aa, Corynebacterium glutamicum
VTQGYGVCMIVQPTSHSKHRARLKTLAIVGASALTLAGCGTSNSTTNDASSVTQTMSATADGAQLSNEASTGPTALGEADVAMKTLRPDAPAQLMVTDVRIGSHSGFDRVVFDLTGTGTPGWFIDYTSNPTQQGSGNTINFTGDTALNVNIDGTVYPFDLGLEDPEIGTVDGSGSIVTQVVSAGTFEGRSQFVIGLNGKHRYSVTELQDPHRLVVDVLAQ

SEQ ID NO: 1779 - DNA, 984 bp, Corynebacterium glutamicum
  CDS (101)..(961): RXA00476
gtgaacgaattgttgtaattcgtcttaaaaacgccaggagacgtgaaaattacagacaccccagacatcagatggaggcggcgatactagggtagaggacatgactcttcgctgttctgacgtcaatgttgaacccctgccgggaacggcaaaaacaggttctgggtttgttctccttgaacatgctggctcgtggagccgtgatgttttagacggcggaacatttgatcctgagttgactgatcaattgaagaggcacctgaaagcttccggaatgggtctgcaattaattaggaagccgggaagggagggtcgaaacgtcgaaaagcataatctttttctcgtttttgctgaggcctcaattattgagcacctggtggtggacgcgccggctgatgttttggatcttgatttaagcgggccgggcaaaaacaatgcgcagcgcatggatgatccgatgctgctgatttgtacgcattcgaagcgcgatgtgtgctgcgcgatcaaggggcgtccgctggcagctgccgtggagccacaatttgggccgctgcatgtgtgggaggcttcgcacaccaagggccaccgttttgcgccatcgatgctgctcatgccgtggaattactcttatggcctacttgatgaggccgaaaccgtgcagcttttccaaggcgcgttggacaacaaactcttcctgccgggcaaccgtggccgaggaaccttagatgctcgtggccaggttgcagaaattgccgtggcggaagctttcggcgaggcggttgctcctgcgagtttgcaggttgaattcgaagatgattctgttttggttactcatcccgatgggcgcacgtgggttgtggagcttgaacgcatcgaggtcgacggcgtggtgtcctcgtgtggtgatcagccgaaaactggaaaagcgtgggtggctaggcaagttacagaactgatcggataaaagcagagttatatctgatg

SEQ ID NO: 1780 - protein, 287 aa, Corynebacterium glutamicum
MTLRCSDVNVEPLPGTAKTGSGFVLLEHAGSWSRDVLDGGTFDPELTDQLKRHLKASGMGLQLIRKPGREGRNVEKHNLFLVFAEASIIEHLVVDAPADVLDLDLSGPGKNNAQRMDDPMLLICTHSKRDVCCAIKGRPLAAAVEPQFGPLHVWEASHTKGHRFAPSMLLMPWNYSYGLLDEAETVQLFQGALDNKLFLPGNRGRGTLDARGQVAEIAVAEAFGEAVAPASLQVEFEDDSVLVTHPDGRTWVVELERIEVDGVVSSCGDQPKTGKAWVARQVTELIG

SEQ ID NO: 1781 - DNA, 708 bp, Corynebacterium glutamicum
  CDS (101)..(685): RXA00481
gtccataaaaataatgtgcctacaagaaatttatagtatcccatgagttaatatttttaaaaataaactttatctgactttgtagaaaaaggtgattactatgctgaatatgcaggaaccagataaaatccatccggcagaacctacacttcgtaatatttatgacgttaaaactagtgatcccaaaagtgaattagttgatcgttctggcatgtcggaagaagacattgcgcaaattgggcggctaatgaaatcgttggccagtcttcgcgatgtggaacgtagtattggtgaagcctcggcacgttatatggagctaagtgcccctgatatgcgagctttgcactatttgattgtggcgggcaatgcgggcgaagtggtgactccaggaatgcttggagctcaccttaagctttccccggcatctgtaacaaagacgcttaataggctagaaaaaggtgggcatattgttcgtaatgtgcaccccgtcgaccgcagggctttcgccctcatggtcactgatgccactcgtggagaggcgatgcggacgcttggtaagcatcaggcgcgtcgttttgatgctgctaaacgattaactccacaagagcgtgaagtggttatccgattccttcaggatatggcacaggagttatcccttaataatgcaccatggctcaacacggagtagatgaccatctacgttaatta

SEQ ID NO: 1782 - protein, 195 aa, Corynebacterium glutamicum
MLNMQEPDKIHPAEPTLRNIYDVKTSDPKSELVDRSGMSEEDIAQIGRLMKSLASLRDVERSIGEASARYMELSAPDMRALHYLIVAGNAGEVVTPGMLGAHLKLSPASVTKTLNRLEKGGHIVRNVHPVDRRAFALMVTDATRGEAMRTLGKHQARRFDAAKRLTPQEREVVIRFLQDMAQELSLNNAPWLNTE

SEQ ID NO: 1783 - DNA, 725 bp, Corynebacterium glutamicum
  CDS (1)..(702): RXA00486
catgcgatcatggcagcagtcgaccatgcccgcgcagccgttctagattcgctgtctgaagtgtccggaacgttgaaagtcacctccttccaatccctgctgttcacccttgccccgaaagccatcgcgcgcctgaccgagaaatacccacacctgcaagtagaaatctcccaactagaagtcaccgcagcgctcgaagaactccgcgcccgccgcgtcgacgtcgcactcggcgaggaataccccgtggaagtcccccttgttgaggccagcattcaccgcgaagtcctcttcgaagaccccatgctgctcgtcaccccagcaagcggcccatactctggcctcaccctgccagaactccgcgacatccccatcgccatcgatccacccgaccttcccgcgggcgaatgggtccataggctctgccggcgcgccgggtttgagccccgcgtgacctttgaaaccagcgatcccatgctccaagcacacctcgtgcgtagcggcttggccgtgacattttcccccacactgctcaccccgatgctggaaagcgtgcacatccagccgctgcccggcaaccccacgcgcacgctctacaccgcggtcagggaagggcgccaggggcatccagccattaaagcttttcgacgagccctcgcccatgtggccaaagaatcttatttggaggctcgtctagtagagtgagttcttgtgagccttcagac

SEQ ID NO: 1784 - protein, 234 aa, Corynebacterium glutamicum
HAIMAAVDHARAAVLDSLSEVSGTLKVTSFQSLLFTLAPKAIARLTEKYPHLQVEISQLEVTAALEELRARRVDVALGEEYPVEVPLVEASIHREVLFEDPMLLVTPASGPYSGLTLPELRDIPIAIDPPDLPAGEWVHRLCRRAGFEPRVTFETSDPMLQAHLVRSGLAVTFSPTLLTPMLESVHIQPLPGNPTRTLYTAVREGRQGHPAIKAFRRALAHVAKESYLEARLVE

SEQ ID NO: 1785 - DNA, 1026 bp, Corynebacterium glutamicum
  CDS (101)..(1003): RXA00490
gattgagcacgacacctccaaaattgttcagtattacttaactatagttggctgtttttcgatctagtccttaaaggtttctttggcaataatcaagggcatgaataaacagtccgctgcagtgttgatggtgatgggttccgccctatccctgcaatttggtgctgccattggaacgcagcttttccccctcaacggcccctgggctgtcacctctttaaggctgttcatcgcaggcttgatcatgtgcctggtgatccgcccgcgacttcgttcctggactaaaaaacaatggatcgccgtgctgctgttgggattatctcttggcggaatgaacagcctgttttacgcatccatcgaactcatcccgctgggtaccgccgtgaccattgagttcctcggccccctgattttctccgcggtgttagcccgcacgctgaaaaacggattgtgcgtggctttagcgtttctcggcatggcactactgggtatcgattccctcagcggcgaaacccttgacccactcggcgtcattttcgcagccgtcgcaggaatcttctgggtgtgctacatcctggcatcaaagaaaatcggccaactcatccccggaacaagcggcctggccgtcgcactgattatcggcgcagtggcagtatttccactgggtgctacacacatgggcccgattttccagaccccaaccctactcatcctggcgcttggcacagcacttctcgggtcgcttatcccctattcgctggaattatcggcactgcgccgactccccgcccccattttcagtattctgctcagcctcgaaccggcattcgccgccgccgtcggctggatcctgcttgatcaaacccccaccgcgctcaagtgggccgcgatcatccttgtcatcgcggccagcatcggcgtcacgtgggagcctaaaaagatgcttgtcgacgcgcccctccactcaaaatgcaacgcgaagaggcgagtacacacacctagttaacgtgcaggcttaccttttgg

SEQ ID NO: 1786 - protein, 301 aa, Corynebacterium glutamicum
MNKQSAAVLMVMGSALSLQFGAAIGTQLFPLNGPWAVTSLRLFIAGLIMCLVIRPRLRSWTKKQWIAVLLLGLSLGGMNSLFYASIELIPLGTAVTIEFLGPLIFSAVLARTLKNGLCVALAFLGMALLGIDSLSGETLDPLGVIFAAVAGIFWVCYILASKKIGQLIPGTSGLAVALIIGAVAVFPLGATHMGPIFQTPTLLILALGTALLGSLIPYSLELSALRRLPAPIFSILLSLEPAFAAAVGWILLDQTPTALKWAAIILVIAASIGVTWEPKKMLVDAPLHSKCNAKRRVHTPS

SEQ ID NO: 1787 - DNA, 543 bp, Corynebacterium glutamicum
  CDS (101)..(520): RXA00491
tcctcatagtgtgtccacaattatctaaactttagtagcttgtccttaaatcggataaccgctgcagctcacacgctattccacaaccggaaatctggcagtgtattgggttttagcaacctctgccaatagggtggaagatgtgaactttgatgcgatgatgccccgcgacccgtttgccgatgatcccaatgacccggcatcgtttattaccgacgatgacccttatgatcatcccgaaccgctttctgaagaagagcgaatccacgtgagccaagaccttcgcctcgtgatggaatttaaaaaagttttaggtccccgaggaatcgaaggcgtgttcttcatgtgcgaagactgcgaagagttccactactacgactgggacatcatggcagcaaacatgcgcgccaccttggctggggaactcagccccgtgcatgaaccaagtgcgcaacccaatattgatgcctatgtgccgtgggactactgcattggttacctagacggacttgaagccaaataaaaactgctagcaactaaaga

SEQ ID NO: 1788 - protein, 140 aa, Corynebacterium glutamicum
VYWVLATSANRVEDVNFDAMMPRDPFADDPNDPASFITDDDPYDHPEPLSEEERIHVSQDLRLVMEFKKVLGPRGIEGVFFMCEDCEEFHYYDWDIMAANMRATLAGELSPVHEPSAQPNIDAYVPWDYCIGYLDGLEAK

SEQ ID NO: 1789 - DNA, 347 bp, Corynebacterium glutamicum
  CDS (1)..(324): RXA00493
ttcgaaggcgaccagaaggtcggcgttcgcgcactggctactgctttgggcaagccagcgtactggatcgcctccaacgcaggtcttgacggctctgttgttgttgcacgcactgctgctctgccaaacggcgagggcttcaacgctgcaactttggaatacggaaacctgatcaacgacggtgtcatcgacccagtcaaggtcacccattccgcagtagtgaatgcaacctctgttgcacgcatggttctgaccactgaggcttctgttgttgagaagcctgcagaagaagcagccgatgcacatgcaggacatcatcaccactaaagttctgtgaaaaacaccgt

SEQ ID NO: 1790 - protein, 108 aa, Corynebacterium glutamicum
FEGDQKVGVRALATALGKPAYWIASNAGLDGSVVVARTAALPNGEGFNAATLEYGNLINDGVIDPVKVTHSAVVNATSVARMVLTTEASVVEKPAEEAADAHAGHHHH

SEQ ID NO: 1791 - DNA, 536 bp, Corynebacterium glutamicum
  CDS (1)..(513): RXA00519
atggctggcggcggactgttcgagaccggtgctggtggatctgctcctaagcacgtccagcaggttcaggaagaaaaccacctgcgttgggattccctcggtgagttcctcgcactggctgagtccttccgccacgagctcaacaacaacggcaacaccaaggccggcgttctggctgacgctctggacaaggcaactgagaagctgctgaacgaagagaagtccccatcccgcaaggttggcgagatcgacaaccgtggctcccacttctggctgaccaagttctgggctgacgagctcgctgctcagaccgaggacgcagatctggctgctaccttcgcaccagtcgcagaagcactgaacacaggcgctgcagacatcgatgctgcactgctcgcagttcagggtggagcaactgaccttggtggctactactcccctaacgaggagaagctcaccaacatcatgcgcccagtcgcacagttcaacgagatcgttgacgcactgaagaagtaaagtctcttcacaaaaagcgc

SEQ ID NO: 1792 - protein, 171 aa, Corynebacterium glutamicum
MAGGGLFETGAGGSAPKHVQQVQEENHLRWDSLGEFLALAESFRHELNNNGNTKAGVLADALDKATEKLLNEEKSPSRKVGEIDNRGSHFWLTKFWADELAAQTEDADLAATFAPVAEALNTGAADIDAALLAVQGGATDLGGYYSPNEEKLTNIMRPVAQFNEIVDALKK

SEQ ID NO: 1793 - DNA, 1212 bp, Corynebacterium glutamicum
  CDS (101)..(1189): RXA00528
ttctgctgggaatccccacattttggaacgtagcgtcgataagcgtgcggcgaagctttttcggtcgcggccgttatctttttaagaggagaaattttagatgagcacgtccaccatcagggttgccattgccggagtcggaaactgcgcgacctccctcattcagggtgtggaatattaccgaaatgcggatccttccgaaactgtcccgggtttgatgcacgtcaaattcggtgattaccacgttggcgacattgaattcgtggccgcgttcgacgtcgacgccgaaaaagtaggcatcgatcttgccgacgccaccgaggcttcacaaaactgcactatcaaaatcgccgatgtcccacagaccggcatcaacgtgctgcgtggcccgactctcgacggcctgggcgatcattaccgcgcgaccatcgacgagtccaccgccgagccagtcgacgttgtccaggcgcttatcgacgcaaaagccgatgttttggtgtcctacctcccagtgggctccgaagaagccgacaaattctacgcacaagccgccatcgatgcaggctgcgcctttgtcaacgctctcccagtattcatcgcctccgaccctgagtgggctaagaagttcactgacgctggcatcccaattgttggcgatgacatcaaatcccagatcggtgcaaccatcacccaccgtgtcctcgcacgcctttttgaagaacgtggcgttcgcgtagatcgcaccatgcagctcaacgtcggcggcaacatggacttcaaaaacatgcttgaccgcaatcgcttggaatccaagaaggtctccaaaacccaagcagtgacctccaacattccagatggtccactgtctggaaaggtggaagaccgcaacgtccacatcggaccatccgaccacgtccaatggctcgatgaccgcaagtgggcttatgtccgcctcgaaggcaccgcattcggtggagttcccctcaaccttgagtacaaactcgaggtgtgggattcacccaactctgccggcatcatcatcgacgctgttcgcgccgccaagatcgccctcgatcgcggtatcggcggaccgatcatgccagcaagctcctacctgatgaagtccccacctgagcagcttccagacgatgttgcttgtgaacgcctagaggcattcatcatcgaggcgtaaaattaggctaaaaatttggg

SEQ ID NO: 1794 - protein, 363 aa, Corynebacterium glutamicum
MSTSTIRVAIAGVGNCATSLIQGVEYYRNADPSETVPGLMHVKFGDYHVGDIEFVAAFDVDAEKVGIDLADATEASQNCTIKIADVPQTGINVLRGPTLDGLGDHYRATIDESTAEPVDVVQALIDAKADVLVSYLPVGSEEADKFYAQAAIDAGCAFVNALPVFIASDPEWAKKFTDAGIPIVGDDIKSQIGATITHRVLARLFEERGVRVDRTMQLNVGGNMDFKNMLDRNRLESKKVSKTQAVTSNIPDGPLSGKVEDRNVHIGPSDHVQWLDDRKWAYVRLEGTAFGGVPLNLEYKLEVWDSPNSAGIIIDAVRAAKIALDRGIGGPIMPASSYLMKSPPEQLPDDVACERLEAFIIEA

SEQ ID NO: 1795 - DNA, 666 bp, Corynebacterium glutamicum
  CDS (101)..(643): RXA00529
gcaaagctttgtaccggaagcgttaaggcactggattttgtcgagcagtttcaggctgtttagcgggcgagttcttatagagatgtataaggtgaagctcatgaagttgaagtggattgcaccaattcttccggttttggcccttgcaggctgcggaaactacgtcaacgtagagtcgcaagggaaatctggaatttcccatgatgaggacggaaatataagcgttcacatgtacatctgtggtgataatgcggtggatgaactgatacttagcggtggtttttacgatggcccacctgggacaaacaacccagcccttgggatgttgaaaacttccaaccctgagtcgggttatgttgtagtcaacatcgctgatccagcaccgtgggaagttgttgagccaatcaatttgcccacggaacagggaaagtacattattgccaatccgaggttggtagataaaggttggccgattcctttcgcaaaagaaaagtatatgccgagtgtttccacatcagtaggaatgcttgaaggaatagatccaggtctagtcatgcgggatatgtataccgagtcgactcatgtgttcggtactgccgaagactttgttgaagccggtcaacagtggtgcgaggattatttctaaaacgtgaatctggcaaaaga

SEQ ID NO: 1796 - protein, 181 aa, Corynebacterium glutamicum
MKLKWIAPILPVLALAGCGNYVNVESQGKSGISHDEDGNISVHMYICGDNAVDELILSGGFYDGPPGTNNPALGMLKTSNPESGYVVVNIADPAPWEVVEPINLPTEQGKYIIANPRLVDKGWPIPFAKEKYMPSVSTSVGMLEGIDPGLVMRDMYTESTHVFGTAEDFVEAGQQWCEDYF

SEQ ID NO: 1797 - DNA, 1404 bp, Corynebacterium glutamicum
  CDS (101)..(1381): RXA00530
ggcgataagcctcctccctggggccttgcccatttcatagggtgtccaggtaatgtttcaggggttagatttcagctgaagcaactggggagttggcgctatgagcatcggattcgaccgcgacctttatattaagatgcagtcgcagcacatcaatgagcgccgcgagcagatcggcggcaagctgtatctggaaatgggcggcaagcttttcgacgacatgcacgcttcccgtgtgctgccaggtttcacgcctgacaacaagatcgctatgctcactgagcttaaagatgagctggaaatcctcgtcgcaatcaatgcgaaggatctggagcgcaagaaaacccgcgccgacctcgacatttcttatgaggaagatgttttacgcctcattgatgtgttccgtgagctgggctttttggcggagcatgtggtgctcacacagttggaggatgacaactatcaggcactcgcgttcaagcagcgcctagagcgccttggcctgaaggttgctgttcaccgcgtgattccaggttacccaactgatgctcgccgcattgttagcgaggaaggtttcggcatcaacgagtatgtggaaaccacccgcaatttggttgttgtgaccgcaccgggcccaggttctggaaagctcgctacctgcttgagccagatttatggcgatcaccagcgcggaatcaagtccggctacgcaaagtttgaaactttccccatttggaacctgcctcttgagcacccagttaacttggcttatgaggctgccacggcagatctcgatgacatcaacatcatcgatcctttccacctcgccgcctatgacaccaaagccaccagctacaaccgcgacgtggaagtcttcccgctgctgaaaaccatgctggaaatgctgtcgggctcatcgccgtacaaatcccccaccgacatgggtgtcaacatggtcggaagcgcaattatcgacgacgccgcgtgccaggaagccgcccgccaagaaattgttcggcgttacttcaaggcgcttgtcgacgagcgtcgcgaggagcaggacgataccatttcagcgcgcatcgccattgtcatgagcaaggccggttgcaccgttgaagaccgccgcgtggttgcccgagcacttgatgttgaagaatccaccggcgcgccgggttgtgccattgaacttaacgatggtcgactcgtcaccggcaagacttcagaacttctcggatgctccgcagcgatggtgcttaatgcactgaaggaactcgctggcattgatcgcagcgtggatctcctctcccctgaatccatcgagccaatccaatcgctgaagacccagcacctgggatcccgcaacccctcgcctgcacactgatgaagtgcttattgctttgt

SEQ ID NO: 1798 - protein, 427 aa, Corynebacterium glutamicum
MSIGFDRDLYIKMQSQHINERREQIGGKLYLEMGGKLFDDMHASRVLPGFTPDNKIAMLTELKDELEILVAINAKDLERKKTRADLDISYEEDVLRLIDVFRELGFLAEHVVLTQLEDDNYQALAFKQRLERLGLKVAVHRVIPGYPTDARRIVSEEGFGINEYVETTRNLVVVTAPGPGSGKLATCLSQIYGDHQRGIKSGYAKFETFPIWNLPLEHPVNLAYEAATADLDDINIIDPFHLAAYDTKATSYNRDVEVFPLLKTMLEMLSGSSPYKSPTDMGVNMVGSAIIDDAACQEAARQEIVRRYFKALVDERREEQDDTISARIAIVMSKAGCTVEDRRVVARALDVEESTGAPGCAIELNDGRLVTGKTSELLGCSAAMVLNALKELAGIDRSVDLLSPESIEPIQSLKTQHLGSRNPSPAH

SEQ ID NO: 1799 - DNA, 840 bp, Corynebacterium glutamicum
  CDS (101)..(817): RXA00535
aatcgcatggggcaccgtggtcagacaccggatcgcgctccgcaccccaaaagatggctccctaaggagctcacctttactcaatgctctgatgacaccgatgtggtgggcaggcatgagtaccgcgatgctggcatatttcttacaaacagtagcacttggtttcggcaccctcttggtagtgcaaccagtgcttgtcctgtcgctgatgttcacgctgccgctctcagcacgattcaatggctaccgactacgccgaactgaaatcttctgggctaccctcctcaccgtagccgtgggcatcatgatcgttttgggacgcccccttcccggaaacccccaccccccactcgatcgatggattccagtacttttagtcggcgttgcagtaatgggtggaatgtggctgcttgcggaatacgtattaaagaaggacaaagccctcatccttggtcttgtgacgggtgcattgtttggctacgtagcagtgatgtccaaagccgcggtggatctttttgtccatcaaggcataacgggactcatcttgaactgggaaggctacggcctaatcctcaccgcattacttggaacaatcgtgcagcagtattcctttaacgctggcgaactacaaaaatcgctacccgccatgaccattgccgaaccaattgttgccttcagtttgggctacttggttctgggcgaaaaattccaagtcgtggactgggaatggatcgccatgggcatcgcactactggtgatgattgtttccaccattgcactgtctcgtacaagcacaatgccggccggatcgaaaaggtaaaactccaaagttccccccga

SEQ ID NO: 1800 - protein, 239 aa, Corynebacterium glutamicum
MWWAGMSTAMLAYFLQTVALGFGTLLVVQPVLVLSLMFTLPLSARFNGYRLRRTEIFWATLLTVAVGIMIVLGRPLPGNPHPPLDRWIPVLLVGVAVMGGMWLLAEYVLKKDKALILGLVTGALFGYVAVMSKAAVDLFVHQGITGLILNWEGYGLILTALLGTIVQQYSFNAGELQKSLPAMTIAEPIVAFSLGYLVLGEKFQVVDWEWIAMGIALLVMIVSTIALSRTSTMPAGSKR

SEQ ID NO: 1801 - DNA, 366 bp, Corynebacterium glutamicum
  CDS (101)..(343): RXA00540
tctccctatctaagggctggctaggtttgaccagtggcaacagttacacttgtgctcgtaaaacattgtcctccccatttcttgagtaagggaaaataccgtggcccgtgtagttgtcaatgtcatgcctaaggctgagattctggatccccaggggcaggcggtacaccgcgccctcggacgtatcggagtttctggcgtttccgatgtccgtcagggaaagcgcttcgagcttgaggtagatgattccgtcaccgaagctgacctaaagaaaattgctgaaaccctcctcgcaaacaccgtcatcgaagacttcgatgtggtgggagttgaggtcgcgaagtgagcgccaaaatcggtgtcatt

SEQ ID NO: 1802 - protein, 81 aa, Corynebacterium glutamicum
VARVVVNVMPKAEILDPQGQAVHRALGRIGVSGVSDVRQGKRFELEVDDSVTEADLKKIAETLLANTVIEDFDVVGVEVAK

SEQ ID NO: 1803 - DNA, 519 bp, Corynebacterium glutamicum
  CDS (101)..(496): RXA00549
attcgtttgcagcaggatctggaaaatggttcacaggatactgcggacatggcgcatgctttgggtatcgcgaagtctttgccaactatccctgagacacttgactgaaaacggagagaccccttatgagggcatcatcttgggtcagtatgagtcccgcccacttgatatggcttctgcgatggcaactatcgctaatgaaggtgtctggcaccgcccgcacttcgtgtccaaggtggagactgtcagcggtgaggttctctacgagttcgaggatggcgacggcgagcgtcgtgtttctgaaaaggttgcactgaatctgctcaaggccatggggccaatcgctgcatactccaacggaaacgctctggctgatggccaggtttctgcatccaagactggtaccactcagcttggtgataccggtgcaaacaaggatgcgtggatgttgggtgcggcacctcagctagctactgcggtgtgggtcggaactgcttgataacactgcattgtataaca

SEQ ID NO: 1804 - protein, 132 aa, Corynebacterium glutamicum
LTENGETPYEGIILGQYESRPLDMASAMATIANEGVWHRPHFVSKVETVSGEVLYEFEDGDGERRVSEKVALNLLKAMGPIAAYSNGNALADGQVSASKTGTTQLGDTGANKDAWMLGAAPQLATAVWVGTA

SEQ ID NO: 1805 - DNA, 444 bp, Corynebacterium glutamicum
  CDS (101)..(421): RXA00550
aaggatgcgtggatgttgggtgcggcacctcagctagctactgcggtgtgggtcggaactgcttgataacactgcattgtataacacctggggtggcagtatgtatggttctaactcccctgccacgatctggaagcagaccatggataacgccctcgagaactcccctctcgaaacttgggatatcgctccagcattggggtacggtaacccaccagttccggaatatgtgtggactccaagtccaaacatcgcgactaatgatccagaaggagcaaccgaggaagctccagtggaggatccaaatgcagtaatcgatacccctgctgtagatcccactgcacctgcagaggagaccggtaacggtcaggtagaaatcctgccggggctgactatcccgggagatctcttagggatcggctaaaatccggtcgtagcctaaac

SEQ ID NO: 1806 - protein, 107 aa, Corynebacterium glutamicum
MYGSNSPATIWKQTMDNALENSPLETWDIAPALGYGNPPVPEYVWTPSPNIATNDPEGATEEAPVEDPNAVIDTPAVDPTAPAEETGNGQVEILPGLTIPGDLLGIG

SEQ ID NO: 1807 - DNA, 444 bp, Corynebacterium glutamicum
  CDS (101)..(421): RXA00553
gtcattgcaagcgcgaacgctgtgcagcaattgctgcggatttcgctgagcaaggaattgatccgctcgttacttcttaaaaagggtatggtggctgggtatgagcatcgttaagatcaacgcaatttccgtacccgaaggcgctggtgaagagcttgagaagcgcttcgcagcccgccaaaatgccgtggattccgctccgggatttgagggctttcaactgttacgccctgtttccggtgaagaccgctactttgtagtcacccagtgggctgatgaagacagctataacgcgtggcgtgatgccgaaaaggccaagggcggtcatggccagggagcccacggctcagataagaagcctgtcgcttccggcgcttccctgctggagttcgaagtagtcctaggatctaccggcgctaagtagggaaagagaaaagtcggaac

SEQ ID NO: 1808 - protein, 107 aa, Corynebacterium glutamicum
MSIVKINAISVPEGAGEELEKRFAARQNAVDSAPGFEGFQLLRPVSGEDRYFVVTQWADEDSYNAWRDAEKAKGGHGQGAHGSDKKPVASGASLLEFEVVLGSTGAK

SEQ ID NO: 1809 - DNA, 594 bp, Corynebacterium glutamicum
  CDS (101)..(571): RXA00554
atccgaaactctcctgtaccgaccatcatttatcccggtctttaggctctccaacagcagaggactagacttaagtatgcctgcaaaggaggacaacttcatgaacacccaaccagagcatccagaaaatgatctagtcgacgaagccgatttttctaaccggcccaggatctactcggacgatcctgattccttggctgatgcgccagacccagcgctggagcatgagaagaacaagaaatcttcacgccaagcactcatttatctgttgcaggttccactagttacattcgtttctgcatacgtattggcctgggtgtcacgactccagggcggtcccatctgtgacgccggtgaggctgtgtggatttgttcccgtgctgcagaactgtggtggccaattaccactagcgtcatcgcatttggtggcatgcttggatctgcatggatcctctatgacaaataccgaaattacctacgctggcgtccttggatgggcgtgttgtggattttgattccattcagcatgctgtggggaacctcggtgctcaccttgtccatcttggggcactaaaaacttcacataaatgacaa

SEQ ID NO: 1810 - protein, 157 aa, Corynebacterium glutamicum
MNTQPEHPENDLVDEADFSNRPRIYSDDPDSLADAPDPALEHEKNKKSSRQALIYLLQVPLVTFVSAYVLAWVSRLQGGPICDAGEAVWICSRAAELWWPITTSVIAFGGMLGSAWILYDKYRNYLRWRPWMGVLWILIPFSMLWGTSVLTLSILGH

SEQ ID NO: 1811 - DNA, 2762 bp, Corynebacterium glutamicum
  CDS (1)..(2739): RXA00563
ttctacaaggatctctacgcacgttccgcacgcggcacggcagcactgtggatcgtggcggctaacttgagctcctactcagacatcgacgccatcatcaactgggtcggatccgagcagaccaccaccgtcaacggcgcatccaagctggtcaagccagctttggtccctaccttgctgttcccattcgcggcacctcgcgtgtccggatccatggcagatgcaggcccacaggcagaatcccagatgcgacttctgctctggtctgttgagcgcctcatcgcaggtcttgcgccattgggctcctccatcaacgtgggtcaccgcctgcacgtggtcatcccaggttcaccaaaccgtggacgcttcggtggcgatggtgcatacggtgaatccaaggcagctctcgacgccgtggttacccgttggaacgcagagcaagctgcatggggagcacacacctccctcgtgcacgctcacatcggttgggttcgcggcaccggcctcatgggcggcaacgatcctttggtcaaggcagctgaagaagcaggcgtggaaacctactccacccaagaaattgcagagaaactgctgtcccaggcaacttccactgttcgcgagcaggcagcatccgcgccaatcaccgtcgacttcactggcggacttggtgaatctgatctgaacctggcggaaatggcacgtgcagaagcagctaaggcagctaacgcaccagtggttgaggctccacgcacagtggcagcactgccaactccttaccgaccagtggttcaaaccacccctgatttcgcaggtcaagtcacccaaaaccttgacgagatggtcgtcatcgttggcgccggcgagctcggcccactgggttctgcacgtacgcgtttcgacgccgaactcaacggttccctctccgccgcgggtgtcatcgaacttgcatggacgatgggacttatccactgggatgaagatccaaagccaggctggtacgacgactccgacgacgcagtggccgaagaagacatcttcgaccgctaccacgacgaagtcatggcacgcgttggtgtccgcaagtacaatgacatgcctgagtacggcatgatcgacaactttgcaccagagctgaccaccgtctacctcgaccaggacctcaccttcaacgtgggatcccgcgaagaggcactgacctacgtcgactccgagccagaactcacctttgcttctttcgacgaagcagcaggggagtggaaggtcactcgcaaggcaggctccgcaatccgcgtacctcgccgcatggcgatgacccgcttcgttggtggacaggttcctaaggacttcgacccagctgtgtggggcattccagctgacatggtggacaacctggacaccgtcgcgctgtggaacattgtctgtactgtcgacgccttcctgtccgctggattcaccccagcagagctgcttgcttccgttcacccagcacgcgtgtcctctacccaaggcaccggcatgggcggcatggaatccctccgtggcatctacgtcgaccgcattctggcagagccacgcgccaacgacgttctgcaggaagcactgcccaacgttgttgcagctcacgtcatgcagtcctacgtcggtggctacggacagatgatccacccagtcgcagcttgtgcaaccgcagctgtttctgtggaagaagcactggacaagatccgcatcggcaagtccgacttcgttgtcgcaggtggcttcgatgccctgtccgttgaaggcatcaccggcttcggcgacatggcagcaaccgccgactccgcagagatggaaggcaagggaattgagcaccgcttcttctcccgcgccaacgaccggcgccgcggtggattcatcgaatccgaaggtggcggaaccgtccttctggcacgcggatcactcgcagctgacctgggccttccagtactcggtgtcatcggattcgcagagtcctttgcagatggtgcccacacctccatcccagccccaggcctcggtgcccttggtgctgctcgcgatggtgtggaatctcgccttgcagtagcactgcgttccgtcggtgtctctgctgatgagatctccattatctccaagcacgacacctccaccaacgcgaatgatccaaacgagtccgacctgcacgagcgcatcgcatccgctatcggtcgtgcagacggcaacccgatgtacgtgatttcccagaagtcactcaccggacacgccaagggtggtgcagcagcattccagatgatcggtctcacccaggtcctccgatccggactggtgccagccaaccgcgcactcgactgcgttgacccagtactgtccaagcattcccacctcgtctggctgcgcaagccactagaccttcgtgcgaaggcaccaaaggcaggtcttgttacctcccttggcttcggacacgtctccgctctggttgcgattgttcacccagacgccttctatgaggcagttcgtgtggcacgtggtgctgaggcagctgacgtatggcgcgcatccgcgatcgctcgcgaagaagcaggccttcgtaccatcgtcgccggtatgcacggtggcgtactgtacgaacgcccagtcgagcgcaacctcggtgtccacggagacgcagctaaggaagttgaagctgcagtcctcctggattcccgcgcccgcctagttgacggtgtcctccgcgccgaaggctagttggttattgcgttgagccc

SEQ ID NO: 1812 - protein, 913 aa, Corynebacterium glutamicum
FYKDLYARSARGTAALWIVAANLSSYSDIDAIINWVGSEQTTTVNGASKLVKPALVPTLLFPFAAPRVSGSMADAGPQAESQMRLLLWSVERLIAGLAPLGSSINVGHRLHVVIPGSPNRGRFGGDGAYGESKAALDAVVTRWNAEQAAWGAHTSLVHAHIGWVRGTGLMGGNDPLVKAAEEAGVETYSTQEIAEKLLSQATSTVREQAASAPITVDFTGGLGESDLNLAEMARAEAAKAANAPVVEAPRTVAALPTPYRPVVQTTPDFAGQVTQNLDEMVVIVGAGELGPLGSARTRFDAELNGSLSAAGVIELAWTMGLIHWDEDPKPGWYDDSDDAVAEEDIFDRYHDEVMARVGVRKYNDMPEYGMIDNFAPELTTVYLDQDLTFNVGSREEALTYVDSEPELTFASFDEAAGEWKVTRKAGSAIRVPRRMAMTRFVGGQVPKDFDPAVWGIPADMVDNLDTVALWNIVCTVDAFLSAGFTPAELLASVHPARVSSTQGTGMGGMESLRGIYVDRILAEPRANDVLQEALPNVVAAHVMQSYVGGYGQMIHPVAACATAAVSVEEALDKIRIGKSDFVVAGGFDALSVEGITGFGDMAATADSAEMEGKGIEHRFFSRANDRRRGGFIESEGGGTVLLARGSLAADLGLPVLGVIGFAESFADGAHTSIPAPGLGALGAARDGVESRLAVALRSVGVSADEISIISKHDTSTNANDPNESDLHERIASAIGRADGNPMYVISQKSLTGHAKGGAAAFQMIGLTQVLRSGLVPANRALDCVDPVLSKHSHLVWLRKPLDLRAKAPKAGLVTSLGFGHVSALVAIVHPDAFYEAVRVARGAEAADVWRASAIAREEAGLRTIVAGMHGGVLYERPVERNLGVHGDAAKEVEAAVLLDSRARLVDGVLRAEG

SEQ ID NO: 1813 - DNA, 528 bp, Corynebacterium glutamicum
  CDS (101)..(505): RXA00564
caacgatggagtgctattcgtaacgaggtgacattcccaccggcaccttgatccagatagaaaaacggatggaaccagtattgggaaaaggatggttgcgatgaaatacaacgtcgatgtctctcgtgaaagcgaggactggctcgccaccgtcaccaatctcgaaggcgtatccacgtgggcgacaaccttcgccaaccttgatcgcaacggccgggaagccattgctctagctgaagatctccccgaaggtgcggaaagctcactgaccatctcttggtcggttcctacagattcccaccccgaactggacactgcaattcaaattgctcaacagcgtcgctatctagtgcaagcccaacaagacttagagcccaaagttcgatccgctatttccgctctcacccaagctgcgctgctaggtatgactgcaggtcgagtatccccaactcacaacccgggtagcagagctatctcattggatcaggtgtcaggagttttaaactagcgtgcgcaattcccgtgtga

SEQ ID NO: 1814 - protein, 135 aa, Corynebacterium glutamicum
MKYNVDVSRESEDWLATVTNLEGVSTWATTFANLDRNGREAIALAEDLPEGAESSLTISWSVPTDSHPELDTAIQIAQQRRYLVQAQQDLEPKVRSAISALTQAALLGMTAGRVSPTHNPGSRAISLDQVSGVLN

SEQ ID NO: 1815 - DNA, 774 bp, Corynebacterium glutamicum
  CDS (101)..(751): RXA00573
gacgccaactccatctgtgttcatggggataatccgcaagctctcgcattggtggagaaaatcgtgaccacccttgcagctcatgaggttcaggtttcccatgctcgttaggccatgtggtgagcaagcagtcatcatcgatttgcttgctgaagatgccgaagccgtccaaggcagcatcttggatgctgttcttgcactcaaccgctctttggtgggcatgcaggtccctggaatcatcgatactattcccgctgcgcaaacactgttagtgacgtttgacaccaagcagatcaccccgaatcgtttcgcagagatcgttgattcaattgcgctgaccccagccgcaaagggcgcagcagagcttaccgacaccattgagattcccgtggtctacgacggccctgatctagaaaccgtagctcaacacacaggtctgagcgtggaggaagttatcgccacgcattctggcaccgtgtggactgctgctttcggtggatttgcaccaggtttttactatctgatcccccagactcccctgtgggatattccccgcttggaatcgccacgcaccaagattcctgcaggttctgtcgcagtggccggtgaattcagcgctgtgtacccgcagcagtcccctggtggttggcaactgctgggcactactgagattcccatgtgggatgtggaccggtggcaaccatcgcttctcaagcccggtgattcagttcgatttgtgcaggtgaagaaatgagcttcaaagtaatttccact

SEQ ID NO: 1816 - protein, 217 aa, Corynebacterium glutamicum
MLVRPCGEQAVIIDLLAEDAEAVQGSILDAVLALNRSLVGMQVPGIIDTIPAAQTLLVTFDTKQITPNRFAEIVDSIALTPAAKGAAELTDTIEIPVVYDGPDLETVAQHTGLSVEEVIATHSGTVWTAAFGGFAPGFYYLIPQTPLWDIPRLESPRTKIPAGSVAVAGEFSAVYPQQSPGGWQLLGTTEIPMWDVDRWQPSLLKPGDSVRFVQVKK

SEQ ID NO: 1817 - DNA, 795 bp, Corynebacterium glutamicum
  CDS (101)..(772): RXA00576
acagtccgagcttcttagcggcggtctgtggcttcatagccctgcccgatggctggcgtacagattcttcgttcacgcccacaacggtagcattgttttcatgctgaccttaagtttcatcactggcacggagccaggaaagtggtttacccgattccgagatcggactcatcacggtggacttgagacccttgattcggacgacgccctaggcctcatgctcgctggccaggcacaactcgccttaaccaggcttccagatgcgcgtatcgacgcctccctccacgtggtcactctttatcaggaacaacccggagtcgcttttccaaaagactttttcctcagtgccgaagaaggcgcggtggaccttgcggacttagatggggagatcatcaactggtccatgcccgatagtggggaagtcgatgccgctgctgttcgcgatgctctgcaaatcgtggcagcgaacgtcggtgtggtgatcgcccccaggccacttctcaaggtgttgagcaagaaattggtggagcaccgggacatcaagggtggaactgaaacatctatcgccctggtatggaagaaagatgaggattctgaagagattcaagacttcgtcggtattgctcgcggtcgaacgcggaattccagcaggcagcaaacggtaaagctcagtgctcgtgaaaaaacactggcaaaacaagcccgcaggcagggggagaaaccaaaaactccgaagcgtccgcaggcaagaaaacgtcccggaaaacggcgataggggtcacccgcgcatgtccg

SEQ ID NO: 1818 - protein, 224 aa, Corynebacterium glutamicum
MLTLSFITGTEPGKWFTRFRDRTHHGGLETLDSDDALGLMLAGQAQLALTRLPDARIDASLHVVTLYQEQPGVAFPKDFFLSAEEGAVDLADLDGEIINWSMPDSGEVDAAAVRDALQIVAANVGVVIAPRPLLKVLSKKLVEHRDIKGGTETSIALVWKKDEDSEEIQDFVGIARGRTRNSSRQQTVKLSAREKTLAKQARRQGEKPKTPKRPQARKRPGKRR

SEQ ID NO: 1819 - DNA, 471 bp, Corynebacterium glutamicum
  CDS (101)..(448): RXA00577
ctggctccgtgccagtgatgaaacttaaggtcagcatgaaaacaatgctaccgttgtgggcgtgaacgaagaatctgtacgccagccatcgggcagggctatgaagccacagaccgccgctaagaagctcggactgtttttgcccgccacgccagaggagttccaaacaggtgcattgactcaccaagagttcaagaacctgcaggaaaacccaccggagtggctccaaaccctacgccgcgagggcccacaccctcgtccagtggtcgcccaaaaattgggcatcaccatcgcggctctgaaaaagaacgacatggacaaaccactgaccaccgccgagatcaaggcacttctggaaaaccagccagaatggttgcgcaccgcacgcacacagcttgctgaaggtcgcgaaaccgcaaagaaagaaactgaagaaactaccgaagactaaatcttcacaaagactgcgct

SEQ ID NO: 1820 - protein, 116 aa, Corynebacterium glutamicum
MKPQTAAKKLGLFLPATPEEFQTGALTHQEFKNLQENPPEWLQTLRREGPHPRPVVAQKLGITIAALKKNDMDKPLTTAEIKALLENQPEWLRTARTQLAEGRETAKKETEETTED

SEQ ID NO: 1821 - DNA, 846 bp, Corynebacterium glutamicum
  CDS (101)..(823): RXA00578
tgggcggtgcacttcttgctctgtctgatccggaggctgagtgggaggaaatccgcgttaaatcacggcctctgctgaatttgtttggggttgaattcccatgacgtacctcgtgtgggacggtgcaacactcgtagaaggcgcgctggaatcaacacccacagttgttgattcctacctagccaaagaccaccgcgtggtgcgctgggatcttcatgaacagcgcttcgccactagcgtggacgtggacccgtgggattttctccacgcagtaagggaagcaattccacgccagggctcatggtttcccaaagttgaatggcatggcgatgatcttttcgcagtcaatattcgcccggcaccaacactgcgaaaggccacatcattgtggctttccgaagacccagatccacgcacacagccaaccattaaaggcccagacctagatgtgcttgctcaccttcgcagtcgcgccaacgataacggctgcgatgatgcgctgttgatcagcgcggatgggttcattctggaagctgccaacgccaccgtggtgttttgggcggatccacagacggtcatcgtgcccaggggagatgtgctcccatcggtgacactcgccgcaaccattccgctgtgggaaaaagccggaatcacattgcgctatcaaaacattcggcacattggttttcccgcgtggtgcggtagttcgctgcatggttggacacctgtggtcagttggggcaggggattgggcaaaattgcagcagcgaaagctccatcggtgaagccctggaatgaaaaattgcgcccaaccatttttctgtgaggaaaaggttgagcgcagtc

SEQ ID NO: 1822 - protein, 241 aa, Corynebacterium glutamicum
MTYLVWDGATLVEGALESTPTVVDSYLAKDHRVVRWDLHEQRFATSVDVDPWDFLHAVREAIPRQGSWFPKVEWHGDDLFAVNIRPAPTLRKATSLWLSEDPDPRTQPTIKGPDLDVLAHLRSRANDNGCDDALLISADGFILEAANATVVFWADPQTVIVPRGDVLPSVTLAATIPLWEKAGITLRYQNIRHIGFPAWCGSSLHGWTPVVSWGRGLGKIAAAKAPSVKPWNEKLRPTIFL

SEQ ID NO: 1823 - DNA, 642 bp, Corynebacterium glutamicum
  CDS (101)..(619): RXA00582
actggccagccttccgacgcatcgacttcctccgcgccattcgcgactactcgcagcgcagcagaagattcggtaaataacttattctccaaggagagacatgtctgactacatcgtcgcatttgaatccgcatacggctctaccaagcagtacgcagaatctctggcgcaacgcctcggcgtagatgccttaaattttgaacaagcgtgtgcggaactcgcggcgaacccgaccgcagcaatcgtggttttgagctttgttcacggcccatcccatccaggtgcgaaattcattaccgataccgatctctccggccaccgcgtcgcactgtgcaccgtcggcatgacgcttgatgatgtcgtgcaaaagaaggacggcgcagctcgatcactgggaaacaaggcagacgatgtcacccgtttctaccttccgggacgccttaattactcagagctctcgaccgcgcaccgcaccaccatgtggacgatcgtcaacatgctgaaagcgaagccgttgaagaatgacaacgacaaaatgatgatcaacacttttgataccgatgttgaccgcgtcgatgagtcccgcctggacgcagtggaggagtgggcgaggggcctctagagtgggcgttgcaaaaactc

SEQ ID NO: 1824 - protein, 173 aa, Corynebacterium glutamicum
MSDYIVAFESAYGSTKQYAESLAQRLGVDALNFEQACAELAANPTAAIVVLSFVHGPSHPGAKFITDTDLSGHRVALCTVGMTLDDVVQKKDGAARSLGNKADDVTRFYLPGRLNYSELSTAHRTTMWTIVNMLKAKPLKNDNDKMMINTFDTDVDRVDESRLDAVEEWARGL

SEQ ID NO: 1825 - DNA, 441 bp, Corynebacterium glutamicum
  CDS (101)..(418): RXA00585
tgtgaagacgtcgatcccagaagatgacctgtttgccggaatcacacccgatgcagaataatgcagttagaccacatcctttaggaaggaccttttcggcgtgattgacctcagccctgtattcaatacagctgccggcgtatacaacgacaccaacgcaatcatcttggctcagcagcagcaaggtggaccacttggacctgagtttggaaaggcctcgccggttggtttgctactgatcgtcgcgatgctcgttgccattcttgttctcggctgggcgttccaccgacgctggtcacggatgaatcgtcgtcgtattttcgcagagcgcaacggccttgatcccttcgatattgagggtgttcgcaaggcaatggctgaggccggcttgaatgaaaagtccaaaaagggcttcctttaaaaagaaagtgtgttaaggtt

SEQ ID NO: 1826 - protein, 106 aa, Corynebacterium glutamicum
VIDLSPVFNTAAGVYNDTNAIILAQQQQGGPLGPEFGKASPVGLLLIVAMLVAILVLGWAFHRRWSRMNRRRIFAERNGLDPFDIEGVRKAMAEAGLNEKSKKGFL

SEQ ID NO: 1827 - DNA, 1005 bp, Corynebacterium glutamicum
  CDS (101)..(982): RXA00586
tcatccaaggggtaaataggtatgacggcggaaacgactatcatgaatgcaatacacatcaactaaaccctgcggaagcatataaagcttcaaggaaaggatgaaacacgtgagtggtctacgcctaatggcgatccacgcccaccctgacgacgagtcaagcaagggcgcagcaaccatggcgcgctatgcagctgagggcaatcaagtaatggttgttacctgcactggtggtgagcgtggagacattctcaaccctgctatggataagccaggaatcctggacaatatttttgctgtgcgtcaggaagagatggcgaaggccatggaaattcttggcactgagcacagatggctaggttatgaggactctgggctgccccaaggtgatcctttgcctcctctgcctgagggctgttttgctttagaagactcggataaagtcacccaagatttagtgaagattctgcgcgagttccgcccacacgtcatcattacctatgatgagaacggcggttacccacacccggatcacctcaaggttcatgaggtgtcgatgcttgcatgggagaagtccggcgatgcagcgtatgcacctgagttgggcgcaccgtgggagccactgaagctttattacacccacggctttatccgtcagcgcatggaaatgttccatgatctgctcattgaacagggcaagcccagcccatacaccccgatgcttgagcgttggaaggcaaatgaggctgatgtgatggctcgagttaccactcaggttccttgtgagcgcttctttgatcagcgtgatgacgccctgcgtgcgcacgcaactcagattgatcctgcgggtgctttctttggaactcccgttgaggtgcagcgtcgcctgtggccgactgaagagttcgaattagctaaaactcgtgtgaagacgtcgatcccagaagatgacctgtttgccggaatcacacccgatgcagaataatgcagttagaccacatcctt

SEQ ID NO: 1828 - protein, 294 aa, Corynebacterium glutamicum
MKHVSGLRLMAIHAHPDDESSKGAATMARYAAEGNQVMVVTCTGGERGDILNPAMDKPGILDNIFAVRQEEMAKAMEILGTEHRWLGYEDSGLPQGDPLPPLPEGCFALEDSDKVTQDLVKILREFRPHVIITYDENGGYPHPDHLKVHEVSMLAWEKSGDAAYAPELGAPWEPLKLYYTHGFIRQRMEMFHDLLIEQGKPSPYTPMLERWKANEADVMARVTTQVPCERFFDQRDDALRAHATQIDPAGAFFGTPVEVQRRLWPTEEFELAKTRVKTSIPEDDLFAGITPDAE

SEQ ID NO: 1829 - DNA, 606 bp, Corynebacterium glutamicum
  CDS (101)..(583): RXA00587
cccttggatgacctcggttaacagtttttcctgaggtgactaagatgtataggtgaccaactcgattcggctttgaagaggatgcagacagacttccatcatgagtacaaattccaactctccatccaacgcatcaggcgcttcgaacattccaaacacccaacgtccggctagccgatacaattcgcctcgcccggaagctgctgcaggcaggaacatcagcggaaaaatcatcgcagtcattggcgtgctgctggtgatcgccattgtgattgttggcgcaaacttcctcaaaaaccgcgatgcacaaacagtgtccggccaaatgggttcatttgaacgcatcgacgacgacaccttccgctttgaagttgacgtcacccgcgatgacccaagccaagtcgcctactgcatcgtgaccgcaaaggactactcgcacgcagaagtcgggcgtcgagaagtgcttgtggagcccagcgaccactcaacggtgcgtatctccacgctgatccccacccgcgaaccagcagtttccggtggtgtttacggttgttcaaccgtgatcccatcacatatgaacctgtaaaactagaaaattttgctgtg

SEQ ID NO: 1830 - protein, 161 aa, Corynebacterium glutamicum
MSTNSNSPSNASGASNIPNTQRPASRYNSPRPEAAAGRNISGKIIAVIGVLLVIAIVIVGANFLKNRDAQTVSGQMGSFERIDDDTFRFEVDVTRDDPSQVAYCIVTAKDYSHAEVGRREVLVEPSDHSTVRISTLIPTREPAVSGGVYGCSTVIPSHMNL

SEQ ID NO: 1831 - DNA, 353 bp, Corynebacterium glutamicum
  CDS (1)..(330): RXA00595
cgcaatattgcagcatggatcgcaatcgccgccatcatcatcgccagcctgggcgcactgctctcgatgatccgcgtgtggcgtgaagtcttctggggtggcgcaatgcaccagcgcggcgtctcgccgcagctgcgcatcagcccagcaaaaatcgccccagcgctcagcctgatcattttatcggtaggcatgttcatcttcgcgggcccgcttatcgacgcgaccctcaccgccaccgacggcctcttgaacaccgatgcataccaacaggctgtgctcggtgaaaatgccatcggagtgccaagccctagctaccagggaggaaactaatgcttaacgccctgaaattc

SEQ ID NO: 1832 - protein, 110 aa, Corynebacterium glutamicum
RNIAAWIAIAAIIIASLGALLSMIRVWREVFWGGAMHQRGVSPQLRISPAKIAPALSLIILSVGMFIFAGPLIDATLTATDGLLNTDAYQQAVLGENAIGVPSPSYQGGN

SEQ ID NO: 1833 - DNA, 393 bp, Corynebacterium glutamicum
  CDS (101)..(370): RXA00597
caaggagatccgccccagcgatgctgagtggccaagtcgcgagatcgctgacaccgcccaaaacaccgtcagccaagacaagagggagttttaaaacaacatgactgcttttggaattgtcaccacagttggcatctgcatgtttgcgttctccctcttatctgccctggtccttattctgcgcaccaaagatttcctcacccgcgtggtgctttccgacatggttttctactctatgatcgcgatctacctcatctgggtgctcaacaacccaacctcaatcgcctttgagattgctcttctcgcagcagtcctcggcggcgtacttccaaccctgtccatggctcgcatcatttcgaagggacgcaggtaaatgaccattccagagatcat

SEQ ID NO: 1834 - protein, 90 aa, Corynebacterium glutamicum
MTAFGIVTTVGICMFAFSLLSALVLILRTKDFLTRVVLSDMVFYSMIAIYLIWVLNNPTSIAFEIALLAAVLGGVLPTLSMARIISKGRR

SEQ ID NO: 1835 - DNA, 441 bp, Corynebacterium glutamicum
  CDS (101)..(418): RXA00598
aacctcaatcgcctttgagattgctcttctcgcagcagtcctcggcggcgtacttccaaccctgtccatggctcgcatcatttcgaagggacgcaggtaaatgaccattccagagatcatcgtctccatcctcgtgatcctcgcaggcctgttttctctaggtactgcaatcgctttgtggcgcgcaccggatccgctcacccgagccaacctgcttggcaccaccgtgggtgtctccataccgctgctcatcattgcgctgctgattcacacctggtccgtcgacggatttaaccccaacaatttcatccgagcgatcatcgccatcatcggcgtctgggtcatcggttccgttggttcctactacatgggacgcgccatctatggtgtgaccgtagtggataacagacgatccaaataaactgcttttagaaaaaaagg

SEQ ID NO: 1836 - protein, 106 aa, Corynebacterium glutamicum
MTIPEIIVSILVILAGLFSLGTAIALWRAPDPLTRANLLGTTVGVSIPLLIIALLIHTWSVDGFNPNNFIRAIIAIIGVWVIGSVGSYYMGRAIYGVTVVDNRRSK

SEQ ID NO: 1837 - DNA, 414 bp, Corynebacterium glutamicum
  CDS (101)..(391): RXA00601
tagatatagaacacattctattgcagggaattatcaagtttcatacattgtcctcgtaggggcaagtatatttcccatgcaatattttttaggagtcccaatgcgtttcaagtcagttgcagctatcgcactttccaccgcaatgatcaggggtggaaccgcaagcgttgctaatgctcagcaggttagccctagttccacgattgagatccctcaagaattcgtccacaccgtgcagaacttcgtgccaggtatgacttacggcgatgcagggtccgctatccagagcaccgctggttctgtggcactgaacagtaccgctggaatcatccttccaatcgttcttccattccttggtctgggagctgttggttctgcagcgctgtctgcttaagccttttctaggttccttaa

SEQ ID NO: 1838 - protein, 97 aa, Corynebacterium glutamicum
MRFKSVAAIALSTAMIRGGTASVANAQQVSPSSTIEIPQEFVHTVQNFVPGMTYGDAGSAIQSTAGSVALNSTAGIILPIVLPFLGLGAVGSAALSA

SEQ ID NO: 1839 - DNA, 876 bp, Corynebacterium glutamicum
  CDS (101)..(853): RXA00602
gcgcgatcaatggaatctagcttcatatattgcacaatagcctagttgaggtgcgcaaactggcaacaaaactacccggcaattgtgtgatgattgtagtgtgcaaaaaacgcaagagattcattcaagcctggaggtgtcgccatccaaggcagccctggaaccagatgataaaggttatcggcgctacgaaatcgcgcaaggtctaaaaacctcccttgctgcaggtttgggcatgtacccgattggtattgcgtttggtctcttggttattcaatacggctacgaatggtgggcagccccactgttttccggcctgattttcgcgggctccaccgaaatgctggtcatcgccctcgttgtgggcgcagcgcccctgggcgccatcgcgctcaccacattgctggtgaacttccgccacgtattctatgcgttttcattcccgctgcatgtggtcaaaaaccccattgcccgtttctattcggttttcgcgcttatcgacgaagcctacgcagtcactgcggccaggcccgcaggctggtcggcgtggcgacttatctcaatgcaaatagcgtttcactcctactgggtattcggcggtctcaccggagtggcgatcgcagagttgattccttttgaaattaagggcctcgagttcgccctttgctctctctttgtcacgctgactttggattcctgccgaacgaaaaagcagatcccttctctgctgctcgcaggtttgagcttcaccattgctcttgtggtaattccaggtcaggccctatttgcggcgctgctgatcttcttgggtctgttgaccatccggtacttcttcttgggaaaggctgctaaatgacaactgatttctcctgtatt

SEQ ID NO: 1840 - protein, 251 aa, Corynebacterium glutamicum
VQKTQEIHSSLEVSPSKAALEPDDKGYRRYEIAQGLKTSLAAGLGMYPIGIAFGLLVIQYGYEWWAAPLFSGLIFAGSTEMLVIALVVGAAPLGAIALTTLLVNFRHVFYAFSFPLHVVKNPIARFYSVFALIDEAYAVTAARPAGWSAWRLISMQIAFHSYWVFGGLTGVAIAELIPFEIKGLEFALCSLFVTLTLDSCRTKKQIPSLLLAGLSFTIALVVIPGQALFAALLIFLGLLTIRYFFLGKAAK

SEQ ID NO: 1841 - DNA, 414 bp, Corynebacterium glutamicum
  CDS (101)..(391): RXA00604
atcacgttttgctatgaaagtggtgaaaccagctcgcccccaggtgtgaagcatgcattttgaagcatgaatctttttcatctagtgaaggactgatcccatgcgtatgaaatcaatcgcagcaattgcaatcgctaccgccgccctggctggtggcactggagtcgctagcgcacaggaagctggctcgactgctggttcctccaacctcagctctgggatccagcttccacaagaagccaccgatctgttgagcttcctgcctgctgctcaggctgcgcaggttgaaggagcaattcagagcaccgctggtttctttgccgttggactcggctcgaccgccattggttccactgcagtgaccttgggaattgcggatctgctgtctagctaatttcctctcaatagcttcaa

SEQ ID NO: 1842 - protein, 97 aa, Corynebacterium glutamicum
MRMKSIAAIAIATAALAGGTGVASAQEAGSTAGSSNLSSGIQLPQEATDLLSFLPAAQAAQVEGAIQSTAGFFAVGLGSTAIGSTAVTLGIADLLSS

SEQ ID NO: 1843 - DNA, 987 bp, Corynebacterium glutamicum
  CDS (101)..(964): RXA00610
caagcactcccaggggaacgttcattcgaaaaactcgacgccttatacgagcttctagagcctcggaaccaattgctcgagatcgcagtctaactagagtatggaaccgaaaaaacctgtcacatataaagaacttgcccacgaatattcaagaagaacgtttaacaaactcttcaccaaaattactggcttcgtctatctaaaaaacgatctaatcaacgatcccaacttagtgacccaagcactgctcaaaagatgcccagaaggagtacttcgcggatatgcagcattaaagcaacgtggctatcagcttttagacgatcagtggatgccaatcatcagtgtttccggagatctaaacaggagggactgctcacgaggtgaaattctcaggcggattgaaccagaaaacaccctgctcagtggcaacattaggttcgttaatgatgttcaagcgatccaagacgtcttcgacctgcattctctcaacgactttgaagaccaagtagctctcatcgatcatctcatcaggcagcgccccgaattattccaagaactcatacaagagccaaaacttaagaaacacactcaatacgccaatccttttgctgaatctccgcaagaatcacgacttcgggtcagacttcattcactgggttaccacggcttcatcccacagattcatgttgaatacgacggtcaatcctattttctagatctcgcagatccgctgtggcaggttgccctcgaatacaacggcggatggcactacacctctgagcagcgagagaaagattctcatcggaagaatgctctgaaaagtgcgggatgggatgtcctagaagtgacatcaaaaactctgcagaatccgaattcctggaacaacctgatacaacagatcaatagctctctccgccgaaagcaggctcagcgacgccgaaggttacccatgcaaacggtgggctaacggcatcactgaaaaagacc

SEQ ID NO: 1844 - protein, 288 aa, Corynebacterium glutamicum
MEPKKPVTYKELAHEYSRRTFNKLFTKITGFVYLKNDLINDPNLVTQALLKRCPEGVLRGYAALKQRGYQLLDDQWMPIISVSGDLNRRDCSRGEILRRIEPENTLLSGNIRFVNDVQAIQDVFDLHSLNDFEDQVALIDHLIRQRPELFQELIQEPKLKKHTQYANPFAESPQESRLRVRLHSLGYHGFIPQIHVEYDGQSYFLDLADPLWQVALEYNGGWHYTSEQREKDSHRKNALKSAGWDVLEVTSKTLQNPNSWNNLIQQINSSLRRKQAQRRRRLPMQTVG

SEQ ID NO: 1845 - DNA, 1599 bp, Corynebacterium glutamicum
  CDS (101)..(1576): RXA00611
ctttaaattgactatttacaaaactacttgatgagttagcaagagcacatttcggtgcgcctccctgctaaacctcgaaacaataactagattgcacactatgtctgccgctgcttctcgatcaagaaacatcttgactgccctcctgctattggtcccgctcatcgcaggtaccatctacgcctccgccatgggcttggacgtctcccgcgcatggtcctcagcagatgaagtaacgggggcacctgcagcctccgtagccaccaacaaccaggagcttatcgaagcccgtcgcgccgccggagaagccggcgcccaagcggggttcctcacctcaggaactgaagagctaaccagcggaacacaagagcttatcgacggcgcagccccactcgaagaaggcgtctcagccgcggctgacggtgcagcgcaactccacgatggcctcatccaactccaggccggcactggacaaatgggaaccggcgccaccgaaattgccgacggcgtccaaaacgcagtcgaacaacttggcggtcttgtcgttgtacagcagcaactcttaggcgccctcaacgaagcagacaaacaactcgcctcgagcaaaatccccgaagccgaagacctgcgcaaacaaatcaccgaagtccgaggacacctcgaaaacttcggcatctccgtagaaatgaccgaccaactcgatcaactacgttccggcacccgcgacctggctaaccaactcgcagtccccggctacggattccacgatggtatttacagcgccaccaatggagcagccgaattatctgcaggtttgcaagagctagaagcaggcgttgggactgccgtcgaaggcttcaccgcactcgatgaaggtgcaaaccgattagactccatggccaccctcaacgaagaaaaaacctccgcagtccaacgagccctcccggtaccccaagtacccgccggcacaatcgaaggcaccgcagacgaagaacgcaccagcgcactagcgcccatgtacgccttcttaatttcagcattggtcatgctggccggtgcagcacttggatgggcaacactaaaaaacaagtggctgatggcctttgctgtcattggtgtcactgcaatcggtggcattatcttgttcaccgtagctttgggcatatccattggagctttgtttggagccttaggaattttgcttcttgccactgttgttgccggtattctctcccggattttgcttgacgtgttgggaactaccggggctattgtggtttctgttctgggatgggtagcccaagctgcagtaattggccatgtatggagtgttaccgctgtatccgatatcgcacttgtttggcgagtcgtcgcaggcatgatgccactgcattatccaacctttgcagtgacctccattggtaatggcggatcagctgcagctatctggatgtctgttgctgtcttgttggcaatgggagcgatcggagctgttgcgcttcggaagccaaaggcggttgcggttgaggttgaagaagctgttgatgctgatgcagaccaagcagcctcggaatcctgatggttttggtctgattcgac

SEQ ID NO: 1846 - protein, 492 aa, Corynebacterium glutamicum
MSAAASRSRNILTALLLLVPLIAGTIYASAMGLDVSRAWSSADEVTGAPAASVATNNQELIEARRAAGEAGAQAGFLTSGTEELTSGTQELIDGAAPLEEGVSAAADGAAQLHDGLIQLQAGTGQMGTGATEIADGVQNAVEQLGGLVVVQQQLLGALNEADKQLASSKIPEAEDLRKQITEVRGHLENFGISVEMTDQLDQLRSGTRDLANQLAVPGYGFHDGIYSATNGAAELSAGLQELEAGVGTAVEGFTALDEGANRLDSMATLNEEKTSAVQRALPVPQVPAGTIEGTADEERTSALAPMYAFLISALVMLAGAALGWATLKNKWLMAFAVIGVTAIGGIILFTVALGISIGALFGALGILLLATVVAGILSRILLDVLGTTGAIVVSVLGWVAQAAVIGHVWSVTAVSDIALVWRVVAGMMPLHYPTFAVTSIGNGGSAAAIWMSVAVLLAMGAIGAVALRKPKAVAVEVEEAVDADADQAASES

SEQ ID NO: 1847 - DNA, 576 bp, Corynebacterium glutamicum
  CDS (101)..(553): RXA00613
tggcgataccagctccgagtagggctgcacttgaaaaagtgagtgttttagcgatagttgacaccttattcaccctacctggggagtactctgggcaaacatgagtgaactaaaagacaaaatccgcgcagatctgaccaccgctatgaaggcccgcgacaaggacaccactggtaccttgcgcatgctgctttccgcattgacccaggaagaaacatcgggaaccaagcacgaactcaatgatgaagaagtgttgaaggtgattgctcgtgagattaagaagcgtcgcgagtccgctgaggtgtacaccgaaaatggtcgtcaggaattggctgacgttgagcttaaagaggctgccattttggagggctaccagcctgagcagcttgatgatgatcagctgaacgcgctgatcgatgaggctatcgctgaagtcggcggcgaggccgatatgaagaagatgggccagatcatgaaggctgctaccgctaaggctgctggccgtgcagatggaaaacgactctccaccgcagtgaagagccgtttgagcaactaggtatttctagcggaagaact

SEQ ID NO: 1848 - protein, 151 aa, Corynebacterium glutamicum
MSELKDKIRADLTTAMKARDKDTTGTLRMLLSALTQEETSGTKHELNDEEVLKVIAREIKKRRESAEVYTENGRQELADVELKEAAILEGYQPEQLDDDQLNALIDEAIAEVGGEADMKKMGQIMKAATAKAAGRADGKRLSTAVKSRLSN

SEQ ID NO: 1849 - DNA, 1038 bp, Corynebacterium glutamicum
  CDS (101)..(1015): RXA00614
cagtggtgtccttgtcgcgggccttcatagcggtggtcagatctgcgcggattttgtcttttagttcactcatgtttgcccagagtactccccaggtagggtgaataaggtgtcaactatcgctaaaacactcactttttcaagtgcagccctactcggagctggtatcgccaccgctgcatggggatactcagagctcaaaaaattcgagctcaaaacagtagaactgccaattttgaagcctggaacgctccgtggaaagaaggaattccgccttctccacatctctgatctccacatgatcccaggccaagaaaccaaaaaagcatgggtctccgcactcgattcactaagccccgatttggtgatcaacaccggtgacaaccttagcgatgaaaaagcagtccccgacgtcctccgcgcactcggcccactgatgaaccgccccggcgcgttcgtcttcggaaccaacgattactgggcaccccgccccgtcaatcctttcggctacctcttcggtaaaaaacgcgaagtgagccacatcgacctcccctggcgagccatgcgagctgctttcatcgaacacggatggcaagacgccaaccaaaagcgactcgaattccaagtaggttccgtccgcctcgccatctcaggtgttgatgacccccaccatgacctcgacgactacacagagatcgcaggggcaccaaacgtggacgctgatctgtccatagcgttgcttcacgcaccagaacctcgagtcctcgctcagttcgaagccgacggctaccagctttccctctccggccacacccacggcggtcagctttgtcttccgggcagcaagccaattgtcaccaactgtggaatcgaccgcaaacgcgccaccggcctcaacaaatttggcgacatgtggatgcacgtttccaacggcctcggcacctcaaaattcgtcccattccgcatcttctgccgacccagcgccaccctaataaagatcactgaacaggcactttgacctgaaaaacccacaggact

SEQ ID NO: 1850 - protein, 305 aa, Corynebacterium glutamicum
VNKVSTIAKTLTFSSAALLGAGIATAAWGYSELKKFELKTVELPILKPGTLRGKKEFRLLHISDLHMIPGQETKKAWVSALDSLSPDLVINTGDNLSDEKAVPDVLRALGPLMNRPGAFVFGTNDYWAPRPVNPFGYLFGKKREVSHIDLPWRAMRAAFIEHGWQDANQKRLEFQVGSVRLAISGVDDPHHDLDDYTEIAGAPNVDADLSIALLHAPEPRVLAQFEADGYQLSLSGHTHGGQLCLPGSKPIVTNCGIDRKRATGLNKFGDMWMHVSNGLGTSKFVPFRIFCRPSATLIKITEQAL

SEQ ID NO: 1851 - DNA, 1183 bp, Corynebacterium glutamicum
  CDS (101)..(1183): RXA00617
acgactgggacgacgactaactaacccctgaggcactttctatttcatggctaaatcaactcctttgattgcatcgctacgctggcgaattgtcctgtggatgacagcggttgttttcttgaccctagccagcgttgtgatcattacccgttcggtgctgctttcagaggtaaccaacaccgcgaactcggcagttgagcaggaaattgaggagtttcgtcgctttgcagccgaaggaattgatccaacaactgcgcagccttttgagtcaggtcatcgcctgatggaggtttacctgtcgaggcagattccggatgaaaatgaagccattgtcggcattttccccggagagctcattcaggttgattactcccagctcagtggcgcccatccgcttcctttggaacactccgatccgttgatttcggaaatccgacagaccacgctgaattctggagttttcagcgatcttgaacgcggaaccactcactggggaaaggtgaatttccaaactgcttccggtgaggccgatggtgagttcgttgtcgcattcttcgctgataatcttaaagaccaggtcaacggccagatccagattcttattttgatcggcacagggggtttgattgcctcaattctgattgcttggttgattgcgggccagatcattgccccgatccgcaaattgagttccgtgtccgcaaagatcagtaattcggatctcacctggcgcgtccctgtggagggtcgtgatgagattgcgcagctggccaggacttttaatgccatgttggatcgcatcgaaatcgcgtataacgatcagcgccagttcgttgatgatgccggccacgagctgcgcaccccgatcacagtggtgcgtggccagttagagcttctcgccaccaccccgccggaggaacaagcgcggtcgattgagctggccaccactgagttggatcgaatgtcgcgaatggtcaatgatctgctcaccctcgcagtcgccgattctggcaccttcatccacgcccaccccacggatgtcacggatttaacaatcgatatcgaagacaaagcccgcaccatcagcgaccgaattttgcttgtcgacgccgccgagggcctcgtcagcctcgacgagcagcgggtcaccgaggcagtgctggagttgttcggcaatgcgttg

SEQ ID NO: 1852 - protein, 361 aa, Corynebacterium glutamicum
MTAVVFLTLASVVIITRSVLLSEVTNTANSAVEQEIEEFRRFAAEGIDPTTAQPFESGHRLMEVYLSRQIPDENEAIVGIFPGELIQVDYSQLSGAHPLPLEHSDPLISEIRQTTLNSGVFSDLERGTTHWGKVNFQTASGEADGEFVVAFFADNLKDQVNGQIQILILIGTGGLIASILIAWLIAGQIIAPIRKLSSVSAKISNSDLTWRVPVEGRDEIAQLARTFNAMLDRIEIAYNDQRQFVDDAGHELRTPITVVRGQLELLATTPPEEQARSIELATTELDRMSRMVNDLLTLAVADSGTFIHAHPTDVTDLTIDIEDKARTISDRILLVDAAEGLVSLDEQRVTEAVLELFGNAL

SEQ ID NO: 1853 - DNA, 531 bp, Corynebacterium glutamicum
  CDS (101)..(508): RXA00628
ggttgaaagtggcgtcgaaaagcgccttaaaatgaccggctcacctgcattattttatgcaacctcaatttggttgcacgccaagtagtagtctgtgcatatggcttctgtattcacgaaaattattaatggcgagctccccggccgatttgtgtatcgttccgagaatgtcgtggcttttctatccatcgaacccctcacctacggccacaccctagtcgtacccgttgcagaagttgaccgctggaccgaccttcctcagaacatctggagcgaagtaaacgaggcctcccagctcatcggaaatgcaatccgcacagcattcgacgcccctcgatgtggttacatcatcgcaggattcgatgttccccacactcacatccacctcttccccaccgacaaaatggccgattacgatttccgcaacgccatggccgcagacgccaccgaccctgcaaaaatggatgaagctgcagagaagatccgcgaagcgctggacggtctggtctagttcttgtagttctaattgct

SEQ ID NO: 1854 - protein, 136 aa, Corynebacterium glutamicum
MASVFTKIINGELPGRFVYRSENVVAFLSIEPLTYGHTLVVPVAEVDRWTDLPQNIWSEVNEASQLIGNAIRTAFDAPRCGYIIAGFDVPHTHIHLFPTDKMADYDFRNAMAADATDPAKMDEAAEKIREALDGLV

SEQ ID NO: 1855 - DNA, 1578 bp, Corynebacterium glutamicum
  CDS (101)..(1555): RXA00631
cctacctgcgccgcaaggtggacacccaggatccgcagctaattcagactgttcgtggcgttggatatgttctgcgcaccccacgtagctaaattctcctatggaaaatccttatgttgctgcgctcgatgacgaaaaccaagaagtcggcgtaaaaaaagaagcagaaaaagaacctgaaataggtcccatcagagctgccggacgagccataccgctgcgcacccgcatcattttgatcgtggtgggtatcgccgggcttggtttgctggtcaacgcgattgctgtctccagcctcatgcgtgaagtttcctatacccgcatggatcaagagctagagacctcgatggggacgtgggcgcataacgttgagctgtttaatttcgatggcgtccgccaagggccacccagcgattattatgtggccaaggtttttcctgatggatccagcatcatcttcaacgatgcacaatcggcacccgatctagctgaaaccaccatcggtactggtccacacactgtggatgctgctagcggttctgcctccaacactccgtggcgtgtgatggcggaaaagaacggtgacattatcaccgtggtgggtaaaagcatggggcgtgaaacaaacctgctgtaccgattggtgatggtgcagatgatcatcggcgcgctgattctggttgctattttgattacttcactcttcctagtcagacgctcgttgcggccgttgagagaagttgaagagaccgccaccaggattgcgggcggtgatttggatcgacgtgtcccgcagtggccaatgaccacagaagtcggacagctgtcgaatgccctcaatatcatgttggagcagctccaagcctcaattctgaccgcccagcaaaaagaagctcagatgcgccgattcgttggcgatgcctcccacgagctccgcacaccactgacctctgtgaagggcttcaccgagctgtattcatcaggtgcaacagatgatgccaactgggtcatgtccaagatcggtggcgaagcccaacgcatgagtgtgcttgtggaagacctcctgtcactgacgcgtgccgaaggccagcaaatggagaagcaccgcgttgacgtgctggaactcgccttggcagtacgcggatccatgcgagcagcctggccagatcgcacagtcaatgtatccaacaaagctgagtccattccggttgtcaaaggcgacccaactcgcctccaccaagtgcttaccaacctggttgccaacggactaaaccacggcggaccggacgcggaagtcagcattgagatcaacaccgatggacaaaacgtgaggattctcgtggcagacaacggtgtcggaatgtctgaagaagatgctcagcatatcttcgagcgtttctaccgcgccgattcctcccgctcacgcgcatccggcggatcgggcctcggccttgcgatcacgaaatccctggtcgaaggccacggcggcacagtcaccgtcgacagcgtgcaaggcgaaggcacggtgttcacgatcaccttgccggcggtttcttaaaggcatcaagggccggaaaa

SEQ ID NO: 1856 - protein, 485 aa, Corynebacterium glutamicum
MENPYVAALDDENQEVGVKKEAEKEPEIGPIRAAGRAIPLRTRIILIVVGIAGLGLLVNAIAVSSLMREVSYTRMDQELETSMGTWAHNVELFNFDGVRQGPPSDYYVAKVFPDGSSIIFNDAQSAPDLAETTIGTGPHTVDAASGSASNTPWRVMAEKNGDIITVVGKSMGRETNLLYRLVMVQMIIGALILVAILITSLFLVRRSLRPLREVEETATRIAGGDLDRRVPQWPMTTEVGQLSNALNIMLEQLQASILTAQQKEAQMRRFVGDASHELRTPLTSVKGFTELYSSGATDDANWVMSKIGGEAQRMSVLVEDLLSLTRAEGQQMEKHRVDVLELALAVRGSMRAAWPDRTVNVSNKAESIPVVKGDPTRLHQVLTNLVANGLNHGGPDAEVSIEINTDGQNVRILVADNGVGMSEEDAQHIFERFYRADSSRSRASGGSGLGLAITKSLVEGHGGTVTVDSVQGEGTVFTITLPAVS

SEQ ID NO: 1857 - DNA, 876 bp, Corynebacterium glutamicum
  CDS (101)..(853): RXA00637
ccgatggcactttccgtacctggaaggtagttgcccgcggcagaaacaattagggaaacctcttgaccttcacgcgacgtcaaggatttaactaacagtcatgacagatcgaaccattggcgaggctgctgaactactcggtgtcaccacccgcacactgcggcattgggacagcatcgggttgcttcaaccgagctggcgaaccacaacggattatcgcctttacacagaagacgatgtcgagcgcgccctgcagattcttatttacagggccgccggaatcgggttgaaggatattgcggaggtgcttgatcagccggattcggccaatcagcacctgcgccgccagcgggaactcctagtggaacagatcggtcagctgcatcggatggtccgggcagtagatgaaatccttggaaaggatgcgattagcgtgaaggaaaagattgagatcttcggcgaggatctgcccaagtaccaagaggaggctttccagcgctggggcgacaccccggagtggaaagaatcccaaaagatccaggagaagatgaccaaggaggattttcagagggcgaaagatgaacatgaggggttcgtcgaaaagcttatcgacgcctccctgcgcggcatcgcgcccggctctgcagagggcaatgagctagcgcttgcgcaccgcgcaagcatcggtcagtggtacaccgtgagtgcaaacaagcaagtaattttggctcggatgtacgtggaagacgagcgttttaacgaaacttacaaaggacacgcctcatatcttttaacacttattgaagcattggcgcaggtagaaggcgtggacttggagaatgtggagtgggaataatcccaatttcaactctttca

SEQ ID NO: 1858 - protein, 251 aa, Corynebacterium glutamicum
MTDRTIGEAAELLGVTTRTLRHWDSIGLLQPSWRTTTDYRLYTEDDVERALQILIYRAAGIGLKDIAEVLDQPDSANQHLRRQRELLVEQIGQLHRMVRAVDEILGKDAISVKEKIEIFGEDLPKYQEEAFQRWGDTPEWKESQKIQEKMTKEDFQRAKDEHEGFVEKLIDASLRGIAPGSAEGNELALAHRASIGQWYTVSANKQVILARMYVEDERFNETYKGHASYLLTLIEALAQVEGVDLENVEWE

SEQ ID NO: 1859 - DNA, 541 bp, Corynebacterium glutamicum
  CDS (101)..(541): RXA00646
aatgcaatcggaacggttaacgccaagtgatctggtgggatgtaggtaccgtcaggtccagcgcataaatttcccagaaatctctcctttacctgcaacaatgcagcgcagggcccgccgtgaggttgggttgacggaagttttggatcgtctcccagagcagcccaaaaagcggggccgaattcctttcaccagggcagatctagacaatgacgctgaattggcggagtttgaaaccctcgaagcaattgcagccggcgacaccttgattaccggcgcagtgttcacgggcaccctcgaaggggtggcatgggaagtgcaagtggatgtcttggtgcgcaaccctgatggaagctacatgcccgtgatggtgagcaatcaccgtgtcgcccgtccggatccgcacaaaactatgcagggcattgccgtcacccgcctcggtttgggtcagccgctagagctcaaggcaacgctgcgccaccacacgatcgatggctatcgcctcaccctcgcgttgatgggtttggaggaagctggagca

SEQ ID NO: 1860 - protein, 147 aa, Corynebacterium glutamicum
MQRRARREVGLTEVLDRLPEQPKKRGRIPFTRADLDNDAELAEFETLEAIAAGDTLITGAVFTGTLEGVAWEVQVDVLVRNPDGSYMPVMVSNHRVARPDPHKTMQGIAVTRLGLGQPLELKATLRHHTIDGYRLTLALMGLEEAGA

SEQ ID NO: 1861 - DNA, 579 bp, Corynebacterium glutamicum
  CDS (101)..(556): RXA00649
gtatttgatctgtggtgtggctgattcgggaggactcgatgacattatgtgtatggtacacattttgtgcaagatgcaatagctggcaaactggagagccatgagcaccgaccccatcgcggccttggaatacgaatccaccatcttcgcccgtcaccggaatcaatacaccggccaagcaggtacgaatgctggcgtcctcgattccagcggctacaacctactcacgctgctccagttacgtggcccctccaccatcggcgaactcagcgccatcaccggcctagacgcatctacccttaaccgtcagacaaaagccctactaaccaaaggatttgtcgaacgcatcccagatcccgacggtggaatcgctcggaaattccaccccaccgacctcggcaatgaactgctcaacgaggaacgcacatccagccaagaaaaatatgccgagttactttcagactggcccgaagaggatctacgcaccttcgtcaaacttcttgaaaaactaaataaagccgtggagacacgcgtcggaaagcattggccgcgcccctgactcagcccaagccagagccc

SEQ ID NO: 1862 - protein, 152 aa, Corynebacterium glutamicum
MSTDPIAALEYESTIFARHRNQYTGQAGTNAGVLDSSGYNLLTLLQLRGPSTIGELSAITGLDASTLNRQTKALLTKGFVERIPDPDGGIARKFHPTDLGNELLNEERTSSQEKYAELLSDWPEEDLRTFVKLLEKLNKAVETRVGKHWPRP

SEQ ID NO: 1863 - DNA, 672 bp, Corynebacterium glutamicum
  CDS (101)..(649): RXA00652
gcgatagctcatcgcgcccggttgattccccttcttcacaagggtttcaacatcgagctcattgcgtccggtttccgacacacgatctaggcttgactgcatgcgtcgtacattacctactatcctcgctgcttccatcatgctcaccgcttgtaccccggcggaacctgaagcaaccccagagaccaccaccgaggcagccccggaagtaattactgacggccttcccatcgacgcgatgcccgcggtcgaacgcaccgcacaaaccgcatgcccctacctgggcaccgactgggtcgccgataccaacggccagcgcgtcacgggttacggcacagacgaacgcttttcgacgccctcctgcgttttttactcctaccccgaagaaccacaactcacggtgattgtccgcgatatggccaccacggatgacgctatcgcggtagtggattgggcagcccccatcgattccactgagcccgctgaggaacccgcagggtggtccggtggccgccgaggtggaaacgatacttcaggcgcactctacgcggttcaaaacggccccaccgcggtcatcgtgttcaccaatcaggatcaatccctcaaagcgcagttaatcgctgaggaagtaatccagaatcttggtctctaactattagaaggccacatcgt

SEQ ID NO: 1864 - protein, 183 aa, Corynebacterium glutamicum
MRRTLPTILAASIMLTACTPAEPEATPETTTEAAPEVITDGLPIDAMPAVERTAQTACPYLGTDWVADTNGQRVTGYGTDERFSTPSCVFYSYPEEPQLTVIVRDMATTDDAIAVVDWAAPIDSTEPAEEPAGWSGGRRGGNDTSGALYAVQNGPTAVIVFTNQDQSLKAQLIAEEVIQNLGL

SEQ ID NO: 1865 - DNA, 1389 bp, Corynebacterium glutamicum
  CDS (101)..(1366): RXA00654
cagcaatagcgattattgcttgattgtgtgtttttagatcttcggttctcttcactcaactgctgtgaagtgccacctgtttggaaaggcgaacacgatagtgctcgatattttgatttacccggtgtctggagtgatgaagctgtggcacctgcttcttcacaacgttgcgggtttggacgattcactggcgtggttcttttcccttttcggccttgtcatcacgatccgtgcaattatcgcgcctttcacctggcagatgtataagtcgggccgcactgccgcacatattcgtcctcaccgcgctgcgctccgggaagaatacaagggaaagtacgatgaagcgtccattcgggagttgcagaagcgccagaatgatttgaataaggaatacggcattaacccgctggcaggttgtgtgcctgggctgatccagataccgattgtccttggtctttactgggcacttctccgcatggctcgccctgaaggtggtttggaaaatcccgtcttccagtcgatcggcttcctaactcctgaggaagtggaatctttcctcgctggtcgcgtgagcaatgtgcctctgcccgcttatgtttcgatgcccactgagcagctaaaatatttgagcaccacgcaggcggaagttcttagtttcgttttgccactgttcatcacagccgcaatcctcaccgcaatcaacatggcgatgtccatgtaccgcagcttccaaaccaacgattacgcatccggattctctaacggcatgctgaagttcatgatcgtgatgtcgatcctcgcgccgatcttcccactgtcccttggcctcacaggaccattccccacagcaatcgcactctattgggtcagcaacaacctgtggacgctcctccaaacaatcatcatgatggtcattttggaacgcaaatacccacttaccgacgatttcaaagtgcaccacctagagcagcgcgacatctaccgcgcaaaacaaaaagaaaagcgcatcttcctgtggacacgacgcaaaaaccgcgccctgatgattctcaccccatggaacgcctcaacgcttcacgcaacaaacgtggaactcaccaaaacccgtactgccgaaatcaacgaagcaaaacaggcccgcaaagaaatcgcgaacaagaggcgcgaaacgcaacgtgaaatgaaccgcgccgccatgcagcgcttaaagcagcgtcgcgctgaggttaaagctaaaaagaaggggcttatcgacgcctcccccaacgaagataccccttcggaaaatgaagaaactaaattgagtagtccgcaggtggagccgacaacaactgccgagccaaatcgcgagccgtctcaagaggactgatgttgtggaccaatcgagat

SEQ ID NO: 1866 - protein, 422 aa, Corynebacterium glutamicum
VLDILIYPVSGVMKLWHLLLHNVAGLDDSLAWFFSLFGLVITIRAIIAPFTWQMYKSGRTAAHIRPHRAALREEYKGKYDEASIRELQKRQNDLNKEYGINPLAGCVPGLIQIPIVLGLYWALLRMARPEGGLENPVFQSIGFLTPEEVESFLAGRVSNVPLPAYVSMPTEQLKYLSTTQAEVLSFVLPLFITAAILTAINMAMSMYRSFQTNDYASGFSNGMLKFMIVMSILAPIFPLSLGLTGPFPTAIALYWVSNNLWTLLQTIIMMVILERKYPLTDDFKVHHLEQRDIYRAKQKEKRIFLWTRRKNRALMILTPWNASTLHATNVELTKTRTAEINEAKQARKEIANKRRETQREMNRAAMQRLKQRRAEVKAKKKGLIDASPNEDTPSENEETKLSSPQVEPTTTAEPNREPSQED

SEQ ID NO: 1867 - DNA, 384 bp, Corynebacterium glutamicum
  CDS (101)..(361): RXA00656
ccttttaataacaatacaatgaataattggaataggtcgacacctttggagcggagccggttaaaattggcagcattcaccgaaagaaaaggagaaccacatgcttgccctaggttggattacatggatcattattggtggtctagctggttggattgcctccaagattaaaggcactgatgctcagcaaggaattttgctgaacatagtcgtcggtattatcggtggtttgttaggcggctggctgcttggaatcttcggagtggatgttgccggtggcggcttgatcttcagcttcatcacatgtctgattggtgctgtcattttgctgacgatcgtgcagttcttcactcggaagaagtaatctgctttaaatccgtaggg

SEQ ID NO: 1868 - protein, 87 aa, Corynebacterium glutamicum
MLALGWITWIIIGGLAGWIASKIKGTDAQQGILLNIVVGIIGGLLGGWLLGIFGVDVAGGGLIFSFITCLIGAVILLTIVQFFTRKK

SEQ ID NO: 1869 - DNA, 986 bp, Corynebacterium glutamicum
  CDS (61)..(963): RXA00657
gatcatgagtttccacgaactgtaacgcaggattcaccaatcaatgaaaggtcgaccgacatgagcactgaagacattgtcgtcgtagcagtagatggctcggacgcctcaaaacaagctgttcggtgggctgcaaataccgccaacaaacgtggcattccacttcgcttggcttccagctacaccatgcctcagttcctctacgcagagggaatggttccaccacaagagcttttcgatgacctccaggccgaagccctggaaaagattaacgaagcccgtgacatcgcccatgaggtagcgccagaaatcaagatcgggcacaccatcgctgaaggcagtcccatcgacatgctgttggaaatgtctcccgatgccacaatgatcgtcatgggttcccgcggactcggcggactctccggaatggtcatgggctccgtctccggtgcagtggtcagccacgcaaagtgtccagtcgttgttgtccgtgaagacagcgcagtcaacgaagacagcaagtacggcccagtcgtcgtcggtgtggatggctccgaagtctcccaacaggcaaccgaatacgcatttgcggaagctgaagctcgtggcgccgaactcgttgcagttcacacctggatggacatgcaggtacaggcatcacttgcaggtcttgcagctgctcaacagcagtgggatgaagtggaacgtcagcaaaccgacatgctgatcgaacgcctcgcaccactggtggaaaagtacccaagtgtaaccgtcaagaagatcatcacccgtgaccgcccagttcgcgcacttgcagaagcatctgaaaacgcgcagctcctagtcgttggttcccatggtcgtggcggatttaagggcatgctccttggctccacctcccgcgcactgctgcaatccgcaccgtgcccaatgatggtggttcgcccacctgagaagattaagaagtagtttcttttaagtttcgatgc

SEQ ID NO: 1870 - protein, 301 aa, Corynebacterium glutamicum
MSTEDIVVVAVDGSDASKQAVRWAANTANKRGIPLRLASSYTMPQFLYAEGMVPPQELFDDLQAEALEKINEARDIAHEVAPEIKIGHTIAEGSPIDMLLEMSPDATMIVMGSRGLGGLSGMVMGSVSGAVVSHAKCPVVVVREDSAVNEDSKYGPVVVGVDGSEVSQQATEYAFAEAEARGAELVAVHTWMDMQVQASLAGLAAAQQQWDEVERQQTDMLIERLAPLVEKYPSVTVKKIITRDRPVRALAEASENAQLLVVGSHGRGGFKGMLLGSTSRALLQSAPCPMMVVRPPEKIKK

SEQ ID NO: 1871 - DNA, 813 bp, Corynebacterium glutamicum
  CDS (101)..(790): RXA00661
cggatgcaagagaaccgtggtttcgctgatttttggcgaacccggaattaaggccccgaggattacatgcttttaaatcctttgaaaaggggacaagatcatgaatcctataaccgaattattagacgcaacactatggatcggcggagttccgattctgtggcgcgaaatcatcggcaacgttttcggattatttagcgcgtgggcaggaatgcgacgcatcgtgtgggcatggcccatcggcatcataggcaacgcgctgctgttcacagtatttatgggcggccttttccacactccacaaaacctcgatctctacggccaagcgggtcgccagatcatgttcatcatcgtcagtggttatggctggtaccaatggtcggccgcaaaacgtcgcgcactcaccccagaaaatgcagtagcagtggttcctcgctgggcaagcaccaaagaacgcgccggcattgtgattgcggcggttgtgggaacactcagctttgcctggattttccaagcactcggctcctgggggccatgggccgacgcgtggattttcgtcggctcaatcctggctacctacggaatggctcgcggatggacagagttctggctgatctggatcgccgtcgacatagttggcgttcctctacttttgactgctggctactacccatccgcggtgctttacctggtgtacggtgcgtttgtcagctggggatttgtcgtgtggctgcgggtgcaaaaagcagacaaggctcgtgcgctggaagctcaggagtctgtgacagtctgaaaagcgtttactaaatagaa

SEQ ID NO: 1872 - protein, 230 aa, Corynebacterium glutamicum
MNPITELLDATLWIGGVPILWREIIGNVFGLFSAWAGMRRIVWAWPIGIIGNALLFTVFMGGLFHTPQNLDLYGQAGRQIMFIIVSGYGWYQWSAAKRRALTPENAVAVVPRWASTKERAGIVIAAVVGTLSFAWIFQALGSWGPWADAWIFVGSILATYGMARGWTEFWLIWIAVDIVGVPLLLTAGYYPSAVLYLVYGAFVSWGFVVWLRVQKADKARALEAQESVTV

SEQ ID NO: 1873 - DNA, 685 bp, Corynebacterium glutamicum
  CDS (101)..(685): RXA00667
ggcatcagtgtttgaagggaaaagcaggtcaaacaaggtgcggctgatttgagcgatcacagcaccgagatctgtgctgaagaattcaatgattgggttgatgattgcgttgaagtccatgtctaacagggtagtacaaaagccaaaaatgaaagcgccgctacccatccgcgacggcctcaacccttcccgtgtgcgcttgccgctcgacgcggcgccgatccgcgccatcgattttgttgaatacctcatttccacgcagcgccaccgcaatccggccgacaacgccgaagcgcttcaagcgcgtttcgacgccgaccttgttgtcaaccactacggcgagccctacgcccccgacaccatggttcagcccgacgacgacatttggttctaccgcatgcccgccgccgaacggccgatcccttacaaaattcatgtcattcacgaagacgatgacatcctcgtcattgacaagccaccctacctagcaaccatgcctcgtggccgccacatcaccgaaaccgctctggtgaaaatgcgtgtgctgactggaaacaacgatctcaccccagctcaccgcctcgatcgcctgacttccggtgtgttagtcatggtgaaaaaaccagaactccgtggcgcttaccaaaccttgtttgcccgacgtgaggcgtccaaaacctatgag

SEQ ID NO: 1874 - protein, 195 aa, Corynebacterium glutamicum
MIALKSMSNRVVQKPKMKAPLPIRDGLNPSRVRLPLDAAPIRAIDFVEYLISTQRHRNPADNAEALQARFDADLVVNHYGEPYAPDTMVQPDDDIWFYRMPAAERPIPYKIHVIHEDDDILVIDKPPYLATMPRGRHITETALVKMRVLTGNNDLTPAHRLDRLTSGVLVMVKKPELRGAYQTLFARREASKTYE

SEQ ID NO: 1875 - DNA, 870 bp, Corynebacterium glutamicum
  CDS (101)..(847): RXA00676
ggtttgcgacctccccggcgtgccgccaggggaggaggcgataaaacttttttacctttcgaatatcaaaatcataaaacagccttatatacttcaacgtatggcgaagaattctcgaatccgatacagcgcgtcaatcaagcgtgccgcagctgcaatcctcaccgcagctgctacctcagtcgcgttgatcgctgtgccagcaactgcttcagcacaggacctcgcaaccggcagctcccagatccagactgatgctcgtgaaggtgcgtgggcaacccgcaacaccatccaagaccaacttgcctccattgggccagcagccctcccagtccgcgcagcggtagacaatgccatcaacggcatgttcccaggacttgttgatgaaaaggttgcagcagagcaggaagctgcacgcgcagaagctgagcgcgaagcagcagctgcacgtgaagcagaagcagcccgcgtagccgcagaagaagccgcacgctttgaccgcggctcttgcccagcaatcgctgatgtctgcgtggacattgatggtggacgtacctggctgcaggaaaacggtcaggtcacctacggtgcagtcccagtttcctccggcggagttggccaggaaacccctcgcggaacgttctacatcaaccgcaaggtcaaggatgaaatctcttacgagttcggtaacgccccaatgccgtacgccatgtacttcacctacaacggccacgcattccaccagggcaatgttgcgactacttccgctggttgtgttcgcctaaacactcaagatgccatctactacttcaacaacgttggcatcggcgacatggtgtacatctactaaaactcaccgttgctagcagg

SEQ ID NO: 1876 - protein, 249 aa, Corynebacterium glutamicum
MAKNSRIRYSASIKRAAAAILTAAATSVALIAVPATASAQDLATGSSQIQTDAREGAWATRNTIQDQLASIGPAALPVRAAVDNAINGMFPGLVDEKVAAEQEAARAEAEREAAAAREAEAARVAAEEAARFDRGSCPAIADVCVDIDGGRTWLQENGQVTYGAVPVSSGGVGQETPRGTFYINRKVKDEISYEFGNAPMPYAMYFTYNGHAFHQGNVATTSAGCVRLNTQDAIYYFNNVGIGDMVYIY

SEQ ID NO: 1877 - DNA, 858 bp, Corynebacterium glutamicum
  CDS (101)..(835): RXA00678
tgcgcagtgcactttccaggaaccaaaatatccccgccgaccttgctgcagatatttcgcagccgctgaaaaaactagccgttgacctggaggttacccgatgactcgcagtaatttacccgcttgggagcaagcagaccccagcgtccacgcctctgatccccgcgccatcacttttgcggaggattttgggattcgtcccatcccggccgtaggtccaattgataccaccgctatctgtgcaacaccttcaaatggatttgagcaattatggaaagccattgagccggaaacccgcacccgcgccaacgacattcatcttcccatcgtcgtggcgtacgctgaacgtctctgcgacgcttacccactggcagatagagaattggttctcgtagccgcaatcctccacgacacgggctgggcacatgtcgatgagagccgaatcatctccgaaggattctccggaaactggcgcaaagcagcaatccgcttcgaacacgaaacagaaggctgcactgtggcccgccgagtgcttccatccctcggatatactgtcgattttgtcgagcatgtctgcgacatcatcgacggacacgacacccgccaagtggcctactcactagaagacgctcttgttcgcgattgcgaccgactctggcgtttcgaccgcgccgggatcacggcttctagctcatggttcgggatgccagtctcagattatgtcgaccgcctgcacagggaaatcctcccagaattaatcaccgaagctgcacaccagatggctactgcagacctcaatcgtgcaaaggccctgttaagaacggatgcgatccgatgaatgctgcaaccaggcgtgct

SEQ ID NO: 1878 - protein, 245 aa, Corynebacterium glutamicum
MTRSNLPAWEQADPSVHASDPRAITFAEDFGIRPIPAVGPIDTTAICATPSNGFEQLWKAIEPETRTRANDIHLPIVVAYAERLCDAYPLADRELVLVAAILHDTGWAHVDESRIISEGFSGNWRKAAIRFEHETEGCTVARRVLPSLGYTVDFVEHVCDIIDGHDTRQVAYSLEDALVRDCDRLWRFDRAGITASSSWFGMPVSDYVDRLHREILPELITEAAHQMATADLNRAKALLRTDAIR

SEQ ID NO: 1879 - DNA, 1053 bp, Corynebacterium glutamicum
  CDS (101)..(1030): RXA00691
tgcagctgcagtcgcactatggattgttcttgccatatcgccatgggttccttctgcgcacgccttgaccacgccttgtgaagacgaccaagtgacagtgatggttgagggcaacaccatcggctgtgctgacgccggcggaaatggctatcaaacgcttcttgatgccggatttgatgtggaaaccaccgttcagtttccagaattcttgtgccgaatcaatgatttcccaggtcctgatgtggacgattgcatgaccgcatcacctgctgaagcttattggtcttattggcatgctcccctcggcggagatgaatgggaatacagcaaccttggagctttcctctactaccccaaacccggcactgttgaagcgtggtattggggagatactgatcgtcccggcgcgatcccggtgagtaaatctcaggcggagttggggttagactccgcggatccggattacaaaattgattttgatccaaatgatttcatcaccacaaccccaacctccgagtcccctatcgccgatttagggggtgacgaagagcccactgaaactactgaagctcctatcgcaggggctggagctggttcggcaagaggacaagcagctgaacccactgttgaggtaaaccctgagaaccctaatgaggtattggtgtatcaggattctgaaggaaactcgattactaaaggtcagtacgagaacttggttgctgcagcagccgctaagaccactgctgctgtccaagccccagctggggctggtgaagcaaatagccaaccgcaggcaacagcggtggcagaagctcctgaagttgatccgatgaccacgcaggttcttatggcgcctgcgggccaagatggagacgtcatggctgagggttcgacgcagcagacgtacgccacaggcacggtggattcttctgctcagggatggatcattggactcacactggctgtcatttccttggtttcagcgtctgctgtggcggcgtgggcgattcgtcgttcagaggtccagggttaaagcttcgtgaaatggattga

SEQ ID NO: 1880 - protein, 310 aa, Corynebacterium glutamicum
MVEGNTIGCADAGGNGYQTLLDAGFDVETTVQFPEFLCRINDFPGPDVDDCMTASPAEAYWSYWHAPLGGDEWEYSNLGAFLYYPKPGTVEAWYWGDTDRPGAIPVSKSQAELGLDSADPDYKIDFDPNDFITTTPTSESPIADLGGDEEPTETTEAPIAGAGAGSARGQAAEPTVEVNPENPNEVLVYQDSEGNSITKGQYENLVAAAAAKTTAAVQAPAGAGEANSQPQATAVAEAPEVDPMTTQVLMAPAGQDGDVMAEGSTQQTYATGTVDSSAQGWIIGLTLAVISLVSASAVAAWAIRRSEVQG

SEQ ID NO: 1881 - DNA, 1257 bp, Corynebacterium glutamicum
  CDS (101)..(1234): RXA00692
ccttaaagcggggtcagaacatttctccaattcattttaaggacatgttttcatggctcatctacgtgggaagagaaccattcgctggtctgctgcaaccgtggctttagcaaccggtgtttccctgttggctccacaggtcgttgctgcacaggatgcatcatcggatattcaattagctacccaattcatcgaaaaagaatttgcaacgaatggcctcatccctgggcctgtaggtactccagatattgggctcaatcaggatctgttgctgtccctaaatgcgcttgcccctgattctccagagatcgacgctgcatatgctgcaattgctccggagctcgagggctatgtctcagtttctgactacatcttcagcgatcgtctagccaagaccgtagctttccaagatgccctcggcgtcagagatgctgattttatcgcgcaacttgtcagcgctgttcaagaaaacggtcagatcaaaaacttagataatggtgaagccacaactgcaattaataacttcagccaggcctggggcgttctagctctgcaccgcgtcggtgaaaccgaagcagccgagcgcgcaacagaattccttaaaactcaagtgtgctccgacggtggtgtccaattagcctcagcaatcgaacctacatgcaaaaccacggattccgatgtcactgcaatggctgcacaggctttgactctggcaaatggtgcgcaggatccaaccacacaagccactctcgattacctcgtcaccacgatggatgagaccggtggtgtcaaaaatacttggaccggtgtgaattccaactccacgggaattgtcggatccgcttttgctcttgcgggcgatgaggaaaactacctcaaggctcgtgaatacctggcatctgttcaatttggcgaagatgcagacccatcgattcagggtggctttgctttcaccgtgaaggctaaggaaaccaacactgcgattagcgatcagattcgacgcgcaactggccaagcagcattaggttttgcaggcggtaactacgccaacgataaactgatcaccattgcgaacccagtagatccaactccagatccagaaattccaactcccccagctgattcagagggatccaccggtggaattggcggcgctggaattatcatcgccatcttggccatccttgccgccatcgctggtgtcatgggaccaatgatggctaacctgcagttttaacatctgagagaagtacagtg

SEQ ID NO: 1882 - protein, 378 aa, Corynebacterium glutamicum
VALATGVSLLAPQVVAAQDASSDIQLATQFIEKEFATNGLIPGPVGTPDIGLNQDLLLSLNALAPDSPEIDAAYAAIAPELEGYVSVSDYIFSDRLAKTVAFQDALGVRDADFIAQLVSAVQENGQIKNLDNGEATTAINNFSQAWGVLALHRVGETEAAERATEFLKTQVCSDGGVQLASAIEPTCKTTDSDVTAMAAQALTLANGAQDPTTQATLDYLVTTMDETGGVKNTWTGVNSNSTGIVGSAFALAGDEENYLKAREYLASVQFGEDADPSIQGGFAFTVKAKETNTAISDQIRRATGQAALGFAGGNYANDKLITIANPVDPTPDPEIPTPPADSEGSTGGIGGAGIIIAILAILAAIAGVMGPMMANLQF

SEQ ID NO: 1883 - DNA, 606 bp, Corynebacterium glutamicum
  CDS (101)..(583): RXA00693
tccatcagccctcccccgcgtgccccacgcggggcacggttagcgctgctaacctggcccgatgtacaaattaatctcaccgcatttgtcaggccacgccatgtggaaagaggctttggaagaattcggatcaggccccatccacggctcgggttatttcgagaactatcttcccatcgactattccgaagcaggatttcaccactacctcaaggagcgcactgacgcggccgatccttcggttccaccaccggaaggttttgtgcactgcagctatttctggatcgttgatgatgacgatgttcttgtcggattcttagctttaaggcacgagctgaaccaacatctcctggaagtcgcgggccacattggttacggcgtgcgcccgtctgcgcgtcgaaaaggtgctgcaaccgcagcgctgaaactcggtgttcatgaagctcaggccttgggcatcgacaaggttttgctgtgcgtcgcaggagataacgaagcgtccaggaacgtcatcgaaaagtgcggtggagtttatgaatccacgatccgtggaatgcgacgctattggatagccacagattcttaaaaaatcttcgcaagaactta

SEQ ID NO: 1884 - protein, 161 aa, Corynebacterium glutamicum
MWKEALEEFGSGPIHGSGYFENYLPIDYSEAGFHHYLKERTDAADPSVPPPEGFVHCSYFWIVDDDDVLVGFLALRHELNQHLLEVAGHIGYGVRPSARRKGAATAALKLGVHEAQALGIDKVLLCVAGDNEASRNVIEKCGGVYESTIRGMRRYWIATDS

SEQ ID NO: 1885 - DNA, 498 bp, Corynebacterium glutamicum
  CDS (101)..(475): RXA00701
aagagacgatggcgtataggacgatgatgagcatttcctttttgccgcgtacttgggggagtaggccggcgccgaagctgacccaggcggctgcgagcatttggtaggggagccacggtccgattcctgcggtgagcagcgcggatgcgaacagtccggtgttgccgaggatgaatccgaagccgggtccgaaggctcgtccgccgaggatgaggacaaagaagactgcttcaaagcctgctgcgccggcaccgaatggtcggactacggcaaccatggcggtgaggacgccgagcatggctacggctttaacgtcgaatccgttttcactgatttcggcgatgacagcggccagcacgaggggaatgacgatcgcgatgtagaggggcgcttgggctttgtcggacaggaaggattccgggttgacgatcagcggccagaagaaaatcacgatgctcaaaaccgcaaggaagcttaaggtgaggaaggttttgggct

SEQ ID NO: 1886 - protein, 125 aa, Corynebacterium glutamicum
LVGEPRSDSCGEQRGCEQSGVAEDESEAGSEGSSAEDEDKEDCFKACCAGTEWSDYGNHGGEDAEHGYGFNVESVFTDFGDDSGQHEGNDDRDVEGRLGFVGQEGFRVDDQRPEENHDAQNRKEA

SEQ ID NO: 1887 - DNA, 1095 bp, Corynebacterium glutamicum
  CDS (101)..(1072): RXA00707
tagttaaaagcacttaccttaactggtaggtgcttttttcatgtctacgcagtgggtaactttcagaggaaaattacccaaccaaaacaaaggaactttcatgaacgtgcaacgcaaactgctggcgatcgtaggggctttcatggcagggtctttagccttgggaacaccaactgcacaggcccaaagcattggcagcagtgcctcacagagaactgaagtcttacgtgggctgacctcatctgccggaataccagatgccacagcgccggaaggcggggcaaaagtcgtggtctttggagattcacatgcatcaggaaccaatgcaccatttgatgtggatgaacgcggctgcctcaaggggaaccaatcgtggcctgatcaattgcaagcacaacaaggattgcagcagggggagctcattgacctttcctgcaacggcgcctccatcaactcgacgggtttccacttttccgatgaagttcggcatgcagaagcactaggggccattggaccaaataccgagaacatcttcatccaatttggcaagaatgatcagtggggacactcaccaatcaatttgcgctattccgtgatcaactgcctttttgatgcggccaacggatgcggtgagaaagctgtagcggctggaaccatgcaggatccctcctcggtcaccggcgaaaactatgctcagcggatgaaacctgtcatcgactacctcaagtactacgctccaaatgcgcagatcacgttgctgggataccaggaatacaccccacgaagcggaagcgagatttgtgtccgcgtgggaggtacggaactaaggaaaccagacgccaccaacctggtgtcctatatgaacaatcttgagtcggccatttttgaagcctctgagattcttgacgtccagcatgccaatctccgtgaggccactgcaggacacagcagctgctcagctgaaccgtgggtcaacggagtgctggatatgcgggtaaacgctgtaggaggcacctggcacccatctccaaagggagatgaagtgaccgcgggcctcctcggaaccttgatgtaactatctagaattcttcatag

SEQ ID NO: 1888 - protein, 324 aa, Corynebacterium glutamicum
MNVQRKLLAIVGAFMAGSLALGTPTAQAQSIGSSASQRTEVLRGLTSSAGIPDATAPEGGAKVVVFGDSHASGTNAPFDVDERGCLKGNQSWPDQLQAQQGLQQGELIDLSCNGASINSTGFHFSDEVRHAEALGAIGPNTENIFIQFGKNDQWGHSPINLRYSVINCLFDAANGCGEKAVAAGTMQDPSSVTGENYAQRMKPVIDYLKYYAPNAQITLLGYQEYTPRSGSEICVRVGGTELRKPDATNLVSYMNNLESAIFEASEILDVQHANLREATAGHSSCSAEPWVNGVLDMRVNAVGGTWHPSPKGDEVTAGLLGTLM

SEQ ID NO: 1889 - DNA, 1056 bp, Corynebacterium glutamicum
  CDS (71)..(1033): RXA00713
aaccacgcctccttgtgcgggcctgtcagtaactgttatcgcaggttcatgcgttaaggtgtggaagaccatgacaaaagtagcggagctggaccaagagtggtccgaagtagatgacgcggaattagacgcgcaaagcgctggcacttctgatagttccagcacagacgacttcgctgacgcagaaaacacttctgaaaatctgggacccatcggcccagaaccactccctgaaccagatggggatgttccggcatcgggtttccaagtgcagctcgataattttgaaggtccttttgaccttctcctgcagctgattaccaagaagaaacttgatgtcactgaagttgccttggcccaggtgaccgacgagtttattgcttacacccgaaaactgggcgaaaccagcgatttggatgagaccacagagttcttagtggtggccgcaacgctgttggatcttaaaacagctcgcctgctcccgcgtggtgaagtcgacgatgaagatgatctcgaattgctcgaaataaaggatctccttttcgccaggttgttgcagtatcgcgcttacaagcaagttgcggaaatgtttgcgcaatggcagcgagatgctcgacgcaggtacccgcgcgctgtctcattagaaactcagtttgccaacctcttgccgcccgtttccttgggtcattccttaaaaagtttcagcgagttggctgctgtggtgtttcgtccgaaacccccagagacggtgaaaacagatcacgtgcaccaagttgcggtgtcagttccagagcaagcgggcaggattcttaacacgttgaaacttgccggaattgatcattatttgagctttcagctgctcacacgtgattgtaccgcgtcaatggaagtgattggccgcttccttgccttgctggaattgtataaggcacgcgctattgaaaccttgcaagaagagccactcggcgagcttaaagtttcgtggactggcattgatgtcgatccagcagtcgtcgcggcgagtgactgggagtaatcagtttttcttaaggaaac

SEQ ID NO: 1890 - protein, 321 aa, Corynebacterium glutamicum
MTKVAELDQEWSEVDDAELDAQSAGTSDSSSTDDFADAENTSENLGPIGPEPLPEPDGDVPASGFQVQLDNFEGPFDLLLQLITKKKLDVTEVALAQVTDEFIAYTRKLGETSDLDETTEFLVVAATLLDLKTARLLPRGEVDDEDDLELLEIKDLLFARLLQYRAYKQVAEMFAQWQRDARRRYPRAVSLETQFANLLPPVSLGHSLKSFSELAAVVFRPKPPETVKTDHVHQVAVSVPEQAGRILNTLKLAGIDHYLSFQLLTRDCTASMEVIGRFLALLELYKARAIETLQEEPLGELKVSWTGIDVDPAVVAASDWE

SEQ ID NO: 1891 - DNA, 684 bp, Corynebacterium glutamicum
  CDS (101)..(661): RXA00714
cgtcaatcaagctgtcaaaaaaaatacaagttaggtcacaaaatgatttcagtcgtgagaaccatcacatataagacatctcatgatctaacatttcttcatggctacgattacacgcaccgacagactgatcctcgtaccgctcactgttgagctcgaagacgaggcccaccagatttactctgattctcgaatctgggaacaccgcccccaggcgcgtcacaccaacgtgcgtgtcacgcgcgacatcatcaagcgcaccaatgaaagctggggcaagaaagaccttggcccctggggtgtttacctccgtgaccgcccatcggaattcgttggcgttggtggcgttgaactcatcgacggaaaagtatgggacctcaagtaccgcctccgccccgacctatggggcaatggatacgccacggaaatctccaacgccgcaacactggccaccaagcgtatcgacgacagcctcccactcacggccagggtgactaccaaccaccctgcctcattccgtattttggaaaaactgggactcacccccgtatgggaaggccgacgagtcggaacggaagatgaccccaacgagcctgatgtgagaatttattctgaccgtccgctatcggatgaaattcttgaaatgctcaagcaacgaccatagaccagaaaatctcacccctt

SEQ ID NO: 1892 - protein, 187 aa, Corynebacterium glutamicum
MATITRTDRLILVPLTVELEDEAHQIYSDSRIWEHRPQARHTNVRVTRDIIKRTNESWGKKDLGPWGVYLRDRPSEFVGVGGVELIDGKVWDLKYRLRPDLWGNGYATEISNAATLATKRIDDSLPLTARVTTNHPASFRILEKLGLTPVWEGRRVGTEDDPNEPDVRIYSDRPLSDEILEMLKQRP

SEQ ID NO: 1893 - DNA, 636 bp, Corynebacterium glutamicum
  CDS (101)..(613): RXA00716
aaagccgattgcttaacgcccgctatgataaccactcatgaatgatttcgatccagcattgatttccgcgatgagccttatccctcagacgaggtctcggatggaatcaatcttgttggtggtcgataccccagtttcagcacgcacgctggctggggtgttgggcattgacgtgcctgcaacagaggcaattttgaaggaaatggcctttgagctttctgaacggggcagcggcattgatctgcgggaaacggcagaaggatggcgctattacacccgcccggaaaatgcggacatcgtcgagcaattcctcctcgatggaaaccaaaccagactgtcccgtgcagcattggaaacactcgcggtggtggcatatcggcagccggtcacacgctcccagatttcagcagtgcgcggagtaaatgtcgacggcgtcatgagaaccttgcagcttcgaggcctagtcaaagaagtcgatgtggacgaatcaacgggcgcacaccgctatggcacaacggaattgctgcttgagctgttgggtattgattctttggataaattaccagatctagcaccgcttttgccggatgttgactccattgatgaagacttctaaagcatcagttaaagccccga

SEQ ID NO: 1894 - protein, 171 aa, Corynebacterium glutamicum
MESILLVVDTPVSARTLAGVLGIDVPATEAILKEMAFELSERGSGIDLRETAEGWRYYTRPENADIVEQFLLDGNQTRLSRAALETLAVVAYRQPVTRSQISAVRGVNVDGVMRTLQLRGLVKEVDVDESTGAHRYGTTELLLELLGIDSLDKLPDLAPLLPDVDSIDEDF

SEQ ID NO: 1895 - DNA, 1752 bp, Corynebacterium glutamicum
  CDS (101)..(1729): RXA00719
cagatgatgcacacatcgtggacacctctgatatgaccatggatcaagtacttgatcacctcatccacctagtggaagcctccgctgaaaggagcaaccagtgactgataaacacaccatgcctggtgaagaggacgacaccgtattcgtctaccacacccacaaaggcgaaatggacgtcgaaggtgcgtttgctgacgaagaagaactagcaccacacggcggttgggcttccgcagatttcgacccagcagaattcggctacgaagactctgacgatgacttcgatgcagaggactttgacgaaacagagttctccaaccctgatttcggcgaagactactctgatgaagactgggaagaaatcgagaccgcattcggattcgacccaagccaccttgaagaagctctctgcacggtcgctatcgtcggacgcccaaatgttggtaaatcaaccttggtgaaccgctttattggacgtcgagaagcagtcgtggaagatttccccggcgtaacccgtgaccgcatctcctacatctctgactggggtggacaccgtttctgggttcaggacacaggcggatgggatcctaacgtcaagggcatccacgcatcgatcgcacagcaagcagaagttgctatgagcactgccgatgtcatcgtattcgtcgtggacaccaaggtgggcatcaccgaaactgactcagtgatggcagcaaaactgttgcgctcggaagtgccagtgatcttggttgcgaacaaattcgactccgacagccagtgggctgacatggctgagttctacagcctcggccttggcgatccatacccagtttcagcccagcatggacgtggtggcgctgacgttttggacaaagtccttgaactcttcccagaagagcctcgctccaagtccatcgtggaaggccctcgtcgtgtcgcccttgtgggtaagccaaacgtgggtaagtcttcactgctcaacaagtttgctggcgagacccgctctgtcgtggacaatgttgcaggaaccaccgttgaccccgttgactccctgattcagctggatcaaaaactgtggaaattcgtggatactgctggtcttcgcaaaaaggtcaagactgcatctggccacgagtactacgcatcactgcgtacccacggtgccatcgatgcagctgagctgtgtgttttgcttatcgattcctccgaacccatcaccgagcaggatcagcgcgtgctcgcaatgatcaccgatgccggtaaggcactggttattgcgttcaacaagtgggatctcatggatgaagatcgccgcatcgatttggatcgcgaacttgatctccagttggcacacgtgccttgggcaaagcgcatcaacatctccgccaaaaccggtcgtgcactgcagcgcctcgagccagcaatgttggaagcgctcgacaactgggatcgccgtatctccactggtcagctgaacacctggctgcgtgaagcaattgctgcgaacccaccaccaatgcgtggcggacgtttgcctcgagtgctgtttgccacccaggcatctactcagccaccagtgatcgtactgttcaccaccggcttcctcgaagcaggttaccgacgatacctggagcgcaagttccgtgaacgtttcggctttgaaggcactccagtgcgaatcgctgtgcgtgttcgcgagcgccgcggcaagggcggaaacaagcagtaaagcttgattttccctaaaag

SEQ ID NO: 1896 - protein, 543 aa, Corynebacterium glutamicum
VTDKHTMPGEEDDTVFVYHTHKGEMDVEGAFADEEELAPHGGWASADFDPAEFGYEDSDDDFDAEDFDETEFSNPDFGEDYSDEDWEEIETAFGFDPSHLEEALCTVAIVGRPNVGKSTLVNRFIGRREAVVEDFPGVTRDRISYISDWGGHRFWVQDTGGWDPNVKGIHASIAQQAEVAMSTADVIVFVVDTKVGITETDSVMAAKLLRSEVPVILVANKFDSDSQWADMAEFYSLGLGDPYPVSAQHGRGGADVLDKVLELFPEEPRSKSIVEGPRRVALVGKPNVGKSSLLNKFAGETRSVVDNVAGTTVDPVDSLIQLDQKLWKFVDTAGLRKKVKTASGHEYYASLRTHGAIDAAELCVLLIDSSEPITEQDQRVLAMITDAGKALVIAFNKWDLMDEDRRIDLDRELDLQLAHVPWAKRINISAKTGRALQRLEPAMLEALDNWDRRISTGQLNTWLREAIAANPPPMRGGRLPRVLFATQASTQPPVIVLFTTGFLEAGYRRYLERKFRERFGFEGTPVRIAVRVRERRGKGGNKQ

SEQ ID NO: 1897 - DNA, 671 bp, Corynebacterium glutamicum
  CDS (1)..(648): RXA00724
atcggtgaggaagtcctcgccggacgccaagcctatgtggtgtgtccgcgcattgaaggcgaaggcggcgtgctggaaatccacgcctatctttccgaacaggtatatccaggattgaatgttggaatgctgcacggtcgcatggacacggatctcaaagattcggtcatgcaggaattcgcccaaggtgagatcgatattttggtcgccaccacggtcattgaggtcggtattgacgttgccaacgccaccgtcatgctcatccgcgaggcggaacgcttcggcgtttcccagatccaccagctgcgcggccgtgttggccgtgggcagcacgattccctctgcctgctgcacaccaccttcgacgaggactccccacaaggccaacgcctcgccgcaatttccaccacaaccgacggttttcaactctctgaacttgatttgcaggtacgccaagaaggcgacgtgttgggcacccgccagtccggcagcgacaccaaactccgtcacctctcgtttatcagcgaccaaaaaatcatcgagcgtgcgcttatcgacgccaccgagctggttgccgccagccgttccagggcgcttgagctggtcagcgacatcgcaatgatcaaccaggaatacctggaaaagagctgatattgatagggtttaagtca

SEQ ID NO: 1898 - protein, 216 aa, Corynebacterium glutamicum
IGEEVLAGRQAYVVCPRIEGEGGVLEIHAYLSEQVYPGLNVGMLHGRMDTDLKDSVMQEFAQGEIDILVATTVIEVGIDVANATVMLIREAERFGVSQIHQLRGRVGRGQHDSLCLLHTTFDEDSPQGQRLAAISTTTDGFQLSELDLQVRQEGDVLGTRQSGSDTKLRHLSFISDQKIIERALIDATELVAASRSRALELVSDIAMINQEYLEKS

SEQ ID NO: 1899 - DNA, 164 bp, Corynebacterium glutamicum
  CDS (1)..(141): RXA00726
cacgaaatgggcttcgcccacgaagtcgccgaccaggtcgtgttcatggccgatggagttgtcgttgaagccggaacccccgaacaagttctggacaatccaaaggaacagcgcaccaaagacttcctgtcttctctgctctaaccttttcgggtcttaaaaaa

SEQ ID NO: 1900 - protein, 47 aa, Corynebacterium glutamicum
HEMGFAHEVADQVVFMADGVVVEAGTPEQVLDNPKEQRTKDFLSSLL

SEQ ID NO: 1901 - DNA, 702 bp, Corynebacterium glutamicum
  CDS (101)..(679): RXA00740
gttataaatattaaagtacgctaaccatgggtgcagggggagacttctacagcagtcatggtccacaccacgactgctgtatatattaaggacgtaactcatgttgaagaataaaactcttgcgctgctggctgtcagtacgctgatgtttggcttatctgcttgctctagtgatgctgacggcccggacagtagcggtgctagtagtagcagtactggctcatcttctgcatcggctgacacaacagattctgcagctgttgataaggatgctcaattagacacctttatgcgttctgctgtggctgatggatcatctgctgctgtggctgtggacaacgctgtaggtaagggctttgataaagctgatgcgcaggcggctgcggagcgcttgggtgatggtttccaattcgctgcggattaccaggctgttggctatttggaatcttggtactttggtggcgcgcgaagcgagaagcttgacgaggtgcgtagtgatgtcatcgctcatttgtctgaattgggatttacagatttagaggctgaatcctcggcatctcgtattacattaggtgattactgtgatggggtccctgagtattgtgagttgttttttgatggcgaatctcctgacttgtatgacatgggtacggagcttgactcgtataagcccactgaataaagctatttcacttaaagcac

SEQ ID NO: 1902 - protein, 193 aa, Corynebacterium glutamicum
MLKNKTLALLAVSTLMFGLSACSSDADGPDSSGASSSSTGSSSASADTTDSAAVDKDAQLDTFMRSAVADGSSAAVAVDNAVGKGFDKADAQAAAERLGDGFQFAADYQAVGYLESWYFGGARSEKLDEVRSDVIAHLSELGFTDLEAESSASRITLGDYCDGVPEYCELFFDGESPDLYDMGTELDSYKPTE

SEQ ID NO: 1903 - DNA, 1056 bp, Corynebacterium glutamicum
  CDS (101)..(1033): RXA00741
tggtgatcactaggtccacctcgtcttgcatggtggtcacctcagtccagaacgcattgattgacaccgatcaaatgtttgatggattatgatatttagcatgactgattctctgcttgtatccatcagaaaaggcttaatagaagagcgtccattaacggagcttcttcgggcgtgtatcttccttggaagtgatactaactcggactctttacaagagtgggcgaaaaatgaattaaatggttatggctccattgatggtattccggaatatcgcaaattgaaaggacctcctgtattcgcgaaaattcaagctggtaattcaataatgtctaatatggtactggggccacataatgttcctgaaagagctcgtaagtatttccctgaagagctgcattttgatcagccgattcaaacgctaattgaatggtcgactaggcaggatgggattaatttatcgcccccgaatttacttcgggtccgcgatcttcataatgatcagtacgcgccattaaatcaaattttgaatttaaatgtttacttagataactcttatttttcgggaattgtggaccgcatccgaactctaatgacttccatgattgccgacctcacacacgcaactcctctggatgaactaccaagcagcgaaaaggttaatgccacggtcatgaagcacattgaaaataactacgaaactacaatcactcaagccaatggagctgtagccattggtaacagcgctaaagctgtgcagaagggattgtccgtggatgacctactgaagattatgcagaccattaatcctgaaaagttcgacttaggggaagctagagctgaagccgaagaaagcattcaatccatcgcggatgagttgaagaaggagtctccgaataaaggttttatccagaatgcttttgaaaagttgaaggaactcagcataaaagccggcgataaagccttcactacaatgttaaatcttgtaggtaaacagataatcgaaaacatcccacaactggtttcaggtggctagagaaattcaaggccgtcagc

SEQ ID NO: 1904 - protein, 311 aa, Corynebacterium glutamicum
MTDSLLVSIRKGLIEERPLTELLRACIFLGSDTNSDSLQEWAKNELNGYGSIDGIPEYRKLKGPPVFAKIQAGNSIMSNMVLGPHNVPERARKYFPEELHFDQPIQTLIEWSTRQDGINLSPPNLLRVRDLHNDQYAPLNQILNLNVYLDNSYFSGIVDRIRTLMTSMIADLTHATPLDELPSSEKVNATVMKHIENNYETTITQANGAVAIGNSAKAVQKGLSVDDLLKIMQTINPEKFDLGEARAEAEESIQSIADELKKESPNKGFIQNAFEKLKELSIKAGDKAFTTMLNLVGKQIIENIPQLVSGG

SEQ ID NO: 1905 - DNA, 1773 bp, Corynebacterium glutamicum
  CDS (101)..(1750): RXA00742
agaggggttttttagtgaaaatgataaaaccacttttacagatggacacatagatattagtaatgatgcttctggagctaagcgtagctttgggggtcgggtgaatgttcagattaaagggcgaaaggttaatgccaaggctgccgacttaaatagctatccggtctcagtagttgatctacgaggcttcgtgacactggctggtctcttattttttgtggttgatattgataagaaatcaaataagaaatatccaaagtatgttcttttgaaaccgttttatattcatgatctactgagtaaagcgaagccgggccaaaagacaattagcgtccgcttaaaacggttaccatctgatgaagatcgaatggaagccataatcgcattagcgctcgcatcgaggcaagaaaagatagtcgagaaccccagtaactatctctatgaaaatatggaatcaattactgttaaatcggctgaaccccttaatagggataagctggctgtatatgatggtagttcgccagaccattcgatcattattcgtactggggatggaattgaacagttcgtcaatgccaccgtagaaataatacccccgaatatgcagtttcatcaagccaattataatgtttcgtgtaatggggtcgtctatgacaatgttttgcatcgaaacattgatgatgagcacattgaattgaaaatcggaaaggggattactctccgcctacaaaagctcgccattgatgctccggggagcgttacggttgagtttcaagatagtcttcctgaacggttaaaagacattgagttcttcctaggagtgcttcaggcgaatacgttttttattaatgaagaacctgttgtgttgaagattaactcgaaccggactgtggctgaccttaaggatgaagcgggtgttcttcgtcagttggtagaaatagctaaccatttcaatattgatccgtcccttattcgaattggtgagattacagaaaaacagttctggcagttggatattgtgtatcgaacagccgttaagggagaatacgtaaagaatttagaggttaaagatgagactagacttatattgcagccttttggtcgttggaatcttgcgttgatagctcaccctggtgatgttgcaggggagtggacttatcatgaagtaatttccaagcgtcatcattttgctatgacaccttcaacggatcggagcgactcctcaatcgagcgagtgacgccgtacgagctcattgataatcgatggcttccatcagtattgaatctgcatttggataagcttgttgatttctattcagcgcttgaagaaactgttgatgttgataatctcgccacatggatggtgcttcgcctaattaaggcagctgattctgagcagagcaggaaaactgcatttcttatagcagctcaagctctcaatgattggctcgtggaacgagatcgagaagagtcgccaatttacaggcttaatggttggcaaattttgtatcgccaaactggattactggattcacaaagaacagaaattcgatcttttaggcataatcttgatcaaacaatgcacccagacaactatagcgagattatgattggttgcgctttgcttcttgacgatagagaagaggcgaattttttgcttactcagctttcggttgatcgacgcgcagtttttaatgaatggccgatagctcaattgatgacgggtgccctaaaagaagagattgaaaaatgagttctgagatcttgatttaa

SEQ ID NO: 1906 - protein, 550 aa, Corynebacterium glutamicum
VNVQIKGRKVNAKAADLNSYPVSVVDLRGFVTLAGLLFFVVDIDKKSNKKYPKYVLLKPFYIHDLLSKAKPGQKTISVRLKRLPSDEDRMEAIIALALASRQEKIVENPSNYLYENMESITVKSAEPLNRDKLAVYDGSSPDHSIIIRTGDGIEQFVNATVEIIPPNMQFHQANYNVSCNGVVYDNVLHRNIDDEHIELKIGKGITLRLQKLAIDAPGSVTVEFQDSLPERLKDIEFFLGVLQANTFFINEEPVVLKINSNRTVADLKDEAGVLRQLVEIANHFNIDPSLIRIGEITEKQFWQLDIVYRTAVKGEYVKNLEVKDETRLILQPFGRWNLALIAHPGDVAGEWTYHEVISKRHHFAMTPSTDRSDSSIERVTPYELIDNRWLPSVLNLHLDKLVDFYSALEETVDVDNLATWMVLRLIKAADSEQSRKTAFLIAAQALNDWLVERDREESPIYRLNGWQILYRQTGLLDSQRTEIRSFRHNLDQTMHPDNYSEIMIGCALLLDDREEANFLLTQLSVDRRAVFNEWPIAQLMTGALKEEIEK

SEQ ID NO: 1907 - DNA, 546 bp, Corynebacterium glutamicum
  CDS (101)..(523): RXA00743
attttggcgtagtgtttcgggttttataggttgagattgaaataccaagacaaggatggacatcatgtcagcgcatctaccttctcatcatgatgagttagtgcagcacttagttcttgcggatgtaaagtatcgggagctcagtgcgttatcggtcaaaattgaggaaccatcagatcgtcctgagtttaaacttggagttactgttaacgacaagagtaaagacgaagaaggtgtgccgcgaatcattgaggtttcattgagggtgtccatcgaggttcccgacggaaagataacggtagagcctgaagcaatctatttgattcctgagaataaggtttatttaacggaatctgatgcaatggtggattattttaacaaccatgcgatttttactctggtgccatatgcacgacaggccgtgtctgatttagggcagcgtgcattccacacgcagatcctcatgcctgcgttaggtcctggtgatttggtttttagtaaatcgacggcctcacgagaatggtagagaattacctgatagttgca

SEQ ID NO: 1908 - protein, 141 aa, Corynebacterium glutamicum
VQHLVLADVKYRELSALSVKIEEPSDRPEFKLGVTVNDKSKDEEGVPRIIEVSLRVSIEVPDGKITVEPEAIYLIPENKVYLTESDAMVDYFNNHAIFTLVPYARQAVSDLGQRAFHTQILMPALGPGDLVFSKSTASREW

SEQ ID NO: 1909 - DNA, 657 bp, Corynebacterium glutamicum
  CDS (101)..(634): RXA00745
tttgacgtgggatggccacaccggtgacggggtcaatgtgcagaatctgtgcagtggtgagttcagcattgttttccgcatcagataacgcggtgggcgagtggcttatctgtacggatctgccgatgggatgcttaatacagatggttttaatatgtttccgcgtgcgtcgtacaccattcttggccctatggatgctgacgcggtcggtgtgtaccaacagctactgaacagcacgattcccatggatttggcacgtcttgtaaccacgcataattccggtgcaagttatcttcgccgcggtgctaccaacgtagtttttgaaacgaatcttgccctcggtgtgaatccgtatatgaagaaacgccgagcaacagaagcacaacgtggtaagaagcgttttaaacgagacagtcattacggcggtggcactgtgaccacaggtactgctgatttggatgtggtggcgatgcaggcgcgggcagagcaccgggaagaaaggttgggagaaaaatctacccgcaagaaagaggagcttgctgcagtagaggcgaaagagttagctgcgaagaagggtccgcagactgtggaagaaggtcttgctgcggtggagaagaaacacctggcgaagcggtaggcgacgtggttggcggtggg

SEQ ID NO: 1910 - protein, 178 aa, Corynebacterium glutamicum
VAYLYGSADGMLNTDGFNMFPRASYTILGPMDADAVGVYQQLLNSTIPMDLARLVTTHNSGASYLRRGATNVVFETNLALGVNPYMKKRRATEAQRGKKRFKRDSHYGGGTVTTGTADLDVVAMQARAEHREERLGEKSTRKKEELAAVEAKELAAKKGPQTVEEGLAAVEKKHLAKR

SEQ ID NO: 1911 - DNA, 1314 bp, Corynebacterium glutamicum
  CDS (101)..(1291): RXA00746
aaactacgttggtagcaccgcggcgaagataacttgcaccggaattatgcgtggttacaagacgtgccaaatccatgggaatcgtgctgttcagtagctgttggtacacaccgaccgcgtcagcatccatagggccaagaatggtgtacgacgcacgcggaaacatattaaaaccatctgtattaagcatcccatcggcagatccgtacagataagccactcgcccaccgcgttatctgatgcggaaaacaatgctgaactcaccactgcacagattctgcacattgaccccgtcaccggtgtggccatcccacgtcaaaacattctgctgggtgaggattttcagactatggccagctcttttagtcaaatccgccatggatggggtatcacccagctcatcggacaagaccccaacagaaaccaaccaatccgctctgctgatacgtggacagtgactggatcgactggactcaccggctttaatactgctacgcataatacagatgacacagacgccactgccgcatataccatgccggcaagcgatcctgccgtaggactatgcgcactggaatccaacaaagacgcaccggtggatgaatttcgcgatctcagcctcagtgctttacgtaccgctacggtcatgtcaagctctggctccgccgtgattactatgcatgatcctatggtcatgagcaccactggcgcattggaagcacgtgcatacgttgacggcgaagtcatcaaccagcacgatcttgactcactgcgtgaccagctaggtattactacagacagcgcagataccacccctgccctacctgctgatcccttggcagcattgggcttgagcacaccaactacatcagctcttgtcccaggtcttgccgagctggactgcctcaacactgatcaagctcgcacctggcatgaccgtgacaacagcattggcactggtaaaccagctattcttgccgtgattaacgccgagctcgctgatgattacaccctgcagatcctcaaaaatagcactgcgacccccaccgactccaccgactccagcgatactgctgaacgcttcgtagcgcagctacctgcggaaacagcctttgtgcttattgatccggacatcggcgctgtgaccgatctgttctttatcaacagcataaatcaggatctccccgcaccgacaacccagatcaactcagtagcggtagatcaacgtgaccccaacatcatctacgcgacctttgccaatgatgaccgcgtgtaccagctcatgctgggttaaccgcgacccgtttttatctg

SEQ ID NO: 1912 - protein, 397 aa, Corynebacterium glutamicum
LVHTDRVSIHRAKNGVRRTRKHIKTICIKHPIGRSVQISHSPTALSDAENNAELTTAQILHIDPVTGVAIPRQNILLGEDFQTMASSFSQIRHGWGITQLIGQDPNRNQPIRSADTWTVTGSTGLTGFNTATHNTDDTDATAAYTMPASDPAVGLCALESNKDAPVDEFRDLSLSALRTATVMSSSGSAVITMHDPMVMSTTGALEARAYVDGEVINQHDLDSLRDQLGITTDSADTTPALPADPLAALGLSTPTTSALVPGLAELDCLNTDQARTWHDRDNSIGTGKPAILAVINAELADDYTLQILKNSTATPTDSTDSSDTAERFVAQLPAETAFVLIDPDIGAVTDLFFINSINQDLPAPTTQINSVAVDQRDPNIIYATFANDDRVYQLMLG

SEQ ID NO: 1913 - DNA, 711 bp, Corynebacterium glutamicum
  CDS (101)..(688): RXA00747
tgtgctgatccgcgccgtgccaactcgcactgggtcgcactgggtcgcacaaccgcatacacatacacacaattaatcaccctcaacacgaagatttatcatgacatttttgcaccgttccgccagtttccaccctcgtacccacgatcacctcagcgagctcggtcttgatccttataagctctctcaagacatccccactgttatttatgaagtccagccgcacagtgtgttcattttaaaattcaacactgccgatgttcgggtctatcaggaacactccgatctctttgtgcgacatgctgtgcttgttgatccagaacagcgtaaacatgagcatgaccagctccttaaagagattctcgacctcgatgcccctcgtgtcaacgatgatattagtggtcgcacgacagtgtttctccacgataaaacagttgttacgcacagtggtggccccattgcgattattccgcacaatcccgatgtcgccagcgccgctgcgtcagctaataaacacaaacaatctgtgatgacaacatccaggcatccttatgcgcagatgtctctcagcgacatgctgaaacaaggcttcacgctcacacctctagagttcccctactgcgctgttgatgaccccgacagctcacgccacacaatgcacgtcatcaacgttcgagatcatacagtgtgaactaccgcgccgctagagat

SEQ ID NO: 1914 - protein, 196 aa, Corynebacterium glutamicum
MTFLHRSASFHPRTHDHLSELGLDPYKLSQDIPTVIYEVQPHSVFILKFNTADVRVYQEHSDLFVRHAVLVDPEQRKHEHDQLLKEILDLDAPRVNDDISGRTTVFLHDKTVVTHSGGPIAIIPHNPDVASAAASANKHKQSVMTTSRHPYAQMSLSDMLKQGFTLTPLEFPYCAVDDPDSSRHTMHVINVRDHTV

SEQ ID NO: 1915 - DNA, 567 bp, Corynebacterium glutamicum
  CDS (101)..(544): RXA00748
aagccttattctcctcttaactaccatgaggtaaccatctaaagtagatggttgcaacaacttttcattacatcaacatgtttaaaaaaggacactgattatgacttacttcgcactcgttgctcgcaattacgctgagacaggtgtctctgttgaattccatgaggtcgatgatgacgcagataactcaaatggccccaacaacacaagcaatttacctctaaaacttcttcgagatcactcttttgatgccactgttgtctatggtgacctggtgcttcacacctcagcacatctcagagatacggctatcgccaactcagacaaccgtccgcgagtagtgaccacagctcaaaaattctttgattacatccgcttagccaccagacacggtgctatccacgacatgatcaataacgcgccagataccggcactgacatcgttgttattacggccactaatgatgctcttattagtgatgaatcagaatactatgacgagctttttcatattctcgaatccgcacagggtgtgattcttaaatgattgattaattgatatgatta

SEQ ID NO: 1916 - protein, 148 aa, Corynebacterium glutamicum
MTYFALVARNYAETGVSVEFHEVDDDADNSNGPNNTSNLPLKLLRDHSFDATVVYGDLVLHTSAHLRDTAIANSDNRPRVVTTAQKFFDYIRLATRHGAIHDMINNAPDTGTDIVVITATNDALISDESEYYDELFHILESAQGVILK

SEQ ID NO: 1917 - DNA, 822 bp, Corynebacterium glutamicum
  CDS (101)..(799): RXA00749
cgtttcgatcatttgtaacattcttattacaagactggaaataaaggtgagtcaatcatacagtcagatgtggtcatcggcaaaacagaaaggaatcccgatgttacgaaaaacagttaccggtggaattgttgctcttattgcgactgccactctcatgaattctgtctcttctgctgaagaggtatccggagatgtctcagcagtagatctcgcatttgcagaattcgaacgtacaactgcagaggacgtggccaatggagtgccagaggctatagctaatgcagaaaaaatttccaatttcactccgagcgaactagagggcttcaagagtcttttagctagtgatgcagtgctgaggtcggtctctggagaagaaattctcccagataatgttgaagtggttcagacggacaacgtaggcgacgaagatccaaatgtcatttctccagcagcctggcagggttctgattatattgaggggtgtttaacgaatactctctacggaattgaagtcctaaaggtttgtactggtggaacctactactccaatgtaggaatcgctacttctgtcagcaatcctcgcagttacgtaaagtataacagtgctccaggattggcagtgacgacaagcaatccacgtggaggtatagagggtggtcttgcggccttctatggtgatgttaaccttgttgcttttccaaatattccatgggtgggaccaattagttcttctgcaggaactcaccgcgttgtcgctagatcatttccgaattcagtggtgcttaacgtctactactaatcgttttttagtttgaaaca

SEQ ID NO: 1918 - protein, 233 aa, Corynebacterium glutamicum
MLRKTVTGGIVALIATATLMNSVSSAEEVSGDVSAVDLAFAEFERTTAEDVANGVPEAIANAEKISNFTPSELEGFKSLLASDAVLRSVSGEEILPDNVEVVQTDNVGDEDPNVISPAAWQGSDYIEGCLTNTLYGIEVLKVCTGGTYYSNVGIATSVSNPRSYVKYNSAPGLAVTTSNPRGGIEGGLAAFYGDVNLVAFPNIPWVGPISSSAGTHRVVARSFPNSVVLNVYY

SEQ ID NO: 1919 - DNA, 951 bp, Corynebacterium glutamicum
  CDS (101)..(928): RXA00751
cgcagcaaccccgtccatgagggcagggaacgccacacatcctgtacctatactgtgaggtggcatagagtatctctaatttagaaagtggtgtagaagtatgttggtacgttcacgcacgttggttaccgctgcactgtcatgttcactgttgttcggagcaacggtaaatggcacgggtgttgcgattgcatatgaaaatgtgtctatggctgctcagtatgaaccacggtatgaatccttagaaacgcgtctcggttctagtggagtctttcccaagtcggttgaacagtctgttgaaaaccttgctgaattaccagaggagactcgatttttacttgagggtgattcgttttcaattattattgatgatggtctgctcgcttctcgattggacccaaatacaggggagattcgacatactcttggggcttcggggatcagctacacccctggtgaaatgaaacgatcttatacagatcgagtgactgtcaaggtggtctaccctgatgggtcatttgatagagtgacaccccattcagtggtttatgtggctgacagtatttactacggcattgaaagcacgggttatcctaaagtccgcaatggtcagactgtcaagatcccattgagggtgacggatggtggtacaggagcggttggtggggtcccacagggatcgaaggtggtccgagatcgttacggctcaattgagaatgcggagttgatgggtgcaatcattctcatagatgagaagactggcgatctcaccttcacggcgcctgatgatcgaaccggtcaactgtggtttcgtacagaagtgactttcccggatggttcggactcagaggttcaatatgtgatcgaggtgacggatcagcctgaacctgtggatgtcattcgtcctgccggatcgtctctgagttcttgatttatgcctgagacttaagc

SEQ ID NO: 1920 - protein, 276 aa, Corynebacterium glutamicum
MLVRSRTLVTAALSCSLLFGATVNGTGVAIAYENVSMAAQYEPRYESLETRLGSSGVFPKSVEQSVENLAELPEETRFLLEGDSFSIIIDDGLLASRLDPNTGEIRHTLGASGISYTPGEMKRSYTDRVTVKVVYPDGSFDRVTPHSVVYVADSIYYGIESTGYPKVRNGQTVKIPLRVTDGGTGAVGGVPQGSKVVRDRYGSIENAELMGAIILIDEKTGDLTFTAPDDRTGQLWFRTEVTFPDGSDSEVQYVIEVTDQPEPVDVIRPAGSSLSS

SEQ ID NO: 1921 - DNA, 552 bp, Corynebacterium glutamicum
  CDS (101)..(529): RXA00752
aaggtcagccgtatttcggtcagtcagcaactaactacgcttatcttccgtgtacgatagaccgtagttaacataaggaatggaataggagaattgcggcatgtattccgacaagctgattctcttgttcctttctgagcaggattcaagctatgaatgctgcgtaggtttattagatggctcagatggacttgattatattgaaaagcttctgaagggtaggaagctgaagaaccattttcttgaatgggaagatattaacaaggctgatgttgctcgtgaagaaatatataaagggcaattggtgcatctggtgtttgtgacggctctttccacgcctggtgaaatttcttttgtttttccaggtcaatctcttatgagtgcaacactcgaagaagactttgctgcgcttgtgctcgaagaggagcgcacatcatttagacctgaactgtctcacctgtggtcactccccgtagggtgggtagctccggggcttgagggtttcgtggagcgtaattccgaggcagcttgaaccaccgctttctgagccgg

SEQ ID NO: 1922 - protein, 143 aa, Corynebacterium glutamicum
MYSDKLILLFLSEQDSSYECCVGLLDGSDGLDYIEKLLKGRKLKNHFLEWEDINKADVAREEIYKGQLVHLVFVTALSTPGEISFVFPGQSLMSATLEEDFAALVLEEERTSFRPELSHLWSLPVGWVAPGLEGFVERNSEAA

SEQ ID NO: 1923 - DNA, 1377 bp, Corynebacterium glutamicum
  CDS (101)..(1354): RXA00757
caggtttagcgaattcaatttctaccactgctcgaggggaatgtgctaattcaagggttgtgacctcgagcaactttttattccgctcgatcaaaacaacgtgagtttcggcgtcgttaagcgccccgatgcgtgctacgcgctttttgccatcctgatcaagcgcaaccaggcgaccgcggtttctgcgccaatggcgcggcagcgtcagtgggttgtccacgcccggcgtggacacttcgagcgtgtaacccgctccgaagttgagctctccgcgctgctcggcggcgtcgaaaagctctccgatttcttggctgaatacttccagctggtcgagatcggggcgggaatccgaatctaccttgatggcgacggcggattttggacctgctttggtcactttcaggccctcgaggtcgaatttgtgggatgcggcgagcggctcgatgagcgcagacagaatttcagtggttggaaaagccataaagacaaggataacctgccggcaaaaatcatcgggctattacactgtgaagccatgcgtaggcgtatcccctctgtccttggtgtttctcttctggctgcctttttggtggcgtgcaccccctcccccaatccgaatgcggcgttggcccagatgtatcaggatgcgctttttgattcccaggcgatgtcagaggccgagcctgagcttgccactttgcgcagtcagcacgcagatgaattattggccgagattcggcgtatttgtggctttgatgaaggccaggttccggaatcgtgccaggtaacggttcctgcgatcgctattctgcccaccgatgatccagagaagtatgtcaacgacagtcaggcgttgatccttgataatttggatgacattccggaagattccgtggctttagtggttgagcaatacatcgcgcaggcggaatttgctgaaggatctgaggtgtccgttcctgttgatttggagctcaccgaggcagaattagctgctgcgaaggacttggcggaccgcgagttttccgccgcgtggtctttgggcgtggctttggctcagcttccggaaaccgaccgcgaggaggtggaaacggcgatcagcaaccaccatgaccgcgcgtcgcagctgcaaattattacctccggcactaccccagcgccaggttacgtgagcgagctgcccgaccccaccgacgagacttcagcgcgaagcaacattgaaaccgtcgaaaacaacgtcacccaggcctggcatgcagctgcaagcgccgcaaccaccgacgcctggcgtgtcttctgcgcgcacatcgccggcgataccgcacgcgaattaacgcttatcgacgtctcctagcagtttcactgccaattttt

SEQ ID NO: 1924 - protein, 418 aa, Corynebacterium glutamicum
VSFGVVKRPDACYALFAILIKRNQATAVSAPMARQRQWVVHARRGHFERVTRSEVELSALLGGVEKLSDFLAEYFQLVEIGAGIRIYLDGDGGFWTCFGHFQALEVEFVGCGERLDERRQNFSGWKSHKDKDNLPAKIIGLLHCEAMRRRIPSVLGVSLLAAFLVACTPSPNPNAALAQMYQDALFDSQAMSEAEPELATLRSQHADELLAEIRRICGFDEGQVPESCQVTVPAIAILPTDDPEKYVNDSQALILDNLDDIPEDSVALVVEQYIAQAEFAEGSEVSVPVDLELTEAELAAAKDLADREFSAAWSLGVALAQLPETDREEVETAISNHHDRASQLQIITSGTTPAPGYVSELPDPTDETSARSNIETVENNVTQAWHAAASAATTDAWRVFCAHIAGDTARELTLIDVS

SEQ ID NO: 1925 - DNA, 906 bp, Corynebacterium glutamicum
  CDS (101)..(883): RXA00763
agcgcgatttgagtgcttttaatacgatcggaagtattcatgtccccaggttagccccaagtttgaatctcttgcaggaacgtggggtaaagatatagatgtggaaaaatccagaaaacgacttgtgaccatcgcagcatcgacaattggggccgttgcggtggctggcggcgctttttggatcgttgatgcttccatcgctgcgcacgcggaacgcaacttgtctaaagcagttgcggaatccgcagatcttgaaaacgacccgcgagtattcctcggcagctccatttactccacggcgttttttaccggcaaactcgactccgtaagcatcgacatgctggacgtggaaatccccggcgtcggcatggtgaatgcacgcacagaggtagaaagcgtggaagtctcacgggatcaaatcctctccggtgacctcgacggcaccactgcggaaaccttcacgcgcacattacgcatggacggcgtcgcaatcggcgcgcagctcggaatcaccgacctcgacatctcccaccccatcgacatctccccctccggcggcatcacctcagaagcgctcctgacaggaaccccaccagacatggaagacccggtcagtgtgctggtcacccttcgcctagtcggctcagaattccagatgctgccgtacgagcttatcgacgcaccctccggactcaccctcgacgatgtcgcccccgacttcacgtggaaaatcgacaccctgcaactacccctcgcagatcgggcaatggcggtttacctatctggtggctccgtccatttccaatctgaagcccgcaacgtccagctcaccacccgcgaactatcaccactagctgcaccggaagaaaactccgatgaatcctagatgccaaacgtgcgcacccg

SEQ ID NO: 1926 - protein, 261 aa, Corynebacterium glutamicum
VEKSRKRLVTIAASTIGAVAVAGGAFWIVDASIAAHAERNLSKAVAESADLENDPRVFLGSSIYSTAFFTGKLDSVSIDMLDVEIPGVGMVNARTEVESVEVSRDQILSGDLDGTTAETFTRTLRMDGVAIGAQLGITDLDISHPIDISPSGGITSEALLTGTPPDMEDPVSVLVTLRLVGSEFQMLPYELIDAPSGLTLDDVAPDFTWKIDTLQLPLADRAMAVYLSGGSVHFQSEARNVQLTTRELSPLAAPEENSDES

SEQ ID NO: 1927 - DNA, 810 bp, Corynebacterium glutamicum
  CDS (101)..(787): RXA00765
acggaaaagtttctgcgtctgcgtggtcgactcaggattcgcaatcagaagaacatgcacgttatctaagagtagtgccaaaacgctagtcttgagtgtcatgagcgaaaattccacccctaataatccagtcgtcccaggtgcaggcgcagacggcccatcactgtccgattctgcaagcatcagcggatccgacgcagtaaacctcgctgccgaacaatccaagagcaccgctcaccgcaacatcccaggcctaggtgaccttcctatccctgacgacaccgctaacctccgcgaaggccccaacctccacgacggactcctcgcgctcctccctctcgtcggcgtctggcgcggcgaaggccaagccgacaccgcagaagacggacaatacgcattcggccagcaaatcaccttcgcccacgacggtgaaaactacctctccttcgaatcccgcatgtggaaactcgacgaagaaggaaaccccaccggcgtcgaccagcgcgaatccggcttctggcgcatcaatctcaaagatgaaatcgaattcgtctgcacccacgccggcggagttgtagaaatctactacggccagccactcaatgagcgcgcctggcagcttgaatccgcatctaccatggtcaccgccaccggcccatccacccttggaccaggaaagcgtctctacggactgcttccaaccaacgaactcggctgggttgatgagcgtctcgttggcgacgccctcaagccacgcatgtccgcacagctcacccgcgtgatcggctagttttttctagttcaccgtca

SEQ ID NO: 1928 - protein, 229 aa, Corynebacterium glutamicum
MSENSTPNNPVVPGAGADGPSLSDSASISGSDAVNLAAEQSKSTAHRNIPGLGDLPIPDDTANLREGPNLHDGLLALLPLVGVWRGEGQADTAEDGQYAFGQQITFAHDGENYLSFESRMWKLDEEGNPTGVDQRESGFWRINLKDEIEFVCTHAGGVVEIYYGQPLNERAWQLESASTMVTATGPSTLGPGKRLYGLLPTNELGWVDERLVGDALKPRMSAQLTRVIG

SEQ ID NO: 1929 - DNA, 411 bp, Corynebacterium glutamicum
  CDS (101)..(388): RXA00781
tttcttaggaaataaaacagggtgtctttgtgttcaaaaggtataaaggaagagtagttccggttaattccaccgggatgagataccgaggagaacgcacatgagcgagaacaaaaacattgagattgtccacaatgaaggacagaagcgctttgttatcagcgttgatggaacgccagctggatttgccagctatttagacggcccggatatccgcaacttcaaccacactgttattaagcctgaattccgtggacagggactgtctgcgccattgatcaagtttgctttggatgatgcacgtgagtccggtatccgtattcatgatgcttgctctgcagtcgctggcttcattcagaagaaccctgagtataaggatctaaagaactagctggcacaggggggtggttc

SEQ ID NO: 1930 - protein, 96 aa, Corynebacterium glutamicum
MSENKNIEIVHNEGQKRFVISVDGTPAGFASYLDGPDIRNFNHTVIKPEFRGQGLSAPLIKFALDDARESGIRIHDACSAVAGFIQKNPEYKDLKN

SEQ ID NO: 1931 - DNA, 348 bp, Corynebacterium glutamicum
  CDS (101)..(325): RXA00788
cgcatccctctagttttccatcacctcaatgaacggcgctaactccggttcattgcgcaattgatccagcactgcttgcagtgaggcctcattagttggcatggcctcctccatcaacatcggagtgttcaaccttggaaatgctgttgctgcctggcttgctggtgcaaccatcaccacttcccttggactcacatcagccggattagttggcggtttgatgacgtccctcggactagtgttggccatcgtggctgtggttttgcgtcgaaaagcgcaaggcacccaagcgaccatcagcgttgtggagcaccagcccgcccaataaataatttctctcttctaatt

SEQ ID NO: 1932 - protein, 75 aa, Corynebacterium glutamicum
MASSINIGVFNLGNAVAAWLAGATITTSLGLTSAGLVGGLMTSLGLVLAIVAVVLRRKAQGTQATISVVEHQPAQ

SEQ ID NO: 1933 - DNA, 567 bp, Corynebacterium glutamicum
  CDS (101)..(544): RXA00804
aatctagtgcaagttccagcgaaaaccttccaaaactgaccaagtttaagaagattcgctaccctatgaatcagttgtaggagtaagaggggagttagagatgaagatcagaagtgcacgtgaaatcgcggagtggttcgttgcctggggagatgaactcgatgctgaagtctcccctttgaaattgcagaagctcctttattactcccagggtgagcatatagctgcaacagggcgaaaacttttctcggataagattctggcgtggcagcacggacctgtcactccgggcgtttattcagatacaaaatcatacggccgaaacccaattgatcctgatgagtttgtgtcagatgaatttaactgggatgactactcagatgtgtcagatgagcttgtaaccgtatggcgaaaatacggcatctattcggcgtgggcactgagggaaaaaactcacagtgaatcgccgtggctcgatgcctgggcacaagggcaaaatattgaaattacagatgctgcgctgaaagatttcttcttggtgcattagaaatttgaaaaagaaacgaa

SEQ ID NO: 1934 - protein, 148 aa, Corynebacterium glutamicum
MKIRSAREIAEWFVAWGDELDAEVSPLKLQKLLYYSQGEHIAATGRKLFSDKILAWQHGPVTPGVYSDTKSYGRNPIDPDEFVSDEFNWDDYSDVSDELVTVWRKYGIYSAWALREKTHSESPWLDAWAQGQNIEITDAALKDFFLVH

SEQ ID NO: 1935 - DNA, 1005 bp, Corynebacterium glutamicum
  CDS (101)..(982): RXA00805
tgctccgctgacagtggtgcgcctgagcagcccaaaagagacaaagcgctggttgagggcatatggggaaagcgtgaaactctgatagggtgccatatccatggcagaaagttttatagaggtctcggcggggcatgcggatcggcggatagataagtttttgcgggcacagctaaagggcgtgcccgcgtcgttgattttccgtcaaatgcgtaaaggcgacattcgggtgaatggtcgtaaagtggatccgaattaccggttgcaagaaggcgaccgaattcgaatgtggcagatggatttgctggcagatttgccgccaccggtcgtcgataagcatatttttaaggctgtcgcagacagcgtgctttttgaggacgccgaattactggtgatcaataagccagctggaattcctgtgcacggtggcacggggcacggcggtggcgtgattgaggcgctgcggcagaagtttccgcaggaacgcgacctggaattggtgcatcgtttggatcgggacacctcaggtttgttgctggtttctaaaacgacatctgtgttgcgcgagttgcaggaaattttgcgagaccgcgaagaggagatttttcgggggtatttactcaaggtcgagggggcttggcctggcgatttgcgacaaattgatgtgccgttgaagcggacggagacaactgttgtgccacattcggatggtttgcgggcgcggacgtattttgaggttgtaaagcgtttgccgggtgcgaccttggtgaaggcgcagttggcgaccgggcggaaacatcagattcgggtccatgcgcagtatgcgggtcaccctattgttggcgatccacgatacgggtcgcgtgggggcagagctgcgacgatgcatttgcatgcggcggaattggtggcgcctcgtggggcggggaagcgtcagaaattcactgcaccgttgccgaaggagtggggtatgggacgggtctgagtcgggccttcgtggaatcg

SEQ ID NO: 1936 - protein, 294 aa, Corynebacterium glutamicum
MAESFIEVSAGHADRRIDKFLRAQLKGVPASLIFRQMRKGDIRVNGRKVDPNYRLQEGDRIRMWQMDLLADLPPPVVDKHIFKAVADSVLFEDAELLVINKPAGIPVHGGTGHGGGVIEALRQKFPQERDLELVHRLDRDTSGLLLVSKTTSVLRELQEILRDREEEIFRGYLLKVEGAWPGDLRQIDVPLKRTETTVVPHSDGLRARTYFEVVKRLPGATLVKAQLATGRKHQIRVHAQYAGHPIVGDPRYGSRGGRAATMHLHAAELVAPRGAGKRQKFTAPLPKEWGMGRV

SEQ ID NO: 1937 - DNA, 701 bp, Corynebacterium glutamicum
  CDS (1)..(678): RXA00808
gctggcttcaatgagatgatgcgtggcctgcgtgaacgtcagcgcgtccgtgaccttttcggtcgctacgtgggcgctgaagtggccaagcgtgcgctggaggaacgccccactctgggtggcgaggaccgtaaggttgccgtgttgtttgtcgatgtcatcggctccactacctttgccgtcaaccacactcctgaagaggttgtggaggcgctcaatgagttcttcgagcacgtcgtggaggttgtgcaccgcaacaagggtgttatcaacaagttccagggtgacgcggcgttggcgattttcggcgctcccctgcccctgtctgatgccaccggtcatgcgcttgcggctgcccgtgagctccgcgcagagctgaaagatctccagctcaaggccggaattggtgtggctgctggccatgtcgttgctggtcatatcggcggtcacgcgaggtttgagtacactgtgatcggcgacgcggtgaaccaggctgcgcgcctgacggagatcgcgaaaacgaccccaggccgcaccgtcaccaacgcttccacgctgcgtgaggccaacgaggcggagcaggctcgctggacgctcatgaagtccgtggagctgcgcggacgtagccagatgacgcagattgcgcggcctattcggccgacgttggcggataggtcctaatacgcttttcgacgcaaaaa

SEQ ID NO: 1938 - protein, 226 aa, Corynebacterium glutamicum
AGFNEMMRGLRERQRVRDLFGRYVGAEVAKRALEERPTLGGEDRKVAVLFVDVIGSTTFAVNHTPEEVVEALNEFFEHVVEVVHRNKGVINKFQGDAALAIFGAPLPLSDATGHALAAARELRAELKDLQLKAGIGVAAGHVVAGHIGGHARFEYTVIGDAVNQAARLTEIAKTTPGRTVTNASTLREANEAEQARWTLMKSVELRGRSQMTQIARPIRPTLADRS

SEQ ID NO: 1939 - DNA, 1182 bp, Corynebacterium glutamicum
  CDS (101)..(1159): RXA00812
ttcacaggtgagcgtatcgcgggcggttgagaggtgagttatccacaggccgcagagggggtcgttgaaagcacgtaagcctcaggccacagtaggtgccatgaacaccatcacacaccaagcaattctcatcgcagtggaagatccggtcctgcacccagaggccatgcacgtagctgcagccactggtcggccggttattgaaacaacaaatttgatggacatctccaggcattttcaccgcacatcggcagtgctcattgatgcgtcgatggcctctcaattatcacctgggaaacgccgcgacagggtgtttcttctcgattctgatccagggccctctgattggaaaacggcgatgaaaatccacgctgagcaagccatgttgcttcccgctcaggcaggggagttgctcagcgctttaggcagagatgacaaacaactgccggtggcttcgggccatgtcatcggtgttgccggggtggtgggaggaacaggcgcgagcacgtttgctgcggcgctcgcaaagcggcgtgcggagtcagtcaccactgtgcttatcgacgccgacccttcctctggcggcatcgacctgttgctaggaatcgaagatgtgcccggcgcgcggtggcctgatgtggggttgcgtcgcggaactgtccaggctgctgatgtgttgaaagcgctgccgagcactcctgatgaggtcgtggtgttgtctacggcgcggtctaatattctggatccttttgcattatccgagtctgatgtttcagcggcgattgattgtttcttaagcgccgataggtcggtggatgtggtggtggatctgcctcatgcgagagtgcatccagatattgcggagcgcttatcccacctggtgttagtcatccctgcagaggtccgagcggtggctgctgccagggctcggtgtctggaattacaacaattgcatgtatccatcacgtgcgtgttgaggcatcgcgggtggtcaggtttggatgttgcagaagtggaagagattttaggtgcggatattaccgcggaggttggctcgatccagcggctggctaagtccgtggagatgcatgggctgaccggttctttgccgagggttttaagctcagcatgcgacgcggtcctcggggaggtggcggcatgactgacattgatctggtggtg

SEQ ID NO: 1940 - protein, 353 aa, Corynebacterium glutamicum
MNTITHQAILIAVEDPVLHPEAMHVAAATGRPVIETTNLMDISRHFHRTSAVLIDASMASQLSPGKRRDRVFLLDSDPGPSDWKTAMKIHAEQAMLLPAQAGELLSALGRDDKQLPVASGHVIGVAGVVGGTGASTFAAALAKRRAESVTTVLIDADPSSGGIDLLLGIEDVPGARWPDVGLRRGTVQAADVLKALPSTPDEVVVLSTARSNILDPFALSESDVSAAIDCFLSADRSVDVVVDLPHARVHPDIAERLSHLVLVIPAEVRAVAAARARCLELQQLHVSITCVLRHRGWSGLDVAEVEEILGADITAEVGSIQRLAKSVEMHGLTGSLPRVLSSACDAVLGEVAA

SEQ ID NO: 1941 - DNA, 897 bp, Corynebacterium glutamicum
  CDS (101)..(874): RXA00814
gccgcaggctagctcaactcggggtgctccgcggaaatcctgtgaccacgcaggtggtgtgggatttggaccacggcatgcacgaagggagcgaagaggcatggtttatgccctaggccttcttagcgtggcggtgttgatctctggttcaaggggccccggcgcgcgtaccaggccaccaacacctgggaatggcgtccatctattcgccctaattgcactattttgcctggccacagtgctatttatcgtcgttgacgcctacacgatgatcgccggcatcatcatcgccacaactctattctggtatctccgccagacacacgccgcagcccaacgcaccaaacaatccctccaattagccagcttcttaagcctctgcgcaggcaatttacgcgccggggtcaccatggtcgacgccatggactacgcgctcgacaacaccacgccggacaaattcttaagccccacgttgcagaccgcagccaggcaggcgcgctcgggcggcagcgggccgcgagtgcttatcgacgcctccctccccgatcttcaacgcctcggccatttgtgggaaacatcagaacgacacggcatcccgctggtcgccctcattgatcaaatgaggtcccggatttcatcgaagcaacgccacggcgaatccacccgagctgcactccaaggaccgcaagcaaccgcagtgatccttaccgtgttgccactagcaggaatgctcatgggcacagccatgggagcaaacccccttgggctactcaccggtggtgggatcggtgggttcctgcttgtcatcggtgtgggcctcgatgctgcagggtttgtgctcacccacaaaattctccagagcgcgagcccctcatgattacagcactagttcttgca

SEQ ID NO: 1942 - protein, 258 aa, Corynebacterium glutamicum
MVYALGLLSVAVLISGSRGPGARTRPPTPGNGVHLFALIALFCLATVLFIVVDAYTMIAGIIIATTLFWYLRQTHAAAQRTKQSLQLASFLSLCAGNLRAGVTMVDAMDYALDNTTPDKFLSPTLQTAARQARSGGSGPRVLIDASLPDLQRLGHLWETSERHGIPLVALIDQMRSRISSKQRHGESTRAALQGPQATAVILTVLPLAGMLMGTAMGANPLGLLTGGGIGGFLLVIGVGLDAAGFVLTHKILQSASPS

SEQ ID NO: 1943 - DNA, 696 bp, Corynebacterium glutamicum
  CDS (101)..(673): RXA00815
ccggtggtgggatcggtgggttcctgcttgtcatcggtgtgggcctcgatgctgcagggtttgtgctcacccacaaaattctccagagcgcgagcccctcatgattacagcactagttcttgcagcagtggccatgttcctcggttcacccaaccctggagttcgcggtggattgataagccccaaatccggtaaaagcctgcgtatccgagctggcccaaaaaagctgggcaacgctgacccagtggatgtctctgcagatatcgaactgttttcagcgtgtttggatgcgggtttaaacacacgtgatgcagcgcaggtggtggctcatgttgcagccattacgcaccgcgaactgtggacacatgtggtggcattgctatcgattggagtgagtgcccctcaagcattcgccctgatggcaggagttgatgggctggatgaactagccaatttagccaccgtgtcgcacaggtcgggcagtgcattaagtgatgggtgcaggaacatttccacctcgttgttggcctctgctggtgacaagcgcaccgccgcagcagaacgcgcaggagtgttcatcgccctgccacttgctctgtgtttcctccccgcattcatgattgtcgggcttgcaccagtggtgctcagcttgggtacgcaacttatcaatttctagaaaacacacacaggagaaaa

SEQ ID NO: 1944 - protein, 191 aa, Corynebacterium glutamicum
MITALVLAAVAMFLGSPNPGVRGGLISPKSGKSLRIRAGPKKLGNADPVDVSADIELFSACLDAGLNTRDAAQVVAHVAAITHRELWTHVVALLSIGVSAPQAFALMAGVDGLDELANLATVSHRSGSALSDGCRNISTSLLASAGDKRTAAAERAGVFIALPLALCFLPAFMIVGLAPVVLSLGTQLINF

SEQ ID NO: 1945 - DNA, 420 bp, Corynebacterium glutamicum
  CDS (101)..(397): RXA00816
atgctcaccgcaacagccactatcccggcaccgattgggcaggtgagcgcgagtgcggtgttcccggtggaaaactagctgtgcaaatgacgaaggctacatgaccatcgccagcgctggtgtcgcctccatcctcattagcctgctggtggtgctggcctggcaggcgggaaacctcgtggccagggaacaagcacaggtagcggccgatgtttcagctgttgccggagcctacgcctttgcccgcggggaactacccgacgctgcctgcgccaccgcgaaacacacagccgaagcaaacaacgcacaactagaaaactgcgcaacagaaggggaggatctcacgctcaccgtcaccgttcgtggacaagaagcccacgcaaaagcaggacctttatgaggttcccaacaaggtcacca

SEQ ID NO: 1946 - protein, 99 aa, Corynebacterium glutamicum
MTIASAGVASILISLLVVLAWQAGNLVAREQAQVAADVSAVAGAYAFARGELPDAACATAKHTAEANNAQLENCATEGEDLTLTVTVRGQEAHAKAGPL

SEQ ID NO: 1947 - DNA, 654 bp, Corynebacterium glutamicum
  CDS (101)..(631): RXA00826
tcggcgcgcgcgatctggtgctcatcttggtgtgtgctgccatttccgcgatcgctctaaccgtgtccattcagactggtttctttaagttcttgggcacatgatcacagttttaattgatggacaatccggtgcgggcaaaaccaccttggcgggtgagttagctgcccgcaccgggtttcagttggttcatttggatgacttttatcctggttggactggccttgaagcggcatcggagattgttgcacgccatgttttggacgcggacaaccccggtttcttcacgtgggattggcacaacaattgccaaggcgattggatcaagttggagcctggtcgaagtctcattatcgaaggctctggatcaatcactgctgcaacaaaacgcaaggcatcgctgttgggcgagctggtgaccgttcgtatcactggtcctgaggctttaagaaaacagcgcgccctcaaccgcgatcctgattacgcaccattttggaaagtgtgggcgcagcaggagcaacgccatttctctttaggcgttgaggtggatcatgagattgtgctaggttctgatgaggcttcgggacgacccgaagaaatctatgacagcctgggaacggcccagagttcttaagaaagtttgactagagaaca

SEQ ID NO: 1948 - protein, 177 aa, Corynebacterium glutamicum
MITVLIDGQSGAGKTTLAGELAARTGFQLVHLDDFYPGWTGLEAASEIVARHVLDADNPGFFTWDWHNNCQGDWIKLEPGRSLIIEGSGSITAATKRKASLLGELVTVRITGPEALRKQRALNRDPDYAPFWKVWAQQEQRHFSLGVEVDHEIVLGSDEASGRPEEIYDSLGTAQSS

SEQ ID NO: 1949 - DNA, 846 bp, Corynebacterium glutamicum
  CDS (101)..(823): RXA00830
tgatggtggctcgattgtattcgagggcagccccgcggaactcatcaaaactgatactccaacaggacgccaccttaaagcttatgtagattagtttcttatggaaaaccctggtgatctcggcgctatgccacagtacggttttgagcatatttcgatgctcatcaccgctgtggttttagcgattcttgtcgtccccattgctcgtcgattcaacttcgcaccggcatttggctgggtgctactcatcgcaacacttctgtcgaacctgtggaattttatgcccggctattacacgctggaccaatcttggccattccacttctcagatgcattgcgcattattgctgccatcgcattgattaatcgcgcgcggtgggcagtttcagtgactattttgtggggcaccacgatcaacctgatgtcactgctcactccagatgttcagtatttacaggttccctggctggagtttttaatgtactggtttatgcacatttctgtgttcctagcagctataattctcattttcgcttttggagaaaagccagggctgtccggagtggttatgtccgttgcagtggcgattagctggggcatcatgtgcctcatggtcaacgcatttttgggaaccaactacgggtacctctccacagaaccagaatcagcgtcaattctggatttgttgggaggatggccgttctacatcgtcgcggaagtattactcctgtgtgcagtgtgggctttgtggtcttatctgattgataagctgcctatcacgtatcgccctgcttaccgtccgaaaactcggaaggccgctgcgtaaccgccctctacctcgagaaa

SEQ ID NO: 1950 - protein, 241 aa, Corynebacterium glutamicum
MENPGDLGAMPQYGFEHISMLITAVVLAILVVPIARRFNFAPAFGWVLLIATLLSNLWNFMPGYYTLDQSWPFHFSDALRIIAAIALINRARWAVSVTILWGTTINLMSLLTPDVQYLQVPWLEFLMYWFMHISVFLAAIILIFAFGEKPGLSGVVMSVAVAISWGIMCLMVNAFLGTNYGYLSTEPESASILDLLGGWPFYIVAEVLLLCAVWALWSYLIDKLPITYRPAYRPKTRKAAA

SEQ ID NO: 1951 - DNA, 726 bp, Corynebacterium glutamicum
  CDS (101)..(703): RXA00853
ttggatccagttgagaaatttcagcccccatcccccacatgaacgctgttcaaaacatccagcttgcttgttgaacactgttcaggtgtatgattttttcatgcctacatcctcttctcctgcaactgtgactccgctaaagaagcagtcttcacgtaaacagctccaagacatcgcgcttattgcagtttttgcagcactgatcattgtgcttgcttttgtttccatcccagttggcacagcgggagtgcctattgttttgcagaatgcctccatcgttttggctggcctgattcttggtggtcgacgtggttttctcactgctttgctgttcctggcactcggcctgattggcctgcctgtccttgcaggtggtcgtaccactttggccgcacttgctggcccaacagctggctacatcgtgggttacctcatttccccacttgttgcaggcatcatcgcttacctcgcacctaaaaagcgtggcgctggaatgttcatcgttttaggcctggcgggtctcgcgggtctgatcacccaatacgcttgcggcatcgtgggtctcgtccttcgtgcgggtctaagcttgagtgaagcaacaattgctcaaggtgcctttgtgctgccagatttggccaagatcaccgtcatggtcataatcgccgctggagttcatgcagcattccctgacatccgtaagaaatagttccaacccacttttcctca

SEQ ID NO: 1952 - protein, 201 aa, Corynebacterium glutamicum
MPTSSSPATVTPLKKQSSRKQLQDIALIAVFAALIIVLAFVSIPVGTAGVPIVLQNASIVLAGLILGGRRGFLTALLFLALGLIGLPVLAGGRTTLAALAGPTAGYIVGYLISPLVAGIIAYLAPKKRGAGMFIVLGLAGLAGLITQYACGIVGLVLRAGLSLSEATIAQGAFVLPDLAKITVMVIIAAGVHAAFPDIRKK

SEQ ID NO: 1953 - DNA, 426 bp, Corynebacterium glutamicum
  CDS (1)..(426): RXA00861
atggctcctcacaaggtcatgctgattaccactggtactcagggtgagcctatggctgcgctgtctcgcatggcgcgtcgtgagcaccgacagatcactgtccgtgatggagacttgattatcctttcttcctccctggttccaggtaacgaagaagcagtgttcggtgtcatcaacatgctggctcagatcggtgcaactgttgttaccggtcgcgacgccaaggtgcacacctcgggccacggctactccggagagctgttgttcttgtacaacgccgctcgtccgaagaacgctatgcctgtccacggcgagtggcgccacctgcgcgccaacaaggaactggctatctccactggtgttaaccgcgacaacgttgtgcttgcacaaaacggtgttgtggttgatatggtcaacggtcgcgca

SEQ ID NO: 1954 - protein, 142 aa, Corynebacterium glutamicum
MAPHKVMLITTGTQGEPMAALSRMARREHRQITVRDGDLIILSSSLVPGNEEAVFGVINMLAQIGATVVTGRDAKVHTSGHGYSGELLFLYNAARPKNAMPVHGEWRHLRANKELAISTGVNRDNVVLAQNGVVVDMVNGRA

SEQ ID NO: 1955 - DNA, 680 bp, Corynebacterium glutamicum
  CDS (101)..(664): RXA00862
aggtagttccttggcgcttgtggtttccgcctctttacttttaagtgcttgtgatggaagcggctcaacgcctacaacctctgctagtcctgctccagttgtgacagaaactgaaaccgctaacccggtcaccacaactcgcacgccttcagatgctgccccgtcgcctaccacttcagagcccactggttcagagtccaccaactccccttcccccactgctttgccgccgttgggttccccgtcgatggatcagaagcagcaggctcaagttggtgactccgatatgtcgatcgctggcatccgcgttgccgagcacgaaacgttcacacgagttgtttttgatatcgccggtaatggccaacctggttggtgggtcgattgggccactgatccaattcagcaggcgtcaggtcttccagttgagatggctggtgattccttcctcaacgtcaatattcaaggcactggatatcctgatcaggttgtcgttccaggtatcgataccggatcatatcctggtgcaggcattgttgaagacatcaacttcaccagtatttttgaagcccgttcccaagttctcattggtgtatctggtcaaccccgaaattactcggtctcattgctgcaggaaccaaccaggcttgtggtggacatcgttcactagcgctggaacgccg

SEQ ID NO: 1956 - protein, 188 aa, Corynebacterium glutamicum
VTETETANPVTTTRTPSDAAPSPTTSEPTGSESTNSPSPTALPPLGSPSMDQKQQAQVGDSDMSIAGIRVAEHETFTRVVFDIAGNGQPGWWVDWATDPIQQASGLPVEMAGDSFLNVNIQGTGYPDQVVVPGIDTGSYPGAGIVEDINFTSIFEARSQVLIGVSGQPRNYSVSLLQEPTRLVVDIVH

SEQ ID NO: 1957 - DNA, 1212 bp, Corynebacterium glutamicum
  CDS (101)..(1189): RXA00874
agctgttccctaccattgctgaacgggagtggattgtcactttagcccctcacggattcttctggtttgatctcaccgccgatgaaaaggacgatatggaatgagcattggccaacacatcatcaccgagcgtttctacggcgccaagtcccacaccatcgacaacgtagatattgtgttgtcccgcgaatgtggcgagaacactttggctgtagtgcgcatcaacaatgcgctgtatcagttgttggtcaatgatgatggcaaagatgttctcaacgaccacgtagaagaggtcggtgcgagtttcggagcatggactggcagctctgcttttcccattggccctttcactccactcggcacagaacaatccaatagctctttcatcaccgccgacaataaagcgatcgtgaaatacttccgcaaattagaatccgggcaaaaccccgatgtggagctaatttctaaaatttcctcctgccccaacatcgcgcccatcctgggtttttcctccgctgagatctccggggctaactacaccctggtcatggcgcagcagtacgttccaggtttggatggctggtcacacgcgctgactactacctctggcagctttgcagaggatgcagaaaagatcggcgaagccacccgcaatgttcacactgctcttgcatcggccttccctactcgggtagttcccgtagaagcactcgccgatgcgctcactacccgccttaatgaactaatctcccaagcacccgaaatcgcccgcttcaaagaagcagccatcgacctctaccaatcgttggaaggcgaagcccacatccaacgcatccacggtgacctccacttggggcagctcatcaaaacccccgaacgctacatcctcatcgatttcgaaggcgaacctgcccgcccacttaatcaacgacgcctccccgactctcccctgaaagatctcgccggcatcatcagatccatcgactacgcagcctacttcgacggcgaacacacccaatgggccaacgaagccaccgcgctattcctcgacggctacggatcaattgaagaccaagaactcctcaatgcctacattctggacaaggcgttgtacgaggttgcctatgaaataaacaaccgccccgactgggtgaaaatcccactcgaggcggtcgaaaggcttctagactagttagttactctgcgtcaaac

SEQ ID NO: 1958 - protein, 363 aa, Corynebacterium glutamicum
MSIGQHIITERFYGAKSHTIDNVDIVLSRECGENTLAVVRINNALYQLLVNDDGKDVLNDHVEEVGASFGAWTGSSAFPIGPFTPLGTEQSNSSFITADNKAIVKYFRKLESGQNPDVELISKISSCPNIAPILGFSSAEISGANYTLVMAQQYVPGLDGWSHALTTTSGSFAEDAEKIGEATRNVHTALASAFPTRVVPVEALADALTTRLNELISQAPEIARFKEAAIDLYQSLEGEAHIQRIHGDLHLGQLIKTPERYILIDFEGEPARPLNQRRLPDSPLKDLAGIIRSIDYAAYFDGEHTQWANEATALFLDGYGSIEDQELLNAYILDKALYEVAYEINNRPDWVKIPLEAVERLLD

SEQ ID NO: 1959 - DNA, 1878 bp, Corynebacterium glutamicum
  CDS (101)..(1855): RXA00876
ttgactatctcgaattaggtgagggctgggagccagaaattttgtgctctgatgctgttgaaattttagaaaatctcatcaaggaactaaggggaattccatgacattgaaaattgatccctcgtccatcagtagtgctgtgtctcgcttgaatgagcttcagcatcaagctattactgcatctcaagtgggaatgaaatcaacaattctatccgcgttttcgcccgtctctggactcgatcaattgggttccggtcacgggaatgtgattaatggtggggcaggcgcagcaaactctgtgctgaattcctatgccgaacaaatcgagtggttgtctgcggctttgcaggcttctggtgcggctttgactggccaggatgaattattcgctaggggtatggatgtagcggataccggtggcagggttgtagaagagtcagtaatgttcccggcgcggccggcacctcggtttgagtctttcgtttttaatccaccagctgttagtccttcgttgtcgttggatgcgttgtgtagtcagttttccggaaccaactcgggggcggttttggaggcgcaggggtcttggggctctatggcgtcggctattagcaatgtgtcggcttcgttgtcgtcgattgctggtgagattttggcggagaactcaggcgaaacgtttgagcaggctgctgctcggattaatgaggtggcggctgcgggggcgacgtttgctgcgaatgcgaaaatgatgggggcgtcggtggggacgctgaatcggatttatatggggcatcgcatgcaggtgtttatggctgcgacgtcgattaaggcgattttggatccggtgcagaggcttgctgcggagagggcgtttttggcgtcgtttcaggctacttttcaggcggatgtgttgacgggtatgcctcctgtgagcaatttgatgcagatgaagggggcgaatggttctgcgggggaaattgctctggggatggatgagattgctggcagtgggcaggcatggtctgcggcggggttgactccgtcgggggctgcgcagggtggtgtcgccaatgcgggcagtatcgcgccggatgcagcggttcaaggtgctgcggggcagagtggggttggaagttttggcactgtcactgatcagttggatggcatcaatattggggatatgttgacctctgctgcctcagctgggcagagccttgcgaatggtttggcgatgcctacttctacgcctaattcggcgtccggtgcgattccttcctcgatgtctgcggcatcgccgcttggtgcgtttggcagcggtgcagggttgggcgcacagggtggctcgattggatcttcggcacctggagcgatcagtagtcgagcggccggatccgcaggtggttcggtaccgggaatgactggtggtcctggcgcgccggggattacctcggattcgttgatgggagctcgaactcatggtgcttcttccgcgggagctgtcgctccgatgatgggtggtgctggcggaatgtctggtggcgtcgttggtgcaggtggtactggttctcagagcaagtatgcgcgccagactggatcgtcggttggatctagttcgcagtcgggttctggcctggggatggtgggatcagggagtgggaagccgtcgataagcaattttgggcgcggcatgatgccgatgatgcccatgatgcccatgggaggcgccggcggtgggcagaagaataccggcaaggtgaaaacggtgacgtctgcggtggaggaagaccgcaatttggcggcgctgctgggtgatcgggggccggttgttccgggtgtgattggtgactgggtgaggggctaacgcaacaatgtgtctaagct

SEQ ID NO: 1960 - protein, 585 aa, Corynebacterium glutamicum
MTLKIDPSSISSAVSRLNELQHQAITASQVGMKSTILSAFSPVSGLDQLGSGHGNVINGGAGAANSVLNSYAEQIEWLSAALQASGAALTGQDELFARGMDVADTGGRVVEESVMFPARPAPRFESFVFNPPAVSPSLSLDALCSQFSGTNSGAVLEAQGSWGSMASAISNVSASLSSIAGEILAENSGETFEQAAARINEVAAAGATFAANAKMMGASVGTLNRIYMGHRMQVFMAATSIKAILDPVQRLAAERAFLASFQATFQADVLTGMPPVSNLMQMKGANGSAGEIALGMDEIAGSGQAWSAAGLTPSGAAQGGVANAGSIAPDAAVQGAAGQSGVGSFGTVTDQLDGINIGDMLTSAASAGQSLANGLAMPTSTPNSASGAIPSSMSAASPLGAFGSGAGLGAQGGSIGSSAPGAISSRAAGSAGGSVPGMTGGPGAPGITSDSLMGARTHGASSAGAVAPMMGGAGGMSGGVVGAGGTGSQSKYARQTGSSVGSSSQSGSGLGMVGSGSGKPSISNFGRGMMPMMPMMPMGGAGGGQKNTGKVKTVTSAVEEDRNLAALLGDRGPVVPGVIGDWVRG

SEQ ID NO: 1961 - DNA, 501 bp, Corynebacterium glutamicum
  CDS (101)..(478): RXA00881
acctgaccgaggaagccgacgagctgaccccaacgctgaaggtcaagcgcaacgttgttgttcgccgttacgcagacgccatcgaccacatctacaaccgatgagtaacacagagacccaatttgattgggatggatcgacatggacccgcaccgaagtcggcgaagcaccaacacgcttcgctgtgggcgtgatggaggatttcgcctacattgcagccactggcacggacggggatgaagagttctttactttgggctcaaatccgggtctgacgtttggtgatcccgagtggcttttcgctcaggataatccgcagtatgtggtggagtgcattggccagcagggaaccgagccggcagccctgaaggttgtagataaatatttgtcgcgactatctgatgaggagtcacgtggcgaacccacgcggattctcaatgaattggtctcggcgatggagttgccggcattgccgtggtgatttttctcgggctttagtga

SEQ ID NO: 1962 - protein, 126 aa, Corynebacterium glutamicum
MSNTETQFDWDGSTWTRTEVGEAPTRFAVGVMEDFAYIAATGTDGDEEFFTLGSNPGLTFGDPEWLFAQDNPQYVVECIGQQGTEPAALKVVDKYLSRLSDEESRGEPTRILNELVSAMELPALPW

SEQ ID NO: 1963 - DNA, 801 bp, Corynebacterium glutamicum
  CDS (101)..(778): RXA00882
aaatagctgagaaattggctagaggacggctagcaaaccggatcaagaccggctagaactttagctacgaggcaagaaaaggaaggtgtgttggaacgcgatgagcagtacaaccgcacagctacgccaccgagagctgacccaggagatctacaacatcggcgacgaggtcgctgaatacattgagcacatcatggaagcagtctccgactgggatctggagctcgtggaagattgcctcgctgaattcgatgagatcatcactgaagcccgcgatgactcccgcactgttgtggctgaactttcaggcctgcgtcacgcactaaccactggtatccgtcagggcaccgtgagcgctagagccacggtggaggtggacgtcgataagccggaacgcctgaccgcctccgagctggagcgcgacttcgatattgatgccggcctcgttgatgtacgcgatctgtcgaccgcgctcaatgcgcgcacagacgctgtggttaagcgcctggaggccactgtggagtgggtgctggcggaaactgacaaggtggccaacgatctggattccctgtctctgccactgctttatggccgcgttgcagcggtgatcgaaagcgccaccagcgcatggatcaacgcagtgggcaccgccaatccggcgtatgtgcgcaccatgcgaggcagcaacccgccacgtttcctgcttgagcgtgcgcgtatcgacgctgtcgtggcccgggttgcagacaagcttgcgcaaaagcgcaacgctgtttcctagaaatctcggtgcagcaaaaa

SEQ ID NO: 1964 - protein, 226 aa, Corynebacterium glutamicum
MSSTTAQLRHRELTQEIYNIGDEVAEYIEHIMEAVSDWDLELVEDCLAEFDEIITEARDDSRTVVAELSGLRHALTTGIRQGTVSARATVEVDVDKPERLTASELERDFDIDAGLVDVRDLSTALNARTDAVVKRLEATVEWVLAETDKVANDLDSLSLPLLYGRVAAVIESATSAWINAVGTANPAYVRTMRGSNPPRFLLERARIDAVVARVADKLAQKRNAVS

SEQ ID NO: 1965 - DNA, 642 bp, Corynebacterium glutamicum
  CDS (101)..(619): RXA00883
aatatacacaccaaaaactgacatgccccaagcctagtgcctgccccctatacatgattaattgatgttaaacatagcgaattcctaagaacagggtagagtgcagggtatgaaacggaagatggtcgcagcggcgctggcaacagcgcttctttttggggctgcacctgcgcacgcttccgaattggtagagcccaccacagttgcagagtcagtggcactcgatcccaacaaagcaatcaatattctcaccccagatctctgggaagacattgaggcaaaaccaggcgatatcgtccacatcccctaccagggcacccgaaactacgaggacctcaccgtagaagtcgcgaaacctttcgaagatttccaaatcctcgtcggactcgacaacagcatcgtcatcgcagtgccaaagaacttaagtggcgcagcatcagtcgccccagttttcactgtctctgacaaaaacggtgagatcgactctttcaccatcaaagtaagcgtcgagccacgccgccaaagcgacgaagaaaagcgctccgcactatttgatgtcatctctgagcttgcctaccgcatgcctcatctgccattcgtgtcagagttgctgaagtactagaacagtaacgagaaaacccc

SEQ ID NO: 1966 - protein, 173 aa, Corynebacterium glutamicum
VQGMKRKMVAAALATALLFGAAPAHASELVEPTTVAESVALDPNKAINILTPDLWEDIEAKPGDIVHIPYQGTRNYEDLTVEVAKPFEDFQILVGLDNSIVIAVPKNLSGAASVAPVFTVSDKNGEIDSFTIKVSVEPRRQSDEEKRSALFDVISELAYRMPHLPFVSELLKY

SEQ ID NO: 1967 - DNA, 846 bp, Corynebacterium glutamicum
  CDS (101)..(823): RXA00887
aagaaatccgcaaccatcgcagcgacaacgcttccgtgcatcgcgaaggcggagaagaatccggtttctttgacaagctccgaaacaagttccgcaaataatgtcactgccagtatttatctctgattccgcagccggaccaggcgaaaccattgagctcgccggtccggaaggccggcacgccgtcaccgtcaaacggatccaggtaggcgaaaagatttcgcttatcgacggccggggtacagcgcgcacctgcacggtcaccgccttgcagggcaaagaccgcctgaacgctgtggtggatttggtcgaggaaatccccgcaccgaacccacaggtcaccatcgtgcaggctatccccaaatcagagcgttccgagctgaccatcgacctgctcacccaagctggcgccgatcggattgttgcgtggcaagcatcgcgctgcgtagcaaaatggggcggcaaggaagcaaaatcactggctaaatggcaggtggctgcggaagcagccgccaagcaatcgcggcgcgcaacgatccctgaaattcttggcgtagtgggggaggagggcgtcgaaaagcttatcgacgaatccgacctggccatcatcctgcacgaagaagcaaccgccgcgatccgtgaactggaattttccggcaacgtcgtggtgatcatcggacccgaaggtggcgtcgcgccatcggaaatttcacgcttcgtcgacgctggcgcacacaccgtgaaactaggccctgaggtgttgcgcactgcctccgcaggcatggtggcgctcgcagctatcggcgtgctgtctgaccgctggtaacatttctctgacataacctt

SEQ ID NO: 1968 - protein, 241 aa, Corynebacterium glutamicum
MSLPVFISDSAAGPGETIELAGPEGRHAVTVKRIQVGEKISLIDGRGTARTCTVTALQGKDRLNAVVDLVEEIPAPNPQVTIVQAIPKSERSELTIDLLTQAGADRIVAWQASRCVAKWGGKEAKSLAKWQVAAEAAAKQSRRATIPEILGVVGEEGVEKLIDESDLAIILHEEATAAIRELEFSGNVVVIIGPEGGVAPSEISRFVDAGAHTVKLGPEVLRTASAGMVALAAIGVLSDRW

SEQ ID NO: 1969 - DNA, 711 bp, Corynebacterium glutamicum
  CDS (101)..(688): RXA00889
tggtccgccaccaactggttggacacattgtggatgcatacgaagactatgaagaacgcgaggcccgcgaattgaaacgcaaacgccaggagacacggccatgagcattgaggtattcaacgaatcaggatacgacggcgtcaatgaagaaatgctcattgatgtcctctccttcgcactcggggaaatggacatccaccccgacgccgaagcatccatccacatcgtcgacgtcgacaccatcgccgatctccacgtgaaatggcttgatcttgaaggcccaaccgacgtgatgagcttcccgatggatgagctcacccccggctactcccgccccgacggcgccacccccggccccgccatgctgggcgacattgtgctgtgcccagagttcgcggcaaagcaagcgaccaaagcaggccacgacttagcccacgagctagctttgctgaccgtgcacggcagcctgcacctgcttggctacgaccacgtcgatccagccgaagagcgtgaaatgttcgcccttcaaaacgagctgcttgccgattggtacgacaacgtcgaagcccgtggcgtcacctaccagccaaaaccatccggcgccggtgcattccccaccgctgctgatcgtctggaattggacgaaaagatggaagcggatgactctggctttggaggcgttgagtcctaggtggaatcctcagttatatg

SEQ ID NO: 1970 - protein, 196 aa, Corynebacterium glutamicum
MSIEVFNESGYDGVNEEMLIDVLSFALGEMDIHPDAEASIHIVDVDTIADLHVKWLDLEGPTDVMSFPMDELTPGYSRPDGATPGPAMLGDIVLCPEFAAKQATKAGHDLAHELALLTVHGSLHLLGYDHVDPAEEREMFALQNELLADWYDNVEARGVTYQPKPSGAGAFPTAADRLELDEKMEADDSGFGGVES

SEQ ID NO: 1971 - DNA, 720 bp, Corynebacterium glutamicum
  CDS (101)..(697): RXA00893
acgccaacgcagagtgtttaaagaaactggcagttggaaagctgcagttgatttagcctgcgacgaactcaacgacctcaaagcactggactaaatagctatggtggaatcccaacacatcattttcatcccggaatcccaacaaacacccgacgagtttaccgaggtagtcaacgagattcccgccggaatcaaaccacggatcgtaccgtggagcggtagtgtttccgcaggtgtgcaggctgtggaatccatcctcgaccgtgaagaaatccggcgcgtcatcctggtcggcgctggaaccggagctggagtggcgttggaaattgccaagaaccaaccccgccgcgtggaacgcctcgtgctggattcaccgttggtgacctttgatgagaaacaactcaaaggcatgagcaccgcactgaaaatgatgccaggattcttcttccgaaagaagaacaagaaagacctcctgcagcaggtagaagaagcccgtactgcagttccgatgggattttccgagattaccatgccgacgttaatcatccgaggctccgctgcgaaggctggaattgattctgacttggaaaaacaaatcccgagcgctcgggctaccaccattattggtgccaattggctgacttacacaacgcatggacgccaaactggtgctgcgattgcggaattcctcgcccaatagaagggcacgcctaaacgcca

SEQ ID NO: 1972 - protein, 199 aa, Corynebacterium glutamicum
MVESQHIIFIPESQQTPDEFTEVVNEIPAGIKPRIVPWSGSVSAGVQAVESILDREEIRRVILVGAGTGAGVALEIAKNQPRRVERLVLDSPLVTFDEKQLKGMSTALKMMPGFFFRKKNKKDLLQQVEEARTAVPMGFSEITMPTLIIRGSAAKAGIDSDLEKQIPSARATTIIGANWLTYTTHGRQTGAAIAEFLAQ

SEQ ID NO: 1973 - DNA, 714 bp, Corynebacterium glutamicum
  CDS (101)..(691): RXA00895
gtcgcgccggaaagatagactaagccacatgacttcggacatgcagaattctccacagcactcggccacgccttcagaagaaaaacaaggcggactgcccatgcgcggtttggccatgattttgatcgccgtggccgtattgctcgcagcgtgggcactgtggtcaatgcagggcaaagacgacacctccaccaccagcgccggacaaacccagtccacggaaaccaacgcgggaactattgctgaatcttctggctcttcggattccgagcaggcatcagcagaacctggaacctccgaagaaacctctgctgagcagccagctgcagatggcgaagccgctaatgctgctggggccgctgctgctggtggcgctagttcggctaacggcaactccaccccagtgaacactctgtacgtgctcaacaactccaccgtcccacaacttgcagcacgagtggcagacagcctaagcggtgactaccaaaaggtagagtccggaaaccttccagacaccatcattccgcagaacactgtgtacttcaccgctggaaacaccgaagctgaaaaggctgcacgtgaactcgctgaccgcgtcagtggcgtagcaatggaacgcagcgatgcactgccaaccgaaacagaaggcaaagatgccctcgttttggtgctggtccaagacgtagcgctgtagttttctcggatttgttggaa

SEQ ID NO: 1974 - protein, 197 aa, Corynebacterium glutamicum
MRGLAMILIAVAVLLAAWALWSMQGKDDTSTTSAGQTQSTETNAGTIAESSGSSDSEQASAEPGTSEETSAEQPAADGEAANAAGAAAAGGASSANGNSTPVNTLYVLNNSTVPQLAARVADSLSGDYQKVESGNLPDTIIPQNTVYFTAGNTEAEKAARELADRVSGVAMERSDALPTETEGKDALVLVLVQDVAL

SEQ ID NO: 1975 - DNA, 815 bp, Corynebacterium glutamicum
  CDS (37)..(792): RXA00904
aagcagtgcagtaccaggctggaagtgtggacaacaatgattaataccatccgctccgaatggaccaaacttgtcaccaccaaatccttctggtggacaaccgcactaattctggtcttcagcctgggatacgcagcgctcaccggatcactcgccaccggcgaaagctttgcatcactgttccttctcgcaggcagcacagtcaccggcctttacctccttggcttcgtggtgatcatgatccaatccatcatgatgttcaccaccgaatttcgattcggctaccaaacccaaaccttcctcgccacaccaaaacgctgggttgtcgccgtttccaaatggttgctgtacctcgtgttcgccgtagtgttgaccttcatcaccgtgattctgtgcttctatctagccaaagccctggcatcagacactgcaagctccaccctggtggtgtgggaagatacgcaagcacgacgaatcatgtggcaatacccactggcagcagcactattggtaactttctgttccggaattgcgctcctgctgcgtcaaactgcaggagcagtggcactggtgcttatgtggcacttcgctatcgaaaacctcctgtctttcttgccacgcatcggcgaatacgtcggcaagtatggtcccttcaccaacctctacgcattcatcaccgactatcaatcaattgatccaggatggtccaccaccatgggagcggtgtacttcggagcgtgggcattcgtgctgttcgcactcggaatcgtcgtcctagaaaagaaagacgcctaaaatgccctctaaaatatcgc

SEQ ID NO: 1976 - protein, 252 aa, Corynebacterium glutamicum
MINTIRSEWTKLVTTKSFWWTTALILVFSLGYAALTGSLATGESFASLFLLAGSTVTGLYLLGFVVIMIQSIMMFTTEFRFGYQTQTFLATPKRWVVAVSKWLLYLVFAVVLTFITVILCFYLAKALASDTASSTLVVWEDTQARRIMWQYPLAAALLVTFCSGIALLLRQTAGAVALVLMWHFAIENLLSFLPRIGEYVGKYGPFTNLYAFITDYQSIDPGWSTTMGAVYFGAWAFVLFALGIVVLEKKDA

SEQ ID NO: 1977 - DNA, 681 bp, Corynebacterium glutamicum
  CDS (101)..(658): RXA00908
tcggtcctccacctaacaggatccttcacacccttcttttcaatatctagaaaagaccgatccgcccaacatctttttcatgacgcaaaggaccgtgtcaatgtctctctacacccgtactcaaaatacccgtcactccaccatcatcgagttccgccgcgagcagactcgtaatcacacgatggagccaatccagtccgagccacggatctacgctgacgatcctttccgtgcacgcttcggacaccaactcccccgcggacttcgcgaagaagcacgcggcatggaatggcgcaccttcaccaacacctacgcaccaaccggcaacctgcgcatcagcaacctcgagtccgaggcacgccgcggaggaatgttccacttcaacgcaaccctgatcaacaactgccagggcgagcgcaccaccaccgacgctcacatcatggcaaccggcccagtttccgcatgcaccaacttgcttgccgacgccggccgtcgcgttgaaatcctcgaattccaccaattcgacatctttgaagcaaccgtcaccttcatctacacctgcaacaacgtttcccgcacctgggcaatgggcttcggcggtacccctgagcagtccgctgcttccgcaatgagctccgcagctcacttgctctacggataggttgcaataacattcattcc

SEQ ID NO: 1978 - protein, 186 aa, Corynebacterium glutamicum
MSLYTRTQNTRHSTIIEFRREQTRNHTMEPIQSEPRIYADDPFRARFGHQLPRGLREEARGMEWRTFTNTYAPTGNLRISNLESEARRGGMFHFNATLINNCQGERTTTDAHIMATGPVSACTNLLADAGRRVEILEFHQFDIFEATVTFIYTCNNVSRTWAMGFGGTPEQSAASAMSSAAHLLYG

SEQ ID NO: 1979 - DNA, 3714 bp, Corynebacterium glutamicum
  CDS (101)..(3691): RXA00916
agcggatccaacgacacaaatggtggatttggttccagcggcggcttcggcgcgcgataacctgtaacttgcgattaaaaactaacttaaggatttacacatgaagaaagttctcgttgtcggctgtggtggttcaggtgccaaaacgctcgcttatatgatggaccagctcaagaccaccctggcggatagtcttcccgagcgttacccaaatccaaaggaagcaaaacttcctggtgcgtggcagttcgtgtcggtggatgttccgacctccccagaaagccccggcccgaaccttccgaatgttccagaagccggtggacgttatatttcctgtggttcctcggatcgctatgccaccgttgatactgcggtgtccaaccagctctcctccaggggcgcgttgggtggcgtttcttcatgggcgcttcgaaaccctgattctgaaaccaccccaattagtaaaggtgcgggccagtaccgctccattggccgtatgttgatcctgagccgacttcaggaaattcaggctgaattacgtaaatcatgggatgtgttgttcagcggtgagactgaacgtgagctcgctgaccttcgttctgcactgtatggcacgtctgtttccagtggtgaaacctctaaagagcagccaattatcttcggtgtctcctccatggctggtggcgccggtgcttcgatggctctagatatctgccgcctgctcaccggtcttgaaggcaacgcagtgggtctgagctcactgtttatggtgaccccggatatcttctcccagctttccccagaccaggttgccggaactaacccaaacgcgctggccatgtttgccgagctcgcagcagcacagatgggtgcagcttccgaagaagatgcccgactgtttaacgctttgggtgtttctgttggcgatgactccatcccagttggacgtatcttcccagtgggtattcgctccggtgaaaacggcgctctgcttggtgatggcaagccagataccgtctaccgcgcactcggccgtggccttgcagctctgatggctgatgaagtgtccatggacaacttcgagcaattcaccctcggcaaccgtggtggcggaagtgccgatcagagcaagtacgcatggggtgcacaggaagctaagaacattccgtggggcagctacggctactcacaactatccatgggtcgtgatcgctacgcagaatacgccgcccagcgactggcacgctctgccgtggatcgtctgctcaagggacactttgatccaagcaatgatgcggcctctgaccagcagcttcaaaagcgactcgagaacaaccgtccatcgctgatgggcaacctcagcgacgttttgcccgtcaacgcgccggcaggggactggattttccatagtttcaaccagatgattgaaaactggacccagcgtatgaaagcaatcatcaagagccaaattcctgcagctaatggccagcgcggaagtgaatggctcggggatgtccagcgtgctttccaatcatccagccagatgattgataatgactcccgccatgagctctacatgggtgtcgccgactgggccagtgctgatgtgttgcagcgccgagtagtcgagttgcttcgtgatgagatcgcaaaactgggcgttccttacggcgtcagcgtgatcgaatctctcagcgccacaatccaaaaccaactcatcggacagctttctgatctggcaaacaaccgtgcacctgaggctgttcaactagacgatgtcagccgcagtgaactggacaacagcaagggcaggatcgacgattctgacagctacatccaggaaatcgtgtcacgatccactggtcaactacacacccgcgcagtgcaatacattgcggaccacatggcttcggttctggacgatttcctcaaaaatttcatctacccacttcagcgcaccatccaacgtgagcaccactccctagaaaaggactaccagctcaccaacgatgtgaacctgggaatctcccagctgaaaaccaacgttccagcactgtggccagatgaatctcaaactaccgtcccgtcacgtttcagtcaggcagccaacgaagtcttcctgaccgatgtcgcctccttcccggagcagttccaagcacacgtccgctcgtccaccgatgacatcaacgaacaaaacgattactcgagcgccctgcaagaggcctcaactcgagtagtcagcggtgtgtgggaatccaagtccggctctgaaaaagcaccacgcgatctcatccgcctcatcgacgtatgggttgcccgtgacctgaccagggatccgtccggttcgggaagcctccgcgaccctaagcaagcacgctttgagctgaagattgataccggcgaagtactcgagcgctcccgccagtacatccgccgccctggtttctccttccagcagttcatcgccagctcactgcgtgaattcatcaccgcgccgggcttggcagaccacgagcgtcgcgcgcgccgtcagcaggtgctgagcaagttcagtgaggcaatgacctacgcgcttccattggctcagatcaaccctcaactggttcgtgcgctttacggcgatgaagtccgctacaacttcaacttctctcgcatcccatttgccggcgatgagcttggatccagcctggaacaggcagttcgtgattacccgaaccaccgaccagcagatatttccaagccactgggcaaggctttggtctcccaaggtgaagagcgttccattgatatcttcggctcttaccccaactacgcgccgatcgtgtttgactccctgctgcctccaatcgagaagcagtggcgtcagatcaccggcgatcgcacggaattctggcatggccgccgtactcgtcctttgactgctgcacttccaatgacagacctagagcgcaacgccatggtcaagggttggtacatcggtcgtctggtcggacgagtattcttccccgcaactctagacactgcggataccactccagtgcagatctacgatgagaagtctgattcgtggatcaacttctccaccccaatgctcaccccagtgtcccgtttccgtggaagcctcgattggctgccaaaccttctggaatcagcatcattggcatgggcacgggcaggcgagcgtcctgtctttgaatccgtcgagccttacatccagctccgccaactgtgggatgatgctgcgagcccatccttgccaggacgcaccacccgcggtgagaagctgctgcacgattggcttttcgacggcaaccgcatggctggaaacgtcctccagatcccaggaaccgaagctggtgtcaccccagctgcacgttttgaggctgcgaagaacttcctgcagcgccagaacgagatctcgcaaaattacgtcccaagcgacaagcttcgccaaggccgtctgttcaccaccgctgatcgtccatttggcgacgtcaaggatcgtgaactagcagcacagattccagtgtttgctgaccttgcagccgatgtttttgatggcacccaagaaatcatcgacatcctggaaaagtgcttggctgcaggtccaccatcagcacaggtctttgacatgaacgtagctcgccgcgacgtttcttcaggaccttctctacctggtgagggtgagttctaaatgtccgccgcctattcgca

SEQ ID NO: 1980 - protein, 1197 aa, Corynebacterium glutamicum
MKKVLVVGCGGSGAKTLAYMMDQLKTTLADSLPERYPNPKEAKLPGAWQFVSVDVPTSPESPGPNLPNVPEAGGRYISCGSSDRYATVDTAVSNQLSSRGALGGVSSWALRNPDSETTPISKGAGQYRSIGRMLILSRLQEIQAELRKSWDVLFSGETERELADLRSALYGTSVSSGETSKEQPIIFGVSSMAGGAGASMALDICRLLTGLEGNAVGLSSLFMVTPDIFSQLSPDQVAGTNPNALAMFAELAAAQMGAASEEDARLFNALGVSVGDDSIPVGRIFPVGIRSGENGALLGDGKPDTVYRALGRGLAALMADEVSMDNFEQFTLGNRGGGSADQSKYAWGAQEAKNIPWGSYGYSQLSMGRDRYAEYAAQRLARSAVDRLLKGHFDPSNDAASDQQLQKRLENNRPSLMGNLSDVLPVNAPAGDWIFHSFNQMIENWTQRMKAIIKSQIPAANGQRGSEWLGDVQRAFQSSSQMIDNDSRHELYMGVADWASADVLQRRVVELLRDEIAKLGVPYGVSVIESLSATIQNQLIGQLSDLANNRAPEAVQLDDVSRSELDNSKGRIDDSDSYIQEIVSRSTGQLHTRAVQYIADHMASVLDDFLKNFIYPLQRTIQREHHSLEKDYQLTNDVNLGISQLKTNVPALWPDESQTTVPSRFSQAANEVFLTDVASFPEQFQAHVRSSTDDINEQNDYSSALQEASTRVVSGVWESKSGSEKAPRDLIRLIDVWVARDLTRDPSGSGSLRDPKQARFELKIDTGEVLERSRQYIRRPGFSFQQFIASSLREFITAPGLADHERRARRQQVLSKFSEAMTYALPLAQINPQLVRALYGDEVRYNFNFSRIPFAGDELGSSLEQAVRDYPNHRPADISKPLGKALVSQGEERSIDIFGSYPNYAPIVFDSLLPPIEKQWRQITGDRTEFWHGRRTRPLTAALPMTDLERNAMVKGWYIGRLVGRVFFPATLDTADTTPVQIYDEKSDSWINFSTPMLTPVSRFRGSLDWLPNLLESASLAWARAGERPVFESVEPYIQLRQLWDDAASPSLPGRTTRGEKLLHDWLFDGNRMAGNVLQIPGTEAGVTPAARFEAAKNFLQRQNEISQNYVPSDKLRQGRLFTTADRPFGDVKDRELAAQIPVFADLAADVFDGTQEIIDILEKCLAAGPPSAQVFDMNVARRDVSSGPSLPGEGEF

SEQ ID NO: 1981 - DNA, 486 bp, Corynebacterium glutamicum
  CDS (101)..(463): RXA00926
atggagacacctggggctggaaccaccagaaggcaccatcggcgattattagccaccttaggtggccaggatgttccatggtctggcaaactaactaaccatggacatcgttttcctcataattcttctagccatttttatcgttcccactttcctcatgagccgccgccagcgcgcacggatgactgaaatccaaaagctgcaggactctgtcgtcccaggcgaccgcatcgtcaccaccgcgggacagcacgcaacggtcatttccaccactgcagaaaccgttgatctagagatcgcgccgggtatgatcagcacttttgaaaagcttgctatcgtgcgtgtgctgtccaaggccaatgaacctcagatgttggatgagccgacgctgtttgatcagccagaagacgatcagccgaacgatggtttcgatggacgcactgacggacatcctgagaatcgttagaaattaataataattcagca

SEQ ID NO: 1982 - protein, 121 aa, Corynebacterium glutamicum
MDIVFLIILLAIFIVPTFLMSRRQRARMTEIQKLQDSVVPGDRIVTTAGQHATVISTTAETVDLEIAPGMISTFEKLAIVRVLSKANEPQMLDEPTLFDQPEDDQPNDGFDGRTDGHPENR

SEQ ID NO: 1983 - DNA, 876 bp, Corynebacterium glutamicum
  CDS (101)..(853): RXA00930
acggcgcaccacacatttggtggtgtattgagctatctctgggctgcgtgagaaaccattttccggtggatgatggaagctagacgacgaaagggagcatatgtctggccactcaaaatgggcgactaccaagcacaagaaggctgctaacgacgccaagcgaggcaaggaatttgccaagctgatcaagaacatcgaagttgcggcacgtacaggcggtggagatccgtctgcgaacccaacgcttgatgacatgatcaagaaagccaagaaggcttctgtgccgaacgataacatcgaacgtgcacgcaagcgtggctccggcgaagaagctggtggcgctgactggatgaacatcatgtacgagggatacggccccaacggcgttgccatgcttatcgagtgtctgaccgacaaccgtaaccgcgcagctaccgaagttcgcaccgcaatgaccaaaaacggtggcaacttgggcgagtccggttccgtgtcctacatgttcacccgcaccggtgtcgtcaccgtacaaaagggcgatcttagtgaagatgacgtgctcatggctgttcttgaagctggtgctgaagaagtcaacgacaacggcgatctgttcgaggttacctgcgcaccaactgacattcaggctgttcgcgacgcactcgtggaagctggcattgaagtagaagattctgaatcagacttccgggcatctgttcaggtccccctggacgctgacggtgcacgcaagatcttcaagcttgtggacgcgttggaagattccgacgatgtgcaaaacgtctacaccaacatcgacttgagcgatgaggttttgacagagctggaaaacgactagttcgtattttccgcactccg

SEQ ID NO: 1984 - protein, 251 aa, Corynebacterium glutamicum
MSGHSKWATTKHKKAANDAKRGKEFAKLIKNIEVAARTGGGDPSANPTLDDMIKKAKKASVPNDNIERARKRGSGEEAGGADWMNIMYEGYGPNGVAMLIECLTDNRNRAATEVRTAMTKNGGNLGESGSVSYMFTRTGVVTVQKGDLSEDDVLMAVLEAGAEEVNDNGDLFEVTCAPTDIQAVRDALVEAGIEVEDSESDFRASVQVPLDADGARKIFKLVDALEDSDDVQNVYTNIDLSDEVLTELEND

SEQ ID NO: 1985 - DNA, 597 bp, Corynebacterium glutamicum
  CDS (101)..(574): RXA00932
cccaattaatttatgcacttcggtgaggttactcacaaagagtagcgtgcaaagcccagcaataaggtgatgtttcaacgattaggttacggtaggggccatgacgccacagaaacttcaccgttttgcagcccttttagaaatgggtacctggaccctgctgatcatcggcatgatcttaaaatacagtggagtgacagacgccgtaacccctattgccggcggtatccacggctttggcttcctctgttttgcagccatcaccatcaccgtgtggatcaataataagtggacattcccgcagggtatcgcaggtttgatcgtctctgttatcccgtgggctgcattgccatttgcattgtgggcagacaagaagggcctcgttgccggcggatggcgcttttcagatccgtccgaaaagccacacactttctttgacaagatcttggctcaattggtcaggcacccaatccgatccattttaattctgctggtgattatcgccgtcgtcttctctatcttgctggcgatgggaccaccttatgatccagatgccatcgcaaacactgtggattaaacaacagcctccttcacatg

SEQ ID NO: 1986 - protein, 158 aa, Corynebacterium glutamicum
MTPQKLHRFAALLEMGTWTLLIIGMILKYSGVTDAVTPIAGGIHGFGFLCFAAITITVWINNKWTFPQGIAGLIVSVIPWAALPFALWADKKGLVAGGWRFSDPSEKPHTFFDKILAQLVRHPIRSILILLVIIAVVFSILLAMGPPYDPDAIANTVD

SEQ ID NO: 1987 - DNA, 585 bp, Corynebacterium glutamicum
  CDS (101)..(562): RXA00933
ccgcggggctaaagcgcgcaaacgcctacgactggtcgacagtatccacccaggtcatggcagtctatgaaaccattgcgatcgacaaagtgaggcttggatgacccttgtttacctcctcatcgctgtcgttgtcaccgcaactgttctgtgggcgtatttcacagcacaacgcctcaaccggctccacatccgcaccgactcagcaagacaagccctgcaagcagcactggatcgccgagcagcactagtaggtgcgttgttgcccgatgcagcagaagcctcaaaacgcgctgaggcaattcccctggaatactcccgcttctcccaacgcgcccgcgccgaacgagaaatctctgaactcatcttgaaacaggggaagacccttccagattccatcgtggacgctgccacccgcgtggaattagcccaccgcttctacaacgaagccgtcagtgacacccgcgatcttcgaacccgattgatggtcagatccttccgactcggcggcaccgcacccttgccggagtacttcgaactactcgatacagatctgctgacttaaatgtaaaaaagcctccttca

SEQ ID NO: 1988 - protein, 154 aa, Corynebacterium glutamicum
MTLVYLLIAVVVTATVLWAYFTAQRLNRLHIRTDSARQALQAALDRRAALVGALLPDAAEASKRAEAIPLEYSRFSQRARAEREISELILKQGKTLPDSIVDAATRVELAHRFYNEAVSDTRDLRTRLMVRSFRLGGTAPLPEYFELLDTDLLT

SEQ ID NO: 1989 - DNA, 519 bp, Corynebacterium glutamicum
  CDS (101)..(496): RXA00940
tgctcaacggcacgctgaagggcacggacatggacatcatcacggcaggcgacccggacgtggtcgcggtggacgtgctggcagaggcgatctgcgcaatgtgattttggtgctgctggaagctgagtcaatgcgcggctaccagatcatcaccaccatcagtgagcaaacagaaggtaactggactccaagcccaggaaccatctatccaaccttgtccatgcttgaagatgaaggcctgatttccatctcccatgaaatgggcagaaaaatggcgcgccttacagaagaaggcgcgcaggaagtggcaaagaacaaggatgcgtggggatcaattctggaggcttatcgcaatccagaatcccgagaggtgcgggtgtttaacattcgctctgagtttcacaaggtcagggaagcagcgaaagctgctcccgacgataaagcagagcaaataatcgagattttaaggagagcagcagatgacatcaagagactataaccccagtaccatgcagctgc

SEQ ID NO: 1990 - protein, 132 aa, Corynebacterium glutamicum
VILVLLEAESMRGYQIITTISEQTEGNWTPSPGTIYPTLSMLEDEGLISISHEMGRKMARLTEEGAQEVAKNKDAWGSILEAYRNPESREVRVFNIRSEFHKVREAAKAAPDDKAEQIIEILRRAADDIKRL

SEQ ID NO: 1991 - DNA, 771 bp, Corynebacterium glutamicum
  CDS (101)..(748): RXA00949
gctcaaggatccttcctgggcaaaccaagcagccctcgcactaggtgcggaacccaggtatgttcaccaatacgactacgtactttaaaggagagttgacatgaaggttttcatcatcggcgctgcgggtggcatcggcaatcgactttccagcctgcttcacgccaggggagatgcagttagcggcatgcaccgcaatcttgagcaggcctcaaaaatcacagacactggggcaactgccgtactcggggatctcatccacaacagcacggaggagcttgcggagcttttccgcggtcacgatgccatcgtattttctgcaggcgcccacggaacagggcaagaaaataccacgcttatcgacggcgccggcctccgtaaagccgccgacgctgccagcgcggccaacgtttcacgcttcatcttggtctctgcgtttccggaatcctcccgcggggagaacaccaccgagaactttgagcactatatgaaggtgaagaagtccgccgatgtctacctcagtcacactgacctagactgggttattgtccgaccaggcgtgcttcaagatgaggcaggggatggtttagtcactgctggcttagcgattaattacggcaatgttgctcgcgataatgtcgcagcgttcattgatgaagctctgcatcaaccgcagttgtcaaagatcattgttgaactcaccgacggttcaactccggtggcggaagccgtagaacgcctcatcaagtaaagacgaaaagagggagaatg

SEQ ID NO: 1992 - protein, 216 aa, Corynebacterium glutamicum
MKVFIIGAAGGIGNRLSSLLHARGDAVSGMHRNLEQASKITDTGATAVLGDLIHNSTEELAELFRGHDAIVFSAGAHGTGQENTTLIDGAGLRKAADAASAANVSRFILVSAFPESSRGENTTENFEHYMKVKKSADVYLSHTDLDWVIVRPGVLQDEAGDGLVTAGLAINYGNVARDNVAAFIDEALHQPQLSKIIVELTDGSTPVAEAVERLIK

SEQ ID NO: 1993 - DNA, 170 bp, Corynebacterium glutamicum
  CDS (1)..(147): RXA00969
atccgacaggaagagcgcgatgatgatgcacgtctgatcgtggtcacccactctgcgctggaatctgatctttcccgcaccgttgaactgctgaaggctaagcctgttgttaaggcaatcaacagtgtgatccgcctcgaaagggactaattttactgacatggcaattg

SEQ ID NO: 1994 - protein, 49 aa, Corynebacterium glutamicum
IRQEERDDDARLIVVTHSALESDLSRTVELLKAKPVVKAINSVIRLERD

SEQ ID NO: 1995 - DNA, 726 bp, Corynebacterium glutamicum
  CDS (101)..(703): RXA00973
ttgttggtgcaggccttacagccattgcactgagttccatgctgtcgcagccagtacaggccttcaccatgaccattgagatggtgagtgtatttttcacatgaaccactctgacgacgatcgcatgcaaaagtggttccagatccgccgcgaactgggcaaagaaattgtgaaacagcttcaaaaggatctgcccgcagtcgcctctgacatcggctccatggtgtattcctctgatcaagttcccctcggaaacgccacgctcactgcatacggagacatcggcaaccgagtcgcttccgctgcaacaagtgcgagatacaacgtagaggaactcctggacgcaatcgaaaacgcacgatttgccatctgggttccaaattacgacaactcctactacctctccggcgaggaaggtgccgacgaattccaaacatacctcatcaaagatgcgtcaagatttcttgaatcctccgggaatactccacccgagaacccgcagtacagcgactccaaattaacctttgctagcgaactactccccttctacaccgcatttaacaactcgacctacccactacttcatgcttgtgtgcaaggtgaaccaactgaagtagacctctacttctacgagctcgagcaggcagaattgaaggaaaaagagactgcacagctctcgagtggatcaagttttggctccagttagtcagaattctcctaaagggc

SEQ ID NO: 1996 - protein, 201 aa, Corynebacterium glutamicum
MNHSDDDRMQKWFQIRRELGKEIVKQLQKDLPAVASDIGSMVYSSDQVPLGNATLTAYGDIGNRVASAATSARYNVEELLDAIENARFAIWVPNYDNSYYLSGEEGADEFQTYLIKDASRFLESSGNTPPENPQYSDSKLTFASELLPFYTAFNNSTYPLLHACVQGEPTEVDLYFYELEQAELKEKETAQLSSGSSFGSS

SEQ ID NO: 1997 - DNA, 738 bp, Corynebacterium glutamicum
  CDS (101)..(715): RXA00978
tcctgggtagcatgggcttatgagcactgatagccaaaaccctgtaagaaaatcctgcgcacagccacattcttgttcccaagaggtgcgattgaaagcgatgtccaggtcaccgcttactaaaggtctaaatcaacttgaacacctcgagttagataagtcactaactgcgtggtcgtgggcagaagatgatcctttgtacctcgcaggtgagaacttaaacggcagttacctcattgtcgcaggacgagtgcgggtctctcgcgacaccatcgacgggaaagaactcaccgttgatattgcaacgcccggcgatgttattggtgcgatagatacagaacctcagccggcagtagattccgcttgggcaatagaaaccacctgtgcgctgtttcttccagcaaccgcgttggcaactgtgattgaacagcatccaagttttgctttggcgatgattcggatgcagcagcaacgtttggctacagccagagatcatgaaattaacctgactacgaccacagttgagcaacgagtagctattgcagtgagaactctgggacgaaaaatcgggcaacgacgacccgatggaatcttgctcattcaagttcgaatccggcgggaagatgttgcgggtttagcaggcaccaccgtggaatctacttctagagttttggcgcgattacgtaaagaaggggtcattgatagcggtagggaatgattgccgtggtcgatgaacgg

SEQ ID NO: 1998 - protein, 205 aa, Corynebacterium glutamicum
MSRSPLTKGLNQLEHLELDKSLTAWSWAEDDPLYLAGENLNGSYLIVAGRVRVSRDTIDGKELTVDIATPGDVIGAIDTEPQPAVDSAWAIETTCALFLPATALATVIEQHPSFALAMIRMQQQRLATARDHEINLTTTTVEQRVAIAVRTLGRKIGQRRPDGILLIQVRIRREDVAGLAGTTVESTSRVLARLRKEGVIDSGRE

SEQ ID NO: 1999 - DNA, 424 bp, Corynebacterium glutamicum
  CDS (60)..(401): RXA00986
ctactttgataacaccgccacccaagccaagccggagtgatctccgtatcctttaaggcatgactttaaaagataagtacgacactgaagtagctgtttctaataatcaggacaagcaccaatttgaggtcagttaccctgaagatgccgtgactgctggctttgctgcataccttgataaaggtgattcgcggatcttctatcacaccgttgttggcgatgaattcggtggcaagggacttgcgtcaattcttgtttcagaggcgttaaaagccacaaaagaagctggtcttaccgtggttccggtatgtccctttgttaaaggattcgtggaaaagaacgcattcgagggttaccgcaaaccaaaccatgaggatatggagctggtgaagagccagatgtagaaactactcaacttccagaa

SEQ ID NO: 2000 - protein, 114 aa, Corynebacterium glutamicum
MTLKDKYDTEVAVSNNQDKHQFEVSYPEDAVTAGFAAYLDKGDSRIFYHTVVGDEFGGKGLASILVSEALKATKEAGLTVVPVCPFVKGFVEKNAFEGYRKPNHEDMELVKSQM

SEQ ID NO: 2001 - DNA, 588 bp, Corynebacterium glutamicum
  CDS (101)..(565): RXA00987
cgcgggctgcttaccacgcagcacagctaagctttaaggccctccggggccttttttgcttttcgacgcctacctccttcggaggcgtattctgtcgttcatgcctaaatctctgacctttgaagacagcattaacatcgcagcgcccatcaatcaggtctacgcactagtttctgacatcactcgaactggagaatggtcgcccgtgtgtgagaaatgctggtgggatgaagacgaaggccccgtcgtgggtgcgcactttactggccgaaacgtcacacctgagcgcacctgggagacacggagcgaggttatcgtcgcagagccaaatcgttgctttggttggagcgtgactgatggaaacgtcaagtggatttattccatggaaccgttagaagaaggcacagtattgactgaatcatgggaatttacccccaaaggtcaacgattcttccacgacaaattcggcgacaaatcaattgaagaaattgaaaagcgacgcttggcagctataaccggaattccagaaacactggttgccattcagcgcattctggaagttgagtagtttctacatctggctcttca

SEQ ID NO: 2002 - protein, 155 aa, Corynebacterium glutamicum
MPKSLTFEDSINIAAPINQVYALVSDITRTGEWSPVCEKCWWDEDEGPVVGAHFTGRNVTPERTWETRSEVIVAEPNRCFGWSVTDGNVKWIYSMEPLEEGTVLTESWEFTPKGQRFFHDKFGDKSIEEIEKRRLAAITGIPETLVAIQRILEVE

SEQ ID NO: 2003 - DNA, 546 bp, Corynebacterium glutamicum
  CDS (101)..(523): RXA00988
tagcagaagacaccgatgtacagtccggatcaggtgttgtgatcaccggttcaatcgtgaccgccggcgatgcgcgcacgctgtttggaaaggaacctgcatgagcaagcgtgaagaatcaattgagtacggaccattaggcaaaggccacgatccattaaaggatcccatgaagggtatccgaggtgtcatggccggcaccttagtgatggaagcaatcaccttaggtcttgttctcaccgtgattctgcgcgtggacgacggcatctactggaccaccttcaactgggtctatgtatcagcagtcgcgatcgcacactttgttgctgcatttctgcaaaggtttagttggtccatcccgatgaacatcgtgctgcaggttcttgcacttgccggtttctttgttcaccccgcgatgggcttcgccgccatcatcttcatcatcgcgtgggcgtacctgttctacctgcgctctaatctgattgatcgcatgaaacgcgggctgcttaccacgcagcacagctaagctttaaggccctccggggc

SEQ ID NO: 2004 - protein, 141 aa, Corynebacterium glutamicum
MSKREESIEYGPLGKGHDPLKDPMKGIRGVMAGTLVMEAITLGLVLTVILRVDDGIYWTTFNWVYVSAVAIAHFVAAFLQRFSWSIPMNIVLQVLALAGFFVHPAMGFAAIIFIIAWAYLFYLRSNLIDRMKRGLLTTQHS

SEQ ID NO: 2005 - DNA, 969 bp, Corynebacterium glutamicum
  CDS (101)..(946): RXA01005
tgggcaccgtcaacgattggactcacgaaagctccgacgactagaaatagtaactgtgttggacacttttcacctccgcgtattgagcgaggatgagtggatggaactagcccgcgcccaccacgcgcgggctgattcattcaccaaagaccacttgaagcgtcgacaagcgcatatcaagcaccccgtcttcgacttcctcttcgagtactaccccgtgcgcgtcgcgcacctaaaaacctggcaccccggcatcggcgtgtttctagaaggcacaccgccgcatgccaccatgcgcgattttttgcttgtcgacgcctccctccatcacgcagccggcgtccagcttgacctggcctcctatatgcaacgccgtgggtcctctgtgcgctacatccacgaactgttgtccgccacccgcgacaaccacgcccaatttgattgttttggtctgcacgaatgggcaatggtgtacaaatcaaacgatctccgccatgaccttcccctgcgccttaccccatcggaaaccgaccgtgtggtggaaagccacaacatcaaatgcacccactttgatgcctaccgattcttcaccacaccagccatcccgttgaacctcacggtgttaacccgcgaagatcagccacgcaacgatcaatgtggttgtctgcatgccacgatggatctatacaaatggtccgcaaagcttggccctcttgtgccaggtgatcttttcttggacgcgtttgaactagcccgcgacacccgcatcttggacatggaggcttcgccttacgacgtccgcggatacggctttggctacgtccccattgagaccgccgagggcaaagccgaatatgtcagtagacaacgcgagctgtctgaacgagcaaaacccatccgtgaccggcttgtctccattactaaacaagctctacaggctagtatttagaaaattagacttgtcaatgt

SEQ ID NO: 2006 - protein, 282 aa, Corynebacterium glutamicum
MELARAHHARADSFTKDHLKRRQAHIKHPVFDFLFEYYPVRVAHLKTWHPGIGVFLEGTPPHATMRDFLLVDASLHHAAGVQLDLASYMQRRGSSVRYIHELLSATRDNHAQFDCFGLHEWAMVYKSNDLRHDLPLRLTPSETDRVVESHNIKCTHFDAYRFFTTPAIPLNLTVLTREDQPRNDQCGCLHATMDLYKWSAKLGPLVPGDLFLDAFELARDTRILDMEASPYDVRGYGFGYVPIETAEGKAEYVSRQRELSERAKPIRDRLVSITKQALQASI

SEQ ID NO: 2007 - DNA, 1830 bp, Corynebacterium glutamicum
  CDS (101)..(1807): RXA01007
tctgaaccaatataccgatcagtctaaaagtgtgttaagttctggaacataaattagctgacacgtaaagtaacttaaagattcactggaggtaagcctagtgtttaaaaagcacagacacggtctcggctcccccgaaaccaaaccacgctcaataacccgccggtttttcaccgcggccgccgctacgctggcaggattggcagtcctgtccggctgcacagcacaaccctcacaagcagaagacaacacgctcacttacttagagccacagttcttccgcaccctgtacccaccatcagcgggcttttaccccaacggcagtgtggtgaacaacattgcagaccgcttgctctaccaggatcctgaaaccttggaactcaagccgtggatcgccaccgaactcccagaagtaaacgaagacgccacggaatttaccttcaacatccgcaccgatgtcacctactccgatggcaccccgctgacggctgaaaacgtggtgaaaaacttcgatctctatggcctcggcgatcaagatcgacgcctcaccatctctgagcagatcaccaactacgaccacggcgaagtagtagatgaggacaccgtccgattccacttctctgagcctgcacctggttttgctcaggccaccagctccttcaacgctggcctttatgccgattccaccttggagttcgccaatgaggatttcgcgccaggcaacgcccaaaacgtcatcggctccggtcctttcgtgatcaccgatgaaaccctaggcaccaacctcaccttgactgcgcgtgaggattacgattgggcaccaccatcacgcgaacatcaaggtcgcgcgaagcttgacgccgtcaattatgtcctcgcgggtgaagaatccgtccgcatcggagccatcgttgctggccaaggtgatatcgcccgccagatcgaagcgccagtggaggcacacctgaaggatgcaggcatcccgatcatctccgcagccaccaacggtgtgaacaacagcttcaacttccgcttcaaaaacgagctgctctcagacatccgtgttcgccaagctctgatccacgcgatcgaccgcgaaaagatcatgcgtgtgctgtttagtgattcctatccgctggcaacttctgtgcttgcgcaaaatgcactgggctacaaagaacaagtagatgcctatgtctacgacctagacaaagcaacagctctgcttgacgaagccggctggacccttgatagcgacggcatgcgtcgcaaggacggtgaacttctagagctcaccttcaacgaagccctcccacagcctcgttcacgcgaagttgtcaccatggtccaagaacagctcggtgatctgggcatcaaggtcaacctcaacccaggtgaccaagcagcccaggacgctgactccaaggatctcaacaagatccaggttcgccacaccatggtgggtcgcgcagactatgacgtgctgaaatcccagctgtactccaccaaccgcaacgagctgttgaacatgaccgtggaaggggagaccgccgatattggcgatcctcatttggaggaactcctcatggctattgcatccagcccacgcgaagaggaccgtgcagcagcatctgccgcagcacaggattacatcaccgagcaggcatatgttcttccactgtttgaagagccagttgtctacggcgtgcagccttacgtgaagggctttagccccgaagtgatcggccgccccagcttctatgagacctacattgaccattccagcgaccattccagtgaggaggactaaatgactacctcgcagattct

SEQ ID NO: 2008 - protein, 569 aa, Corynebacterium glutamicum
VFKKHRHGLGSPETKPRSITRRFFTAAAATLAGLAVLSGCTAQPSQAEDNTLTYLEPQFFRTLYPPSAGFYPNGSVVNNIADRLLYQDPETLELKPWIATELPEVNEDATEFTFNIRTDVTYSDGTPLTAENVVKNFDLYGLGDQDRRLTISEQITNYDHGEVVDEDTVRFHFSEPAPGFAQATSSFNAGLYADSTLEFANEDFAPGNAQNVIGSGPFVITDETLGTNLTLTAREDYDWAPPSREHQGRAKLDAVNYVLAGEESVRIGAIVAGQGDIARQIEAPVEAHLKDAGIPIISAATNGVNNSFNFRFKNELLSDIRVRQALIHAIDREKIMRVLFSDSYPLATSVLAQNALGYKEQVDAYVYDLDKATALLDEAGWTLDSDGMRRKDGELLELTFNEALPQPRSREVVTMVQEQLGDLGIKVNLNPGDQAAQDADSKDLNKIQVRHTMVGRADYDVLKSQLYSTNRNELLNMTVEGETADIGDPHLEELLMAIASSPREEDRAAASAAAQDYITEQAYVLPLFEEPVVYGVQPYVKGFSPEVIGRPSFYETYIDHSSDHSSEED

SEQ ID NO: 2009 - DNA, 2064 bp, Corynebacterium glutamicum
  CDS (101)..(2041): RXA01008
atttatgttccagaacttaacacacttttagactgatcggtatattggttcagaccaacctgtctaattggggtatttattttaatgatcaggagttttcgtgagcacaaccgataagcaggtagccatcgttggagttggccccagaggtatttccatactcgaaaggatcgcagcagctctcaacacagtttcccgccccaaacaaggcttgaccatccacctgattgaggatgcccagatgggtgcaggcaacgtgtggcgcactgatcaaacccgcacgctgtgcatgaatactctggccggtgcggtgacattattcacagagccaggctctacggtgagcgctccagtggtggaaggaccactgcaatttgattggattcgcctgctgcgcggcgatgaggatttgagcggcattcctacaaaagccatcgagctgttccgcacctaccccccagctgcatccgtggcggaggatttcaaggaagagctagcagccactgttatccagtccaatccttcccgtgctctttatggcgcatatctgcggtgggctttcgatgtcgctttgcagctgttgccacagtgggtcaaggtcgagcagcaccatgcgcgcgcgattggcatccgcgaagatggtgaccgcgatgtgatcaccttagataattctgagatgatttccgccgattccactgtgttggctgtcggctggcaaacccccgcccccaatgcggaggagctgtccatcgcggctgctttggaggagaaccctgatctggtgtgggtcaagcccggcaaccctgtcgagcaggatgccagcctcattcccgctggcgaacaggtgcttgtccgcgggctgggcatgggatttttcgatatcatggcgctgaccaccatcgatcgtggcggcatcttccacgaggatcccagcacccgttccggtttgcgctacgaggcatctggtgaggaaccacactttgttatttcctccgggcgcggctacccctacctgcctaaatccgattacaaatcgctgccaccaggggcaaagctagcgcgactcaaggctgttatcgcggcgatcaacgcgcaaaatcgtggtgtcgcatccatcaactatgatgcggaagtgtggccagctgttgctcgcgacgcctacgaagcctattacgaaacccttgatcgcgtaagcccagaatctatccggaccggtctggataaaattgtggaaattattgatgaggtggacgtcgataagcttcctaaagcactcgccgcgcacaccgatgacgtctttgacctgcatgcttgggaatttccgctcgcgggaattaatgaaagcgtcgaggcgctgaccgcacgcatcgcggacggcatggcccgcgatattcgccatgcagtaacggcctgggacagcccgctgaaatccgcgctgtggtccatttccgccgcgcgcaaacccagctccatcctgggcgcggaaggccgcctgaccttcgaatcgcgccgcaaccgcttcgccgccgtcatggcgatcggccagatggtcggctccggcccaccgcttttccgcacccgcgaacttcttgcgcttgtcgacgccggcctcgctcacttcgccggcgcccgcccccgcctcagcgtgagcgacggtcaatggcagatctcctcgcccaccaccggcgatacgccgctgagatcgaaagtgcttgtcgacgcgtggatgcacaacccagatgtgcgtcgcaacgccgacccgctagcactgtctttggaagatgccgaccgggtacgccccttcaacgactattccgtcgacggaaccgctgcccccacaggctcccccgaagttgatccggcaacccgacttttggttcaccccaacggcaacctcgatccgcgcgtgcacctgattggcatcccaacctatgggcagctggccgacaccaccatctcgccgatgcctggaaccaacccgctcatgctgcaagaaaccgacaaaacagccgttcacgtgctaaagcagctcggcttgatctagggtgaggtgagttatttaaa

SEQ ID NO: 2010 - protein, 647 aa, Corynebacterium glutamicum
VSTTDKQVAIVGVGPRGISILERIAAALNTVSRPKQGLTIHLIEDAQMGAGNVWRTDQTRTLCMNTLAGAVTLFTEPGSTVSAPVVEGPLQFDWIRLLRGDEDLSGIPTKAIELFRTYPPAASVAEDFKEELAATVIQSNPSRALYGAYLRWAFDVALQLLPQWVKVEQHHARAIGIREDGDRDVITLDNSEMISADSTVLAVGWQTPAPNAEELSIAAALEENPDLVWVKPGNPVEQDASLIPAGEQVLVRGLGMGFFDIMALTTIDRGGIFHEDPSTRSGLRYEASGEEPHFVISSGRGYPYLPKSDYKSLPPGAKLARLKAVIAAINAQNRGVASINYDAEVWPAVARDAYEAYYETLDRVSPESIRTGLDKIVEIIDEVDVDKLPKALAAHTDDVFDLHAWEFPLAGINESVEALTARIADGMARDIRHAVTAWDSPLKSALWSISAARKPSSILGAEGRLTFESRRNRFAAVMAIGQMVGSGPPLFRTRELLALVDAGLAHFAGARPRLSVSDGQWQISSPTTGDTPLRSKVLVDAWMHNPDVRRNADPLALSLEDADRVRPFNDYSVDGTAAPTGSPEVDPATRLLVHPNGNLDPRVHLIGIPTYGQLADTTISPMPGTNPLMLQETDKTAVHVLKQLGLI

SEQ ID NO: 2011 - DNA, 1356 bp, Corynebacterium glutamicum
  CDS (101)..(1333): RXA01011
cccgcaaaccgatttcactcgccgactcatcgacgcgatcccaggatcgcgctatcgtggtggcgaactcaatcttggactataggagcagatcttaaaaatgtcagatctcatcgacatgctggttggagaagacctcccacagctgcgtgacaaccgtccccaagctcgcgacaatgcacaaaagagcttcgaagctctgctcgaaccggtcaacccaggaaccttcagcttcggcgagcgttacgccgtggccacctatgttgcaggtttgcaccaattcgcgccagctgtagatctctaccaagatttgcttctcgacgacgccccaaccaccctggcaaacgccgtctccgatgccatcgacgagggcctatccgcaggcccatacggcacctaccgtgaacctggacttgagtccgaatcagagccaggcggatctgtgcgcaacgatgccgccaagcttggcgagcgacttgcagcagcatttgattacgcacacctactagttttccacccccgtgattcccgccccgaggtccttggtcgactctccggcgctggctggagcgcggatgacaccgtgacattggctcagctggtgtcgttcctggcattccagctgcgtgttgcctacggcctgcgcaccctcaaaggtgaagacattcaggtgaaagctcctcgcctgagtattcctgaagcgaagtgggaactgtccaacaacggctttgagatctccacctatgaagaactcaaccgccctgaagcgtttgtgaaccactctttgggctggaagccatgggtaccaccagtagcaaaggcagatctcaccgaagaacagctggattctttgatccagcctgagcgcgctgatatgccatacttccgtctcttggcacgcgatcctgcagcattgaaggcgcgtaccctgaccgatctggatatcttcttcaacactgacggcgaaggcctaggacgtgcagagcgtgaactcggcgccaccgttacttcccgctacaacggctgcgtgtactgcgcatccgtgcacgcaggacgtgctcaggaagaatccggtcgagctgatgatgtcaacgcactgttggcaagcatcgactccgatctgggttctgaccagtggaatgtcatccgtgacgctgctcgcgcactgagctccacccctgctgctttcaaccagggatgcatcaccaagctgcgtggcgttggattcagcgacctgcagatcgtggacttgatcaactctgtggcgttcttcaactgggcgaaccgcctgatgttgtcactgggtgaacccgaagtgccaaagcgtttcctgtaaaacgcataaccccgaatacc

SEQ ID NO: 2012 - protein, 411 aa, Corynebacterium glutamicum
MSDLIDMLVGEDLPQLRDNRPQARDNAQKSFEALLEPVNPGTFSFGERYAVATYVAGLHQFAPAVDLYQDLLLDDAPTTLANAVSDAIDEGLSAGPYGTYREPGLESESEPGGSVRNDAAKLGERLAAAFDYAHLLVFHPRDSRPEVLGRLSGAGWSADDTVTLAQLVSFLAFQLRVAYGLRTLKGEDIQVKAPRLSIPEAKWELSNNGFEISTYEELNRPEAFVNHSLGWKPWVPPVAKADLTEEQLDSLIQPERADMPYFRLLARDPAALKARTLTDLDIFFNTDGEGLGRAERELGATVTSRYNGCVYCASVHAGRAQEESGRADDVNALLASIDSDLGSDQWNVIRDAARALSSTPAAFNQGCITKLRGVGFSDLQIVDLINSVAFFNWANRLMLSLGEPEVPKRFL

SEQ ID NO: 2013 - DNA, 732 bp, Corynebacterium glutamicum
  CDS (101)..(709): RXA01017
gaaatttgagggggcgctacccttagaaggtgcgcaatgacaccacgatagttcgcgcctagtgtggattgctagaaaactttaagaaagaggaaataatatggctcaaaaagtaaccttctggttcgataccacctgcccattctgctgggtcacctcccgctggattaaggaagtcgaacaagtccgcgatattgaaatccagtgggttccaatgagcctcgctgtcctaaacgaaggccgtgatctcccagaggattacaaggagcgcatgaaggctgcatggggaccagcacgcgttttcgcagctgtcgccaccgaccatgctgacaagctcggcgacctgtacaccgcaatgggtacccgcatccacaacgacggtcgcggaccaatcgaaggttccttcaatgatgtcatcgcagaggcacttgaagaggtcggcctagacgctgcacttggtgaagttgcagacaccaccgaatgggacgacgcacttcgcgcattccaccagaccgcaatggacgaggtcggcaacgatgtcggaaccccagtggtcaagctcggcgacaccgctttcttcggcccagtgctcacccgcatcccacgcggcgaggaagcaggagagatcttcgacgcttccttcaagctcgcaagctatccccacttctttgaaatcaagcgcagccgcactgagaacccacagttcgactaattaacgctgtctctgcttat

SEQ ID NO: 2014 - protein, 203 aa, Corynebacterium glutamicum
MAQKVTFWFDTTCPFCWVTSRWIKEVEQVRDIEIQWVPMSLAVLNEGRDLPEDYKERMKAAWGPARVFAAVATDHADKLGDLYTAMGTRIHNDGRGPIEGSFNDVIAEALEEVGLDAALGEVADTTEWDDALRAFHQTAMDEVGNDVGTPVVKLGDTAFFGPVLTRIPRGEEAGEIFDASFKLASYPHFFEIKRSRTENPQFD

SEQ ID NO: 2015 - DNA, 622 bp, Corynebacterium glutamicum
  CDS (101)..(622): RXA01021
cgagaggcttttttggctctaagccttttagtcgtgcgaacgaaatcttaagcagcctcggtgccaccgagatcgattggtcgctgtaaggtatctgattatgtccagttccgaaagctcgcgttccgaaggctcgcagccagcaccgtctgtacagcctgaacgccgtgctgattcaacgggggctcctgcggcagcttccaaggaagcttcccaacaaatggacgctgccggagttcttgagtgggccaggaccgctgtcgagcagctttctgaacgtcgtgcagagatcaatgcactgaatgtctttcctgttccagatgcagacactggatcaaacatgacctacaccatgacagctgcgttggatgaagcgctgaaactgggggagttgggtgatgtcgcaaggattactgaggctttggctgttggttctgtgcgtggagcccgaggaaattctggagtagtccttagtcaggtccttcgcgctattgctcaggcagctgctgacggggttattgatggccacacaatccaagaagcgctatccattgctcgctccctagttgatcgcgcaattacagatcctgtggagggcactgttgtcactgtgttgcgttct

SEQ ID NO: 2016 - protein, 174 aa, Corynebacterium glutamicum
MSSSESSRSEGSQPAPSVQPERRADSTGAPAAASKEASQQMDAAGVLEWARTAVEQLSERRAEINALNVFPVPDADTGSNMTYTMTAALDEALKLGELGDVARITEALAVGSVRGARGNSGVVLSQVLRAIAQAAADGVIDGHTIQEALSIARSLVDRAITDPVEGTVVTVLRS

SEQ ID NO: 2017 - DNA, 612 bp, Corynebacterium glutamicum
  CDS (101)..(589): RXA01029
atgggtggttgtcttaattaagggtgttgcgtgaaacacgcaaccggagaggagggtgaagtgtggggttccttgcgggcgtatgtccggggtgcttgctatgcttcaaacgatttcattcaagaaacttaatttattaacaactcttaaaagaaaaggagagctggtcatcatgatcactcgtcacgatgttccctacatcatcgctccgcctgtctacgcgatctttgcgagcctgatgaccacgccaccatggttttatcgaaccacctacaccattgacggtttcgattttaagatcagctgggtctacaccatcaccatctacatcagcctcatgatcctcattatcgggttctaccaagccaatatgcgcaaagcgtgcccttatgaggaagatcctttggtcgatatttggcacaaggtgtggagcactgcactctttatcctacctatcgttttatccatcgcggtgtactcactgatcacacagcgcgggtttgactggtatgtcatggtgtttattctccctgtaggcttgatgatcgcttatggattcttcaagccctgtgattgcgacaaacaccgttaaggtatacttgtccaagactt

SEQ ID NO: 2018 - protein, 163 aa, Corynebacterium glutamicum
MLQTISFKKLNLLTTLKRKGELVIMITRHDVPYIIAPPVYAIFASLMTTPPWFYRTTYTIDGFDFKISWVYTITIYISLMILIIGFYQANMRKACPYEEDPLVDIWHKVWSTALFILPIVLSIAVYSLITQRGFDWYVMVFILPVGLMIAYGFFKPCDCDKHR

SEQ ID NO: 2019 - DNA, 789 bp, Corynebacterium glutamicum
  CDS (101)..(766): RXA01031
cagctgaacttgatcattttgatgatctgccagtacagcgccaagaagatcttggcaccttagttgttatctctgctgttcacgcaagcgactctgcggcatgaaactgctgcaatacgcaggtggtgctgtctatgtcgatccagaagattctgcgcagtcccaagacctggatgccagcactgcacgtgatgttatcgacgctaccaacaccgccatgaccactattacctctcgccccaccatgattgtgcacctgcacaaggtgcgaaaagtcattgagattttatgcaaccctgcactcggcggtgaacctgtcaatatcgaccaggacgagaccggaaaacaggtgtacacacccaccccaacgcttgtcgcctatcgctttatctctgacaaagaaatcctgcttcattacctggcgcaggcgggtgtgcagggtgtggaggtttttgacgggtcgcctgacatgctgagccgttggaatgcgggacgcattccggtcttacttttgcagcctgcgtctgctggtcacggcttgaatttccagcacggcgggcatcgcttggtgtggtacaacctgcccgataataacgagcattatatgcaagcgaatgctcgtctacatcgcattggtcaaaagaatcccgtgaccattcaccgcattattaccgctgatacttatgatgcgaatatgccggcgattctggccggtaaagcaaatagacagcaacgtctcatcgacgccgtgcgccgtgatccagtctaagaccggcacgatcgcaccgt

SEQ ID NO: 2020 - protein, 222 aa, Corynebacterium glutamicum
MKLLQYAGGAVYVDPEDSAQSQDLDASTARDVIDATNTAMTTITSRPTMIVHLHKVRKVIEILCNPALGGEPVNIDQDETGKQVYTPTPTLVAYRFISDKEILLHYLAQAGVQGVEVFDGSPDMLSRWNAGRIPVLLLQPASAGHGLNFQHGGHRLVWYNLPDNNEHYMQANARLHRIGQKNPVTIHRIITADTYDANMPAILAGKANRQQRLIDAVRRDPV

SEQ ID NO: 2021 - DNA, 498 bp, Corynebacterium glutamicum
  CDS (101)..(475): RXA01032
agctaatcagcaccacctacaacaccacaaacacaccccaatcagcatgatcgtgccggttggggtgtgtcttatcccctaagaaagtgacacctttaccatgtcagaccacgacgccccacaaacaccgatccccaaggggttttggcagcagatcgaccaccaactcgatcgcctcggcacgcagcgcccagagaccttcgcagcactgcgtgacattttgcttgatcctgcctacaccgccattgttcatgaccgtaatcgctacggcgttgtcacctttgacaccaactcagccttcttctcaggctctggcggagacaacggcttagccgacgtactcattaactgtgattggcgcatgactgactaccgcgccgagtactactacgtcatgacacataaatacaccaaggaatcgtttacctatatcgagggcgacgtgaaacgcggcgacctcatcccgcctaataattaaggacaaccgccatgactcag

SEQ ID NO: 2022 - protein, 125 aa, Corynebacterium glutamicum
MSDHDAPQTPIPKGFWQQIDHQLDRLGTQRPETFAALRDILLDPAYTAIVHDRNRYGVVTFDTNSAFFSGSGGDNGLADVLINCDWRMTDYRAEYYYVMTHKYTKESFTYIEGDVKRGDLIPPNN

SEQ ID NO: 2023 - DNA, 459 bp, Corynebacterium glutamicum
  CDS (101)..(436): RXA01033
acgtcatgacacataaatacaccaaggaatcgtttacctatatcgagggcgacgtgaaacgcggcgacctcatcccgcctaataattaaggacaaccgccatgactcagatcgccatgtatctcgcaggacccatgacaggtatccctgaatacaactaccccaccttccatgcagcggctaataagttccgtgcagctggctacaccgtactctcccccgctgaagacgaatatgaatcccagctcactgcaccattgcctgagaacgctgagcacaaatacgaccactacttgcgtctcggtatcgaaaagctgctcaaggctgatgctgtccacatgcttcagggatggcagagtagcgccggtgccactcttgagcacgatattgcacagaaattgaggcttgccattacctatgaagaaccaccagcatcctaaggcgcctccggcatagcgta

SEQ ID NO: 2024 - protein, 112 aa, Corynebacterium glutamicum
MTQIAMYLAGPMTGIPEYNYPTFHAAANKFRAAGYTVLSPAEDEYESQLTAPLPENAEHKYDHYLRLGIEKLLKADAVHMLQGWQSSAGATLEHDIAQKLRLAITYEEPPAS

SEQ ID NO: 2025 - DNA, 477 bp, Corynebacterium glutamicum
  CDS (101)..(454): RXA01034
agaaagtatgtcaataactttgacataacctaaacacaataaattatgtagtattatgtgacactaagttattacatttattacatgattggttaggactatggacatggccattattcagtcggtcgaatacacatctgatgtctcacatgagcgcatcaccaatgtcgtctctgtaggcgtggtctacgagggtaaacagtatgtagtggaccttaatggtgacgacattgatactgagctcgatatgatcacgctcaaagaagtcatcaagattggtcgtgaggaatctgcacgccagatccgtcgtggatctgtagatgcagagctgcaccgtaaggcgcgtttgtgggctattgacaatgacatggccgttggtcaacgtggtatcgtgccacaggaaatcatcgacgcgtacaaagagtactgcgaaaaagaaggcattcctttcgaataagagccctgtggagaattgtt

SEQ ID NO: 2026 - protein, 118 aa, Corynebacterium glutamicum
MDMAIIQSVEYTSDVSHERITNVVSVGVVYEGKQYVVDLNGDDIDTELDMITLKEVIKIGREESARQIRRGSVDAELHRKARLWAIDNDMAVGQRGIVPQEIIDAYKEYCEKEGIPFE

SEQ ID NO: 2027 - DNA, 729 bp, Corynebacterium glutamicum
  CDS (101)..(706): RXA01035
ggcagtgatgcaccgcacttgagaaaaataaatcatctcaagaaacaaactaatacgttattattgtaatttaattagagaaaagaaagtgacttttaaagtgcttattcgcatcgccgagcatcaaggccggctccatgtccatagcccctactcaaaggcttttgccgcccgcgctcgaaagctcaacggtctctggtcacccgaaacgaagacctggcatttcagccccgataaagaacaaccggtgagacgcgcactcaaggatgtctacggctgggatgaattcaccacacccgagctatgcacggtgcagctcactgtgaccccagaggcagtgctcaacaaacacacactcaccatcgctggtgttacacttctgagccgtttacgcagaaattactcggtgtggttgggtgataatgtccgcatcatcagtggcaatttcccagaagcagcaggatcaccccagtaccccctcatcatgggtgtgaaggctcaacccgttgttatccatgtgcaggaattccctgtagatgctgtttcgactattcccccgcgatttaatcctattgttatcactgcaccgccgagcattgatattgctgctcttcgagctgaacgcgaacagctcacccgacgcatcagcgaaattgacaagaaaatcgcacgtgctgtgcatccaaccattcagactgaggctgcctaataatgatgcagactctcaag

SEQ ID NO: 2028 - protein, 202 aa, Corynebacterium glutamicum
VLIRIAEHQGRLHVHSPYSKAFAARARKLNGLWSPETKTWHFSPDKEQPVRRALKDVYGWDEFTTPELCTVQLTVTPEAVLNKHTLTIAGVTLLSRLRRNYSVWLGDNVRIISGNFPEAAGSPQYPLIMGVKAQPVVIHVQEFPVDAVSTIPPRFNPIVITAPPSIDIAALRAEREQLTRRISEIDKKIARAVHPTIQTEAA

SEQ ID NO: 2029 - DNA, 576 bp, Corynebacterium glutamicum
  CDS (101)..(553): RXA01036
ctgaggctgcctaataatgatgcagactctcaagcggaaaattccgctcatctcatgcaatgacctcaaagaagtgcagttactttttcttaaaggtcagatgcacacagtcggctacaagctagataccgatcttcgcaagctcactaataccgatgtgcttgatcttattaacgcgctcttcggcaccactgtgaccagcgcagatgacgaagcagcagatttcattgactctgatcctcagtttgcagtgctcgttgagctggcctaccacgactgtgcacgccgcgctgccatgggtctatccagggtacagcagctcatctatgacaatgcggctaaatcaacctactaccgcagcgtcgcagctagacatcgcaaacacatccgtgaactccacgagcaaacacagcgagatggtattcacttcgacaacccgttgtctcgtgcagtcatcaacgatctcagcatgtccatgaaccgtgctcgactaaaccgcatcgcttcatggaaatcagccggcgtacagcgctatctcaaccccactatctcttagaaccacacacaaccaagaaa

SEQ ID NO: 2030 - protein, 151 aa, Corynebacterium glutamicum
MHTVGYKLDTDLRKLTNTDVLDLINALFGTTVTSADDEAADFIDSDPQFAVLVELAYHDCARRAAMGLSRVQQLIYDNAAKSTYYRSVAARHRKHIRELHEQTQRDGIHFDNPLSRAVINDLSMSMNRARLNRIASWKSAGVQRYLNPTIS

SEQ ID NO: 2031 - DNA, 651 bp, Corynebacterium glutamicum
  CDS (101)..(628): RXA01037
cgactaaaccgcatcgcttcatggaaatcagccggcgtacagcgctatctcaaccccactatctcttagaaccacacacaaccaagaaagcagtcactacatgaccacctcatcaccccttaagtccaaaaattcccttaacggcgcgcagaccacatttgtccgcaattgtgttgcagacggcccaaccgaggtaaaagccaccattgatgcacgtggcggtatcgaacagctccgtgacaatgagatttcacagctccccgacaagctgtggttcaatagcgcaacctccgcatccaatgacgagttcaccaccgataacatccgacttgggttgctctacaacatggcactgaataaggcatcggctcatcgctatgagcttgctgcccgctggtacgccattgttagccctcagccatcgcaagaagctagccacaagcgcatcgcgtcctggcaccttacccagctgcacgcactggtgaccctatctcgcaccctaggggtcatcattcctggtgatgagatcgacgctctagcgcagtctatggagaatgctcgtcaagttggcaccgagaattggtccactgtcaccatgcgcacctacgtgaccaaccgcaaggcatcctaatgactcgcgatattttccac

SEQ ID NO: 2032 - protein, 176 aa, Corynebacterium glutamicum
MTTSSPLKSKNSLNGAQTTFVRNCVADGPTEVKATIDARGGIEQLRDNEISQLPDKLWFNSATSASNDEFTTDNIRLGLLYNMALNKASAHRYELAARWYAIVSPQPSQEASHKRIASWHLTQLHALVTLSRTLGVIIPGDEIDALAQSMENARQVGTENWSTVTMRTYVTNRKAS

SEQ ID NO: 2033 - DNA, 870 bp, Corynebacterium glutamicum
  CDS (101)..(847): RXA01038
acgctctagcgcagtctatggagaatgctcgtcaagttggcaccgagaattggtccactgtcaccatgcgcacctacgtgaccaaccgcaaggcatcctaatgactcgcgatattttccacgaggctgcaaaactcatcgcacacctggggtggagggacgcttttccagcactacagcgcactgacccagcgccaacacatgctgtgccgatcagggcctttgatctcaaggcgggcgccgtcatcaccgatgaaaatcgaagcaatgcttatatctatgacacccttgtcatcacgcagccatataagcacgagttacctcatcaaaacacccacccttttgagtgggccctggaacaaattgccacgcttgatccggcgttctcgatcaagctcgatcgctcagtgaccgtccctgaaattggactctacgcccgcacactgcatgaccttaatactcggcatcaagacttcttggcacagcgcaacgccatgttgcttgttgttgcccgtcgtggtgttgatccaaaaaatatcgcagacgtacttggtttaaccaccaatcagatacatcggattctcagtgctactccggctgattcccctactgatttaggcgttaaccccgccacaacaatgggtgatgtagtgaggtttatcaagaaacgtcgcaccactatgcaactacgcggcaccgctgtccgtgcactgctctatcacggccttacgccggcagtcatctcccgactaagcggcatgtcgcgtgcgggtgtcatcaacgcagccaaggcattccccaccaccatcaaccacaaggtcaagaaaagaaagcagcacttccatgtctaatctcggcacatactatgcag

SEQ ID NO: 2034 - protein, 249 aa, Corynebacterium glutamicum
MTRDIFHEAAKLIAHLGWRDAFPALQRTDPAPTHAVPIRAFDLKAGAVITDENRSNAYIYDTLVITQPYKHELPHQNTHPFEWALEQIATLDPAFSIKLDRSVTVPEIGLYARTLHDLNTRHQDFLAQRNAMLLVVARRGVDPKNIADVLGLTTNQIHRILSATPADSPTDLGVNPATTMGDVVRFIKKRRTTMQLRGTAVRALLYHGLTPAVISRLSGMSRAGVINAAKAFPTTINHKVKKRKQHFHV

SEQ ID NO: 2035 - DNA, 699 bp, Corynebacterium glutamicum
  CDS (101)..(676): RXA01039
aaacctatatgttaatagtaacagaaattaataagatactagagtttaatttgtagtatccagggaacattaaacgggtaaaggtaaaggacaaacgaacatggcgattaaaggcgcaatgccgaaaaatcgagtaccaggtgtggcagcaggtgcgtttattgctgctgccgttattgcaggtggatcaggcgtgacctttctcgcccaaggcggtggtgatgtcaatacagtggccgtcgtcgagccacaggacgaggtaaaaaatcaggtcgtgacagaaaccgaaattgtcacgaaggttcacgatccttcttcatctgacgccagtgatgctgacagcaacacaggcaccgccgaaggcgcagactcagatcacaaagaaccccgtgagcacgacagtgctcaagagccaacggctccgaccgaccccaccttgaccattaccggcaacggtgacacaccagtatcagcacttgatgctgtcgcaggacctgcccgtccaggtacggtgcacgtcattgagaatggcgaaaccttgtcctctatttctcaggacagtggtgtgccggttgggttgatcattgatcgcaacaagcttgttgatccagacctgatctatgcaggcacgccattggcgattccgactgagcaggaacttgctgctgcgatacagtaatgtagtggtagagggttaaa

SEQ ID NO: 2036 - protein, 192 aa, Corynebacterium glutamicum
MAIKGAMPKNRVPGVAAGAFIAAAVIAGGSGVTFLAQGGGDVNTVAVVEPQDEVKNQVVTETEIVTKVHDPSSSDASDADSNTGTAEGADSDHKEPREHDSAQEPTAPTDPTLTITGNGDTPVSALDAVAGPARPGTVHVIENGETLSSISQDSGVPVGLIIDRNKLVDPDLIYAGTPLAIPTEQELAAAIQ

SEQ ID NO: 2037 - DNA, 1026 bp, Corynebacterium glutamicum
  CDS (101)..(1003): RXA01040
taatttctgttactattaacatataggttttttaaagtttcgtctacataaacctgcaacagaaatcactacacccagttctcgaaaggctttttctctcatgacctacccagttacccctcaacctgtgcagccagcaccagtcgccgaaaagatcaaggcatcaagcctcaaagaaggcactcaggtatttatcaaaggtcgggttaattactcccgcatcgcaagctttattactggtaccgagcgcgaaaaccgtaatcgcgacaggcttcacccaatcgaattcgactacacctccctgactttgagccaccctgaaatcatctacggcaacccgcaacaaaagaccaatgaagaactcttccttgagcagcgaatctttgtcggcaagaagcgtcctgaagagggtccaaaattctccattgacaacaagagcaaccgtctaccacaggtttgggtgccatccaccaatgctgatggtacttatgagcagcttgaaggtctcgaaggtgagctcgacgcagggctcaacgtcattattctcatcgagttctataagccacgtacacaggttaatcgcggctcccgcctcaacgccgtgttcctgcaggagcccattcgttactacacccctggttacaatgcagataagctcgctgccctcggaatcgtacttaacgcaccgccaaaggacactattcagctcgttcctaatgaggtcgctgcaggacaagaccagtccaccaccgatgcatccggtctcccgcttccaggccagggatatagcgcacctgatcagccatatcaggcgcagcctcagtatcagcaggcaaccccagcggctgcacctcagcagtaccaggccccacagccccagtaccagcagtcagctccacaggcacaacctgcaccggcaccagttgcgcagttccagcaggcaagcgcctcaggcacctgctcagccagcacagcagcagtatcaggcaccacttcctgccggtaatcctcttgcagcaggtcagc

SEQ ID NO: 2038 - protein, 301 aa, Corynebacterium glutamicum
MTYPVTPQPVQPAPVAEKIKASSLKEGTQVFIKGRVNYSRIASFITGTERENRNRDRLHPIEFDYTSLTLSHPEIIYGNPQQKTNEELFLEQRIFVGKKRPEEGPKFSIDNKSNRLPQVWVPSTNADGTYEQLEGLEGELDAGLNVIILIEFYKPRTQVNRGSRLNAVFLQEPIRYYTPGYNADKLAALGIVLNAPPKDTIQLVPNEVAAGQDQSTTDASGLPLPGQGYSAPDQPYQAQPQYQQATPAAAPQQYQAPQPQYQQSAPQAQPAPAPVAQFQQASASGTCSASTAAVSGTTSCR

SEQ ID NO: 2039 - DNA, 276 bp, Corynebacterium glutamicum
  CDS (101)..(253): RXA01041
acagcaggcaatgcctacccaagccccacaaacaccggcacaaccagttcagccaccagcaccacaagccggttctgcatttaccgatgctccgggtgctgtgccacaggcaccagcagttcaggctgctcccgctgtagctcaggcgcctgtcgcgccagtagttgatatgaccgagccagcatccccatgggatcttccagctgcacctagtcagccagcgcagccagctcagggcatcacctacccggcataacaaccagcacaacccttaga

SEQ ID NO: 2040 - protein, 51 aa, Corynebacterium glutamicum
VPQAPAVQAAPAVAQAPVAPVVDMTEPASPWDLPAAPSQPAQPAQGITYPA

SEQ ID NO: 2041 - DNA, 1401 bp, Corynebacterium glutamicum
  CDS (101)..(1378): RXA01042
ttttttcaccagggtcgaggcgcggtctgtgtgcccacctcgacccacttttcgcccaccacttttcgtcaacctaccaacaacaaagcccaggtcacttatggtcaacccttttcacacgcttgataactcaccgtttgatccggtggcacagtttcctgcgttttatcacaacccgcttatcaatcacttgggccgccgtcgcgcctggacaatctcagacatcaacaaacgccccatcaatgtccaacagatgctgaccacggccacctacggtagccccgttattcatggtgcccgcattgaagacgcagcaacctccctacttaccctggatgaactgcgtacacagattcccaccgctgccaacaatgcgttttatctcgatgctgtccaagatggctgtcttattttagatattgaaaaaacctgtccccccgaggtcgcagccacactactcacgctctcccccaccgccttttacacagaggtgtccatgagtggtcgtggctatcacctcgttatgccgataccagagaattttgcagcgtttcctgccgtacacaacaaacccagtatcaaacaccccaagcgctggttcgaaattcttacctcacagtggatcaccttcacccgacaaccaatcccagagcatgttctccatcacagtgaatctgctaacacaagtgctgtgccatggttgaatgatcaaccacttacatgggaaaacgtctttgcagacttagctaaaactgttgcacccaacttaaaaaccggtgccggacttaccatcacacccaatgcactgatgccaccagatctcagcgatgctgagcgcattcgcgacgatgaagtcatcgactcgacctgtcgattatttgccgaacattactcgaaaacacttgcggacttctatgatgatgcatcccggttcgagttcagccaaattggtgtcattatcaatctactgctccccactatgaggatgcatcccaccacgatcagtctcgacaaacccatcaactccgatcacatcatcagacttctgttcgctgtcgctactcgcgtgatcactcaccgcagcaaacatgatgaggagcgatctggcgttccgtatctgatgtatcaggttatttcctgccttgacatgcgagaacaccccgacaatggcgactaccgtgtcgtaccctcccggcataatagagaccaacacagcaacaacccctcagctcatgtggtccaccaacaaccacaaccccagcccagcgcagcagattcgccacatcactaccgtgcactaccccaagaaaacacggtgtccgaacacagttttaaaatctataacccaccagccacaccccctctaggaggtgaaaattagatttattattaaaacacttg

SEQ ID NO: 2042 - protein, 426 aa, Corynebacterium glutamicum
MVNPFHTLDNSPFDPVAQFPAFYHNPLINHLGRRRAWTISDINKRPINVQQMLTTATYGSPVIHGARIEDAATSLLTLDELRTQIPTAANNAFYLDAVQDGCLILDIEKTCPPEVAATLLTLSPTAFYTEVSMSGRGYHLVMPIPENFAAFPAVHNKPSIKHPKRWFEILTSQWITFTRQPIPEHVLHHSESANTSAVPWLNDQPLTWENVFADLAKTVAPNLKTGAGLTITPNALMPPDLSDAERIRDDEVIDSTCRLFAEHYSKTLADFYDDASRFEFSQIGVIINLLLPTMRMHPTTISLDKPINSDHIIRLLFAVATRVITHRSKHDEERSGVPYLMYQVISCLDMREHPDNGDYRVVPSRHNRDQHSNNPSAHVVHQQPQPQPSAADSPHHYRALPQENTVSEHSFKIYNPPATPPLGGEN

SEQ ID NO: 2043 - DNA, 696 bp, Corynebacterium glutamicum
  CDS (101)..(673): RXA01043
tactaggtatagcaacggattaaataatcactataattaattctttccgtactcattttaatcactacctattcaccacttgaacggagcgtttttcgccatgttgaaattccgcatcatctccacagtcactactggatctcagccaactccacgaaaaagctggagccaccccgacaccactctcctggtcaccatggtcactgcaccatcgctgtgctcagccatcaacgtgtggaacgcaactgagcgtattcccgctcaaaaaatccttaatgtcgaagaagtacacgttcttggtgagtgcagcgacgccatcatctctacgtcactaaccaaaaaggacaatccgcacgcacttgtgcccgatgatttcgaccaaatcggcgatgtgtttggctatgcgcaagacaatgtagctgtttttgatgtcattgtcgcagcactgggcggtgctggttatggcctgctacccggactggtcatgcaccacattgatgagcacaccgttgcacttgtctttgatactgattcccctactgggacgcatatcctcggtgagcgctgcgtgtactccgacatcattcacatgactgacgataagtctgcccgtggctggggtgcagtcattgccatagcacgagccatcatcctcaaagtcgaacagatcatgtagtaccccaccatgactcactt

SEQ ID NO: 2044 - protein, 191 aa, Corynebacterium glutamicum
MLKFRIISTVTTGSQPTPRKSWSHPDTTLLVTMVTAPSLCSAINVWNATERIPAQKILNVEEVHVLGECSDAIISTSLTKKDNPHALVPDDFDQIGDVFGYAQDNVAVFDVIVAALGGAGYGLLPGLVMHHIDEHTVALVFDTDSPTGTHILGERCVYSDIIHMTDDKSARGWGAVIAIARAIILKVEQIM

SEQ ID NO: 2045 - DNA, 1380 bp, Corynebacterium glutamicum
  CDS (101)..(1357): RXA01044
cagatagccactacctacacgcatctgttgtgctgaaacaacagcgcgacactcactcttctcattactcaacaacttacttttaaggactacataacttatgtctctctaccttgacgacactttgtctcgcatcgttgaacttgatctcaaagacacccgcattgtgccgtttcttgctggtgaaccaggtatcggtaaaacctcattcatctacggcatcggcgaacgtgcaggctacaaagtcttcagtatctcggttaacacccttgccgataagggtgacctcacgggcgctcgcaccctgcaggaccctgccgatggcaagtggaagcagatgtttttcccgcacgcgaccttcgtcgaagcaaatgactatgcactagcaaacccaaacgaaacggtcgtcattcttctcgatgagattaaccgaactgattcggatgtcacctctgcctcgatgactatctctactgagcgtcgcgttggtaccaccgatctagcacccaatgtccgccttgctgtcaccggaaacctcaccggtaatgtcacccaccttgattcagcatctctgaccaggttctccctctatgaggtcaagccatccgcagagaccttcatgaacatcatgggcggccgcctcaacaagtacatccgtaccgtgctgaccaaatacccggaatacatcttcatgaagccaactactgctactgctcttattaccactggcgatgatgatgacgaccatacaaccaatgcgaagcaaatgatggacttcaacgctgtgctcggttcagaccaagacatggttcaatttaccgcacctagaactatcgaaggtttgtccgtctggctcaacaacgccgatgatgactttcttcgtctacttctacaagaaaaggtggatggtcttgctcgatccatgagcttgctgcaggctacgctcgaatctcacaccggcgataccgcttttaccgcagaagtcctcagcgaaatgaccaatgatctgctgagctccgcatcgcaagctcctagtggtccaatcaaaccatttgtctacgaccgactcgctgctgcaccaagcaatactgtactggaacaagaggttcacacactcagtctcaatgaccgcgccgatgtcttgttgtttgccctccatgacactgtaaacaacgctgcaccaagcatcatcgctcaccttgcatctgaaggcgtacttgatgaactgcccaaagacagaatcagcaaaattgtttcactcggtcctgtaccaacggcaaactatcacgccttgaccagacaggatacaacgttgactcgaaatctcggtcccgctgtcttgggcttcttggaaagttaaagcaatttcctaagtacctt

SEQ ID NO: 2046 - protein, 419 aa, Corynebacterium glutamicum
MSLYLDDTLSRIVELDLKDTRIVPFLAGEPGIGKTSFIYGIGERAGYKVFSISVNTLADKGDLTGARTLQDPADGKWKQMFFPHATFVEANDYALANPNETVVILLDEINRTDSDVTSASMTISTERRVGTTDLAPNVRLAVTGNLTGNVTHLDSASLTRFSLYEVKPSAETFMNIMGGRLNKYIRTVLTKYPEYIFMKPTTATALITTGDDDDDHTTNAKQMMDFNAVLGSDQDMVQFTAPRTIEGLSVWLNNADDDFLRLLLQEKVDGLARSMSLLQATLESHTGDTAFTAEVLSEMTNDLLSSASQAPSGPIKPFVYDRLAAAPSNTVLEQEVHTLSLNDRADVLLFALHDTVNNAAPSIIAHLASEGVLDELPKDRISKIVSLGPVPTANYHALTRQDTTLTRNLGPAVLGFLES

SEQ ID NO: 2047 - DNA, 1947 bp, Corynebacterium glutamicum
  CDS (101)..(1924): RXA01045
cagctgaggtagtcatctgtctacctgcgtggagtagacactaaatcctgtccacgcacccttacccttcttgacactagtaattgaaagcgatcccctcatggttaccttcagcgtcgcaaatcacgcgcctcatacttttagcccattcgatattgaaccaccactcaccggtaacgccaccaccgacgaacatggttacgaacacacctcagtgctagaaaaactagcctccaaccacctgttcaatccaatcaatccgcaacacccagtcactatcacagccaccgaaaacggatcaaccgttgatcttgatgcagcagcactagcacaacatcttgctctagcgattaccccagactcaatgctggcaaatcatcaaggctacaaccgtgacatgatgggtctactttcgcagcttactaaccatgttggctttgatcgccgattcattgttgaccaactctttatctcccaagtgctcaaagcgaatcgtctaccagcaccggcaaacaacgttatttacaccgtgcccaatgacgttatcccatctgctaaagacatcttgtccaccactgcaaaaatgaacaatccactgacagttactgcaagtgccccaattactgttgacgacattcacacagcctatgaggtatttttcgcttctcttgcctcagtgtttttcccttatacctacggtgcggtattccttaacaacgcagaattcgttgagtttgttgattaccttattaacgaagcaacaacactgcactcggcatcactcatctccaacaacacctttaataggttccaatcaatgcgtaacatctccattgataatctcaccgccgagtttctcttacgcaaaaatgaagcagagacaactgatgattattcattcccccgcgtacttgtttccctgctgcattcttgggtgaaactcaatcacgatgatgctcgtgctaacaatgatgcacccacctgtgcactagcaccgtttagtgtggctcaatggatcatgccggagaccattgtgtttattaatgctgaagctcatgctcatgcatcctcccaggacattgagaagaaatggaaggaaattaatgcggcgttaacagggtctattcgtattatgtcgccaaatgcaatttccaagctgcaatctgctcagcatctcgggatgcaagcacaaatgcaggccatgcgtgctcgaaaagatcaccacaacatgcagaagcgttcctcacaagaaaacgacttttccaaggcactcccctcaccacagactatcgtgctttctgtcgcagaggttctgcgcaaactcactcacgtacgccaatcgcacaaccctcagaaataccagaagaagtctctgaccagagcttctcgccgacacccggataaccctaatgtccctggcaccattaagagcaagctcttctaccctgacctgcatgtttatgtagatacttctggttcgattagtgaagaaagctaccgcaactctgtggttctgctcatgcagcttgccaccaaactggacatcaacctctatttctccaccttctctcacgtgctctccgaagaagtactattgccgaccaagggtaaaacaccacagcaattggcagctcttatttcggccatcccaaaggtctctggcggtactgactatcaccagatttgggattacatccagatcaatccgcagcgccaagaacgcatgaatcttgtgttaactgacttcggattcatgccgaatcgcggcttaaacatcgaccacccaagttctattttctacgtcccaatcctgcctgactacggcagctggtcaatggttcgaagagatatgtctcatttcgcaaatgaaatggttgacttcgacccctatatccacagccgactactcggcgtacacggaaaatagcagctgatccatctagggtc

SEQ ID NO: 2048 - protein, 608 aa, Corynebacterium glutamicum
MVTFSVANHAPHTFSPFDIEPPLTGNATTDEHGYEHTSVLEKLASNHLFNPINPQHPVTITATENGSTVDLDAAALAQHLALAITPDSMLANHQGYNRDMMGLLSQLTNHVGFDRRFIVDQLFISQVLKANRLPAPANNVIYTVPNDVIPSAKDILSTTAKMNNPLTVTASAPITVDDIHTAYEVFFASLASVFFPYTYGAVFLNNAEFVEFVDYLINEATTLHSASLISNNTFNRFQSMRNISIDNLTAEFLLRKNEAETTDDYSFPRVLVSLLHSWVKLNHDDARANNDAPTCALAPFSVAQWIMPETIVFINAEAHAHASSQDIEKKWKEINAALTGSIRIMSPNAISKLQSAQHLGMQAQMQAMRARKDHHNMQKRSSQENDFSKALPSPQTIVLSVAEVLRKLTHVRQSHNPQKYQKKSLTRASRRHPDNPNVPGTIKSKLFYPDLHVYVDTSGSISEESYRNSVVLLMQLATKLDINLYFSTFSHVLSEEVLLPTKGKTPQQLAALISAIPKVSGGTDYHQIWDYIQINPQRQERMNLVLTDFGFMPNRGLNIDHPSSIFYVPILPDYGSWSMVRRDMSHFANEMVDFDPYIHSRLLGVHGK

SEQ ID NO: 2049 - DNA, 1902 bp, Corynebacterium glutamicum
  CDS (101)..(1879): RXA01046
tagcgatcctaggcaaaatgcaccagctaaccccaccgctcaaccgccatctgcccccacctcacactcatcacagcagggtctccctccgggcgccattatgatcccttttccagggcaaccgcagcagcaaagcgcacccaatgacgagacccgtttcatcgaccttaacgaacgtcataaagatgatgaaccagccctgtttcgcgatgatgttattgatcaaactctcgctattttgatcagtaaaaataagcccaatgcgctactcgttgggcctgccggtacaggtaaatcccgtatcgcagaagatattgcgcgccgccttgccaatgatgacgtatctattcccgatcagcttgtcggccaccgtattcttgatgtctccattgcagagcttgttgctggtgctggcgttgttggtcagctcaagaaacgcattctggatctcatcaagtatgcgaccgacccgagtaacaaagtcattatctttattgacgagattcaccaaattgctggtgatcagtccagtcacagtggatcgcaagccaaagttgctcagattctcaaaccctatcttgcccgtggtgaccttcgtgttattggtgccaccaccacccaggaagctcgtgacttcgatcatgatccagccctcaaacgccgttttagcagagtaaatgtcgatgaatttgatcgagatcaaacgctcactattcttcatgctgcacgtgatggttacctcaaacatttcaacaacgctgtcacggtatctgacgacgtactgggctatgtctacacctactcgcagcaattcaacccaggcaatacagcacaacctgatgcagcactgacgctgtttgataaggcgttggcttccctaactatggagaaacagcgtctgatcaacaaccatgtcattgcgccgtcgctcaagttccctgtgtcagaaaggcacatccataacaccgctcgcaaacttgcctttggctctcaagtgccagcctccatcaatactgatgatgctcgtgacaaactcgaaacgttgtttggtcaagatcatattattgagccagtactcaccgctatcaagcgtgaacagcttggtattttccctcgcaccaaaccattgagctgggtgtttgctggttcatctggtgtgggtaaaacagaaatggcgcgtattctctctcgcgccattaatggcggcgatcccatcattatcaatggtcccgaatacattagtcctgagtccattactggccttatcggatcatccgatggctatatcggctctaattctaagcgtgctaaaccactcgacccgctgatttctaatccgcgtcaggtgattgtgctcgatgaatttgagaagtctcaccctcatttccagcaattgttcatggcagctcttgatacaggcactatggcgatggctaatggcacgacattgaatttctctcaggccattatcattgccaccaccaatgcagcccgcgacaaaatcggtcgtgacagctttggattcgattcagataattcaggtgtcctcggttctgctcaagcagcaactgatccgcgtgcacaggaacgcctcaagtcactgatgtccaaggatttcctgttgaactgctcaaccgtttccagaatatctttgccttcaaccgcattgatgcaggcacctaccgtgagattctggacaatctctaccagcgtcgccgtgacgccgtgctgcttagccaccccgcattacgcagcacagatccctgcagatattgattcagacactcttgatcagctggtggaaaccacctttatctcagattttggtgcacgtcctgctgcacgcaccatcgaagaccacatcgcatccttgctgatgtgaccaaccttttaggagtacat

SEQ ID NO: 2050 - protein, 593 aa, Corynebacterium glutamicum
MIPFPGQPQQQSAPNDETRFIDLNERHKDDEPALFRDDVIDQTLAILISKNKPNALLVGPAGTGKSRIAEDIARRLANDDVSIPDQLVGHRILDVSIAELVAGAGVVGQLKKRILDLIKYATDPSNKVIIFIDEIHQIAGDQSSHSGSQAKVAQILKPYLARGDLRVIGATTTQEARDFDHDPALKRRFSRVNVDEFDRDQTLTILHAARDGYLKHFNNAVTVSDDVLGYVYTYSQQFNPGNTAQPDAALTLFDKALASLTMEKQRLINNHVIAPSLKFPVSERHIHNTARKLAFGSQVPASINTDDARDKLETLFGQDHIIEPVLTAIKREQLGIFPRTKPLSWVFAGSSGVGKTEMARILSRAINGGDPIIINGPEYISPESITGLIGSSDGYIGSNSKRAKPLDPLISNPRQVIVLDEFEKSHPHFQQLFMAALDTGTMAMANGTTLNFSQAIIIATTNAARDKIGRDSFGFDSDNSGVLGSAQAATDPRAQERLKSLMSKDFLLNCSTVSRISLPSTALMQAPTVRFWTISTSVAVTPCCLATPHYAAQIPADIDSDTLDQLVETTFISDFGARPAARTIEDHIASLLM

SEQ ID NO: 2051 - DNA, 597 bp, Corynebacterium glutamicum
  CDS (101)..(574): RXA01047
aaccacctttatctcagattttggtgcacgtcctgctgcacgcaccatcgaagaccacatcgcatccttgctgatgtgaccaaccttttaggagtacatcatgattgataccactgctaacagcacctcaggcaccctacctacactcactgctgaccaagctgcgtttatcaccggtttttgcgaggctgctatcttcacagccaccgtcacaatagataacgaacctatatttcttgatgaagcgttcttcttaggtcaagaaacctataccgacattctcatgaatcaactccgcaccaatgaagccattgttaaagactgtctcgacttcttccttgacaactacaccacaatgaacaagctcattgttgatggtctatgcccagattgggagcaccacggccatgatttcctactcacccgtgaccatcatggtgccggattctgggatcgtggctacgacgaatacggtgcccaactcaccgacaatgccgaaaaatattcagaaaactgtctcaatttctggattgagcctgatagtgaccctctcattatcaacttcgagtaccactaacaccccttgaccttattttt

SEQ ID NO: 2052 - protein, 158 aa, Corynebacterium glutamicum
MIDTTANSTSGTLPTLTADQAAFITGFCEAAIFTATVTIDNEPIFLDEAFFLGQETYTDILMNQLRTNEAIVKDCLDFFLDNYTTMNKLIVDGLCPDWEHHGHDFLLTRDHHGAGFWDRGYDEYGAQLTDNAEKYSENCLNFWIEPDSDPLIINFEYH

SEQ ID NO: 2053 - DNA, 444 bp, Corynebacterium glutamicum
  CDS (101)..(421): RXA01058
ctcccgtaataggggtaattttgcaattaactgcgcttaaagtaagaaacattgctaatctttatctgggtaattaacaatcgattttaaggatattctcatgcgtaaacttcgtactgcttccgttgcactgctgaccgcaggtgcacttgcactgaccgctactcctgcaatggctcagtccaccaccggttcttctgcatcttctcaggttggcgacgcactcggtgctagcgactacgagcgcgacatctggggttcctctaaggacttcgacgatgtaaccccattcggttccgcttggtacggctacaccctggccgcaaccgcagttgctatctccggtcttgtgtacgcaaaccttcctgcaatcgagcaggctgctgcacaggccggcatcaagctggagatcccacgctactaattgccactgcaatcttaaat

SEQ ID NO: 2054 - protein, 107 aa, Corynebacterium glutamicum
MRKLRTASVALLTAGALALTATPAMAQSTTGSSASSQVGDALGASDYERDIWGSSKDFDDVTPFGSAWYGYTLAATAVAISGLVYANLPAIEQAAAQAGIKLEIPRY

SEQ ID NO: 2055 - DNA, 453 bp, Corynebacterium glutamicum
  CDS (101)..(430): RXA01063
actttcttgtagaggtctgggtagtggataagttaatcaactatgaaatagactaacttaatcattaacattaatggattttcggagaatagggatagacatggcagacgagaaaaaggttcatgtacgtgccacactgcgctttgattcagacacccaccagcgggcaatttattgggcagatcgaaaaggtatctcgctgagcgcgtatgcagaagaggcgatcagagagaagattgatcgtgataacggtgtgcacgttattccgaattcactgttggataaccgcatgaaccaaatcattgatcagctcagctcgtttggtcgtgagttggcgaacaacacgacagttgtaactagtggtttcaacaccattatcggtatgactcgtggcgactcgtatctctctgatgatctcgatgacctgggttaaacccgatgaacgagcaggaa

SEQ ID NO: 2056 - protein, 110 aa, Corynebacterium glutamicum
MADEKKVHVRATLRFDSDTHQRAIYWADRKGISLSAYAEEAIREKIDRDNGVHVIPNSLLDNRMNQIIDQLSSFGRELANNTTVVTSGFNTIIGMTRGDSYLSDDLDDLG

SEQ ID NO: 2057 - DNA, 849 bp, Corynebacterium glutamicum
  CDS (101)..(826): RXA01066
aaacgtattccttgacctgcgcatcaaggtgctgaagaactggcaatccgatccaaaggctttgaaccgcctgggcttctagctttaagggggtgagttcatgcgtagggacagttttcgggaccgcgcgctagtagtcaaaacttatgattttggcgaagccgaccgcattattgtgctgctcacccgagaccacggcatcgtgcgcggagttgccaaaggagtacgccgatccaaatcccggtttgggtcaaggctgcagctttttgtggaactcgacgtgcagctctacccaggtagaaaactgtccaccatctctggcgcggacaccgtcggctactacgcatcaggcatcatcgaggacttcactcggtattcctgtgcgtccgccatcctggaaatcgccacccacatcgcaggactggaaaacgatccgcacctgtttgaagaaaccacccgggcgttgaaaaacattcaggactccccagaacccatcctcaacctagacgagttcatgctccgcgccatgaaccacgccggctgggcaccaagccttttcgactgcgcagcctgcggccgaccaggacctcacaacgcattccacccaggcgtcggcggggcagtgtgcctgtactgccgaccgccgggaagcgccgaagtcccaccagaagcactacacatgatgtggttggtcgccaacggccaagcagcccgcattccccgggaacacccagagcagcaaaccaccattcaccaactgacaaccgcgcatctgcagtggcatattgaaagaaagctgcccacgctggcggtgctggatcaggcctagtgcttaggcttaggcgtccg

SEQ ID NO: 2058 - protein, 242 aa, Corynebacterium glutamicum
MRRDSFRDRALVVKTYDFGEADRIIVLLTRDHGIVRGVAKGVRRSKSRFGSRLQLFVELDVQLYPGRKLSTISGADTVGYYASGIIEDFTRYSCASAILEIATHIAGLENDPHLFEETTRALKNIQDSPEPILNLDEFMLRAMNHAGWAPSLFDCAACGRPGPHNAFHPGVGGAVCLYCRPPGSAEVPPEALHMMWLVANGQAARIPREHPEQQTTIHQLTTAHLQWHIERKLPTLAVLDQA

SEQ ID NO: 2059 - DNA, 1194 bp, Corynebacterium glutamicum
  CDS (101)..(1171): RXA01068
tggtctaccaagacaagctgttccctgatttcacgcagcaagatctgtacgacgcggtcctggaatacgccaagcgggatcgcagattcggaagcgcataatgcccaccaaccagccgacgccagcccaaatcaaacgctggcgcggatacctggccaatgagcaagcagaggccgcagcctaccgcgacctggccaaacgacgcgaaggcgaagagcgagacatcctcctagcgctcgccgacgctgaacaccgacacgccgcttactgggtggaaaagctcggccctgatgccgaaaacccaccaaaagccgacgtcaaaacccgcctgctcggttttctagcacgccgattcggctccgtgttcaccctggcactcatgcagtccgccgaaacgcgcagcccctacgacgacgatgccgacgcctcccgccaaatcagcgccgacgaacgcatccacgccgaagtcgttcgaggcctagccagccgcggcagagaacgcatgagcggcaacttccgtgccgccgtattcggaatcaacgacggcctggtctccaacgtcgccctcgtcatgggtgtcatggccaccggcgtgcccgcccaaattgttctcatcaccggcatttccggtctgctctccggcgcgctatccatggccgccggcgaatacatctcagtgcgctcccaaacagagcttctcgacgcctccctcccagaccccaaagcccgcgaagccctccacgccctcgacgtcgaatccaacgaactggaactcgtctaccgagcccgcggaatgagcgaagacgaagcgcgggcaaaagcgtcacaagttttccaaagaatcagcgaccaaaaacgcatcagcgacaacgtcctcggcagcaccgaaatccaaagcgccggctccgctcgttcggccgccacattcagcttcctgtcctttgccatcggcgcattcctcccgatcgtcccatacgtcttcggcatggaaggcctcgccggggcagtggtgtccctagtcctcgtcggactatcactgatggcaacgggcgcgaccaccggcctgctatcgggaaagccaccgggaatccgcgcggtgcgtcagctgtcgatcggctacggcgcggcgctggtcacctacgtgctcggcctcctgttcggcatgatcctttaaaagctcttgcttctcgacgt

SEQ ID NO: 2060 - protein, 357 aa, Corynebacterium glutamicum
MPTNQPTPAQIKRWRGYLANEQAEAAAYRDLAKRREGEERDILLALADAEHRHAAYWVEKLGPDAENPPKADVKTRLLGFLARRFGSVFTLALMQSAETRSPYDDDADASRQISADERIHAEVVRGLASRGRERMSGNFRAAVFGINDGLVSNVALVMGVMATGVPAQIVLITGISGLLSGALSMAAGEYISVRSQTELLDASLPDPKAREALHALDVESNELELVYRARGMSEDEARAKASQVFQRISDQKRISDNVLGSTEIQSAGSARSAATFSFLSFAIGAFLPIVPYVFGMEGLAGAVVSLVLVGLSLMATGATTGLLSGKPPGIRAVRQLSIGYGAALVTYVLGLLFGMIL

SEQ ID NO: 2061 - DNA, 828 bp, Corynebacterium glutamicum
  CDS (101)..(805): RXA01074
cgaatgaaatcactgggcgggagttcaccctcggcgaggagcctgagcgctactagctttgccacatttcactaaacgccccgcacaaccccaagcagccttggcggaagccgcaggtctacgctggctcgccgaagcatcttcagctgtggcacaggttgttagcgccgacgcagagcagatcacgactgttggcgtcgaaacgcaattgcccacacccgatgcggccttcaaggccggcgaagagctcgcccgcatccaccttgccggcgccccagcgttcggctgtccaccagcgggctgggcggggttaaactacatcggcacccagggacaagcatgcttatcgacgcccacctggggtgttttttactcccagcaacgcgtactcccgtttgcgcgccgggcacgcaggcgaaatcacctcaccgagcacgcactctgggtcgtggaagccgcttgtgatttgattagcgaacttcccgatgacgttccccccgccagaatccacggcgacttgtggtttggcaacctactttttggcacagacgggcctgtgtttattgaccccgcagctcacggcggtcatcccgaaactgatctcgcgatgcttgatgtatttggcgcaccctatctcgatgaaatccgggaaggttatctgtctatcaacccgctgccagacgggtggcgtgaacgcacccccatgcaccaactccaccctttggccgtacatgcggcgtctcatgggccaagctacggcgtggaactactccacgccgccaaagcgacactcaaactgttggattaacgccaccaattttcctgcgg

SEQ ID NO: 2062 - protein, 235 aa, Corynebacterium glutamicum
LAEAAGLRWLAEASSAVAQVVSADAEQITTVGVETQLPTPDAAFKAGEELARIHLAGAPAFGCPPAGWAGLNYIGTQGQACLSTPTWGVFYSQQRVLPFARRARRRNHLTEHALWVVEAACDLISELPDDVPPARIHGDLWFGNLLFGTDGPVFIDPAAHGGHPETDLAMLDVFGAPYLDEIREGYLSINPLPDGWRERTPMHQLHPLAVHAASHGPSYGVELLHAAKATLKLLD

SEQ ID NO: 2063 - DNA, 1143 bp, Corynebacterium glutamicum
  CDS (101)..(1120): RXA01076
tcctcccattaagcaccttgtcttccggaagcttccaccccaaattccaaaccccaaattccatgccccggatggacatttttcattacactcgggggctatgactccagctcacatattttctgaaggtccaatcaatagtgttgttctcagccaggatgaggatggaaatttcaccacctcctaccaggacacgttctctgatccatcatttttgggggaaggtgacgttctaattgaggttggttggtccagcttgaattacaaggacgcaatggctctgaagggtgataagggagtggtgcgtactgtgccactgattccaggtatcgatgtggtgggcactgtgatcgagagcgctgatcctcgctttggtcgtggtgatgaagtggtgctgaatggcgctggtttgggggagaaccggcatggaggtttcacgcagcggctgaaagtgccgtctgaaccgttgctgcatattccatttaacttctccgcgcagcaggtgggtgcgttgggtactgcaggtttcacggctgcgctatcggtgaatgctctggtcgatcaaggtatcaaaccggaggatggggagattctggtaactggttcgactggtggtgtgggttcgattgcacttcacctgctgaataagttgggatatacgacggtcgcggtgacggggcgtcgagaagcgcatgccgaatacctgaccagcctgggcgcaagcgacatcattgatcgcgcggagctttctgaaaagggccggccgctgcagaaggggcgttgggcgggtgtagtggattcagtgggatcccacacacttgtcaatgcgattgctcagacaaaatggggcggaattgtcacggcgtgtggcatggctcaggggccggatctgccgggaacggtgttgccgtttattcttcgtggcgtgcatttggttggcattaactctgtcgatgcaccccgtgagctgcgtcgacgtgcgtgggcgttgctgtccgagcatcttgataccgcggtgctagatgatatgaccactgtgattgatgtcaaggatgttgctcaagctggcgaagatttgatggctggcaagcttcacggacgtaccgcggtgcgtgttcattagcaggtcaagcgcgtaattga

SEQ ID NO: 2064 - protein, 340 aa, Corynebacterium glutamicum
MTPAHIFSEGPINSVVLSQDEDGNFTTSYQDTFSDPSFLGEGDVLIEVGWSSLNYKDAMALKGDKGVVRTVPLIPGIDVVGTVIESADPRFGRGDEVVLNGAGLGENRHGGFTQRLKVPSEPLLHIPFNFSAQQVGALGTAGFTAALSVNALVDQGIKPEDGEILVTGSTGGVGSIALHLLNKLGYTTVAVTGRREAHAEYLTSLGASDIIDRAELSEKGRPLQKGRWAGVVDSVGSHTLVNAIAQTKWGGIVTACGMAQGPDLPGTVLPFILRGVHLVGINSVDAPRELRRRAWALLSEHLDTAVLDDMTTVIDVKDVAQAGEDLMAGKLHGRTAVRVH

SEQ ID NO: 2065 - DNA, 957 bp, Corynebacterium glutamicum
  CDS (101)..(934): RXA01078
atcattcacgagctcgatagccgacaggtttctgaactcacagaagccctggccaaagtctccaccacccgcagctaaaactttttgaaaggagctcatcatgagcaacgcagtaccccacaacgtttccttcaactttgttccccgcgcttaccgtccagaaaagccccgcacattcggcatgacagaaattcgtgcaccgtactactccactttcggcacccgacacctccaggatgtcttcgatgttgcaggccagtgggtggacggcatcaaatgggcaggcggttccttctccctggtgccgaccgaacaggtgcgtgcttttagcgacatcgcccatgaaaacaatgcctatgtgtcttccggtggctggattgaaactgtgcttcgctacggcgacgacgcagttgatcattacttaaaggaagccaaggaagtcggcttcgatgttattgagatttccaccggattcatcatgctcaacacttcaggtcttcagcgcctggtagaaaaagtggtcaaggcaggcctcaaagcaaaacctgaactaggactacagattggttccggaggcgactctggtgaggctgaacttgcagccgaaggaaagaaagacattggcgatctggttgaccgcggtaaaaaagctctcgacgccggcgcatccatcatcatgatcgaatccgaaggcatcaccgaaaacgtcaccgaatgggatacaggcgctgccgcgtccatcatcaatggactgggattagaaaacgtcatgttcgaagccgccgacggccccgtctttgagtggtatgtcaaaaactacggcaacgaatgcaacctgttcgtcgaccacagtcaaattctgcaacttgaagggctgcgccaaaacatctggggcaacaagagcacctggggacgagtaatcaaccctgcgccttaaataccaggtcagggagggca

SEQ ID NO: 2066 - protein, 278 aa, Corynebacterium glutamicum
MSNAVPHNVSFNFVPRAYRPEKPRTFGMTEIRAPYYSTFGTRHLQDVFDVAGQWVDGIKWAGGSFSLVPTEQVRAFSDIAHENNAYVSSGGWIETVLRYGDDAVDHYLKEAKEVGFDVIEISTGFIMLNTSGLQRLVEKVVKAGLKAKPELGLQIGSGGDSGEAELAAEGKKDIGDLVDRGKKALDAGASIIMIESEGITENVTEWDTGAAASIINGLGLENVMFEAADGPVFEWYVKNYGNECNLFVDHSQILQLEGLRQNIWGNKSTWGRVINPAP

SEQ ID NO: 2067 - DNA, 399 bp, Corynebacterium glutamicum
  CDS (101)..(376): RXA01083
gtcgacatactggcacgcaagatctgtgtacccggcccacgtgcctaaaactaggtgagcgagaccttcgagcagttcctcgaaggagagtgatccacctatgtttccgcgaattccgctggcaatgtgtgctgtcgcagcaatccctgctgttgtgctcaggttttctgagctgtcggcgtcacctgtggcgaccatgctgatttttggtaccgcagtggttgctgcctcttttgtgttggcgtgggcagctgaagctgtgcgcaaagatatttctggtgcgttggcagtggccttgcttgcgttagttgcagtgcttcctgaatatgcttctgaaacggttgtcgagcacacttatcaaacatcggcggcgaattaagaaggtgaacagttgacgca

SEQ ID NO: 2068 - protein, 92 aa, Corynebacterium glutamicum
MFPRIPLAMCAVAAIPAVVLRFSELSASPVATMLIFGTAVVAASFVLAWAAEAVRKDISGALAVALLALVAVLPEYASETVVEHTYQTSAAN

SEQ ID NO: 2069 - DNA, 1305 bp, Corynebacterium glutamicum
  CDS (101)..(1282): RXA01088
tgccttgagtctaattctcccgcccgtgcgatgggtttaagctggactgataaaccttttgtgaaccgaattttttaactgatttgaagaagcgagaataatgggactgtggatcgatgcaaccgctggcgttgcaggggatatgttgctgggagcactcattgatgcaggtgcagaactagaaaaaatccaacaggttgtggaagcagtcatccccggtgacgtgctcttgcgcaccgaagaggtagtgcgccaaggccaacgaggcatcaagctgcatgtggacgcacaacatgaacaccatcatcaccgccacttaagcaccattaaagaactgcttgtcaatgctgacatccctgaacaaaccaagcaggatgccttaggcgtttttgaactcatcgctatcgctgaaggaaaagtccacggcatcgagccggagaaaatccacttccatgaggtaggagcttgggattccatcgcagacattgtgggtgtgtgcgaagcgatcaggcagcttaacccaggtttgattgctgcatctccgattgctttaggattcggacgcatcaaggcagctcacggagatattccagtgccagttccagccgtggcagagctggtgaaaggctggcccacccaaaccggagctcttatggagagcaccgaacctgttggtgaattagccaccccaactggtgttgcgttgatccgtcactttgccacccaagatggccctttcccaggtggcatcatcaatgaagttggcattggtgcaggaacaaaagatacagaaggccgtccaaatatagtgcgcgcaattttgttcaacacctctaggagtaacccagatacccgcacactggtgcaattagaagccaatgttgatgatcaagacccacggctgtggccaggagtaatagagatcctctttgccgctggcgcagtagatgcatggctgactccaattttgatgaagaagggccgtcctgcacatagggtgtcagcattggtggatagctccgaggtggaagcagtgaaaaccgcattatttgcagccaccacgacttttgggatcagatcatgggaagtcgaacgagaaggcttggaccgtcgtttcgaacaagtcgaggtggacggacacaccatcaacatcaaaatcggttcccgtgatgatcaagtaatcagtgcacagtccgagtttgaagatattcggtctgcagcggtggccttgggaatttcagagcgggaagttgtggcaagaattccgcaaggcaccaccgagtaacaaccaaaaggtcgactgct

SEQ ID NO: 2070 - protein, 394 aa, Corynebacterium glutamicum
MGLWIDATAGVAGDMLLGALIDAGAELEKIQQVVEAVIPGDVLLRTEEVVRQGQRGIKLHVDAQHEHHHHRHLSTIKELLVNADIPEQTKQDALGVFELIAIAEGKVHGIEPEKIHFHEVGAWDSIADIVGVCEAIRQLNPGLIAASPIALGFGRIKAAHGDIPVPVPAVAELVKGWPTQTGALMESTEPVGELATPTGVALIRHFATQDGPFPGGIINEVGIGAGTKDTEGRPNIVRAILFNTSRSNPDTRTLVQLEANVDDQDPRLWPGVIEILFAAGAVDAWLTPILMKKGRPAHRVSALVDSSEVEAVKTALFAATTTFGIRSWEVEREGLDRRFEQVEVDGHTINIKIGSRDDQVISAQSEFEDIRSAAVALGISEREVVARIPQGTTE

SEQ ID NO: 2071 - DNA, 594 bp, Corynebacterium glutamicum
  CDS (101)..(571): RXA01091
tcgtcggaaaaactggcgatactattgataacgggcatgggttcaccttcgataaagcacggtctatgctggactatcgccttttgacacgagtatcgcaatggtcccgaacacagtccttatccatgacgaaaccgccgatctggcgacgcagatccagcggctggaacatatcatggcgtgcctgcgcgatccggtcagcggatgcccgtgggatattgaacagacctttgccagcatcgcgccccacacgattgaggaaggctacgaggttgccgacgccatcgcgcaggaagactggcccgagctacgcggcgagttgggcgatttgctgtttcagaccgtgtttcacgcccaaatggcgcgcgaggcaggccatttcgctttggttgacgtggtgaaggcaatttcggacaagatggttttgcgccatccgcacgtgttcggcgcgcagtcgaacgcgaaatccgccgaccagcaggtgaagattgggaagtcatcaaggcgcccgagcgcgcgggcaaagcgcaaaagggcgttttggatggcgtcgcgctgggactgcctgccctgatgcgcgcgacgaagctgcaa

SEQ ID NO: 2072 - protein, 157 aa, Corynebacterium glutamicum
MVPNTVLIHDETADLATQIQRLEHIMACLRDPVSGCPWDIEQTFASIAPHTIEEGYEVADAIAQEDWPELRGELGDLLFQTVFHAQMAREAGHFALVDVVKAISDKMVLRHPHVFGAQSNAKSADQQVKIGKSSRRPSARAKRKRAFWMASRWDCLP

SEQ ID NO: 2073 - DNA, 280 bp, Corynebacterium glutamicum
  CDS (101)..(280): RXA01092
tgaacccatgcccgttatcaatagtatcgccagtttttccgacgagatgacccgctggcggcgtcacctgcatcaaaaccccgaaatcagctttgattgtgtggaaactgcggccttcgtggccgagcagctgcgcagcttcggggtggatgaaattcacaccggcatcgcgaaaaccggtatcatcgccctgattcacgggcgcgaggctggccccgtcgtcggcctgcgcgccgatatggacgcgctgccgctgaccgagattaccggcgtctactat

SEQ ID NO: 2074 - protein, 60 aa, Corynebacterium glutamicum
VETAAFVAEQLRSFGVDEIHTGIAKTGIIALIHGREAGPVVGLRADMDALPLTEITGVYY

SEQ ID NO: 2075 - DNA, 280 bp, Corynebacterium glutamicum; identical to SEQ ID NO: 2073
  CDS (101)..(280): RXA01092

SEQ ID NO: 2076 - protein, 60 aa, Corynebacterium glutamicum; identical to SEQ ID NO: 2074

SEQ ID NO: 2077 - DNA, 822 bp, Corynebacterium glutamicum
  CDS (101)..(799): RXA01096
accgtgaaacaaaccggcggtgcgtgccacactggtgcccacacatgtttcgacaatgacgttttgctgtaaaagcaacaacgattaaggaagaaatcttatgaagccacgcgtgctgtcagcattaggcattggagctggcgccctggttgtctggatcagctcacgcatgaactgggtaaccatcgaggctttcgacgataaatcaggtagtgtcacccaatctattgtgggtgcaacctggtctacagaaatcatggcgcttgcacttgctttgctcgctgccttcgccgccgcgttggtgctcaagcgcatgggtcggcgcatcattggtggtatttcggcgctgatcgcggtgggtgccagcctgtctccactcgcgcttctcacccaagacccagacgcagaacgggcccgaaccctgctgacctccggtgtggcctcacagaaggctaattccggaaccctgctgtctgattgggcggagatcatcaataccaccacccatccactggcggcagtggtagccatgattggctgcgcgctagccctagtcggcggcgttgtccttgccatgcgccctgccgaggacaccgcgaaaagcaatcagtatgagcgtaaacaggctcgcgctgagaaaatccacaccgatttggcccaagatccagactccggtcgtgtgatgtggacgcactcgatgaagacattgacttcaccgagaagactcagaaatccaaagaaaccccaggtcaaagctagggtgtggcaccctgatttctttcgccatgtgtgttcgggataaccttaaacacagcattggtt

SEQ ID NO: 2078 - protein, 233 aa, Corynebacterium glutamicum
MKPRVLSALGIGAGALVVWISSRMNWVTIEAFDDKSGSVTQSIVGATWSTEIMALALALLAAFAAALVLKRMGRRIIGGISALIAVGASLSPLALLTQDPDAERARTLLTSGVASQKANSGTLLSDWAEIINTTTHPLAAVVAMIGCALALVGGVVLAMRPAEDTAKSNQYERKQARAEKIHTDLAQDPDSGRVMWTHSMKTLTSPRRLRNPKKPQVKARVWHPDFFRHVCSG

SEQ ID NO: 2079 - DNA, 1368 bp, Corynebacterium glutamicum
  CDS (101)..(1345): RXA01102
attctatggttgttgggagagatgacttaatttggaatcacgggctttaacacgcgctgacattgagcaacttcccagcatgtggaaaagcccaggtttcgtggctgtcctcgtggcggttgcagcagcgttcggcagttggtcactccttcttcccgtcgtaccgctagcggtcctcaacaacggcggatcaagcgctgtcgccggtgccaccactggcatcttcatggcagctacagtgatcactcagattttcactcccgctgcgctgcggaaaattggctacaccccagtgatggctttcgccgcattcatgctgggtgtgccagccatcgggtacatcttcagcgtcgagccaattccagtgctggtagtgtccgcacttcgaggaattgggttcggtgcgctcaccgtcgcagaatctgcgttggtggctgaactcgttcccgtacgcttcttgggcaaagcttctggaatgttgggcgtatttattggcctttcccaaatgcttttcctgcctgccgggttggcgttaggtgaccaatttggctacaacgtggtctatgttttaggtgccgttatcgcactagttgcagcggtgatgtgtctgcgtattccgcaggttaaggcagcggcaaagcagcaaccacaggtgagcgaacaggagcgttctgtttccacctggaagttggtgctggttccctccttggctgttaccagtttgtcaatgacttttggcgcagtgtcttcattccttccagctgcagtcattgagttagatccaggattaggtgctgcattagcgggtattattttatccattaccggtggttcttcaatggtgttccgctacctgtccggcgttatcgctgaccgccgcggtgtgcctggtaccacgatgattcctgctcagatcattgggttcttaggtgtcgttttaatcaccgtcacaatcttccaaggctggtccgtgtggcttttgattataggtgcagtgatgtttggtggtgcttttggcatggtgcaaaacgaagcgttgctttcaatgtttttccggcttcctcgcactagagtctccgaagcctccgccatctggaatatcgcctttgattcgggaacaggaatcggaagcttcctccttggcatagttgccgcatcgcttgcttacagtggtgcttttggttccggagccgtggtgattttgtttggaatcgttttgaccaccgccgatcgaatcattgggcggcaccgcattactgaatacaacaacacccgcgcgcgtttgcgccaggtgccagtcgctcggcgtgcagtgcaagggctgcgcaacaggcgcaaagatcgctaaaacgcttttcgacgccaccc

SEQ ID NO: 2080 - protein, 415 aa, Corynebacterium glutamicum
VAVLVAVAAAFGSWSLLLPVVPLAVLNNGGSSAVAGATTGIFMAATVITQIFTPAALRKIGYTPVMAFAAFMLGVPAIGYIFSVEPIPVLVVSALRGIGFGALTVAESALVAELVPVRFLGKASGMLGVFIGLSQMLFLPAGLALGDQFGYNVVYVLGAVIALVAAVMCLRIPQVKAAAKQQPQVSEQERSVSTWKLVLVPSLAVTSLSMTFGAVSSFLPAAVIELDPGLGAALAGIILSITGGSSMVFRYLSGVIADRRGVPGTTMIPAQIIGFLGVVLITVTIFQGWSVWLLIIGAVMFGGAFGMVQNEALLSMFFRLPRTRVSEASAIWNIAFDSGTGIGSFLLGIVAASLAYSGAFGSGAVVILFGIVLTTADRIIGRHRITEYNNTRARLRQVPVARRAVQGLRNRRKDR

SEQ ID NO: 2081 - DNA, 348 bp, Corynebacterium glutamicum
  CDS (101)..(325): RXA01103
ccgaagcagagtacaaggctgttgcccgtgcgctgcgcggtgccgtagagatggatcctcgtcaaacaggaatcccatccactaagggagcgctctagacatgaactcttctcccatctctgatatggtcactgcggctgtgcagaacgaaccagatgcgggcgaccgatggtttatttatggtttgttcctcatcgccgggcttttctttggcggtgcctggtctgcatataaatcagaaaacaaaatcctcatggttgcagccggcctcatcgcagtgctggcagtggctggaggaattctatggttgttgggagagatgacttaatttggaatcacgggctttaa

SEQ ID NO: 2082 - protein, 75 aa, Corynebacterium glutamicum
MNSSPISDMVTAAVQNEPDAGDRWFIYGLFLIAGLFFGGAWSAYKSENKILMVAAGLIAVLAVAGGILWLLGEMT

SEQ ID NO: 2083 - DNA, 1323 bp, Corynebacterium glutamicum
  CDS (101)..(1300): RXA01107
gggtacatcagagttcatttgaattagacttaaaacttaaaatgaccaccccagatttacctgaattaaacccgctttcacctttgagatactggaaggaatggatttcacctctgtgaatgatcgaaacgtccctgcacccaacacctccattcctttcccagttgacctgaatcgagtgacggaggctgttgattccttgggctaccactatttgagctcagaagatcgcatcatcgtgccgtggcaagatcaccgcatttcgatgtacttcagccacgaatcagggcaaatgctcaccatccttggtcgcacgcgccttaatttggacatgtttgccatcaacgatgcggcgcgagctgtcaccgaatggaatgccgaacgcatcgggccaacagccctcgtccatctgggcaacgacggcgaagtggaattgaaattccgcacgaccatctgcatcgatgaagggttaagcacccaacagctacgccaattcatcaacctgtccttggacaccaccgccatggctgtgacctatattctggagcgtttttcagaacttaacttcagcgacaccggaagccctgacgacacgaacaatgccgatgaactcagcgacgaacaagaccaagcagatctcgtagagaaaatccgggggctgtacgttcccactccagttgaagagctcatcgaatccctagaagacgcagagtgggaagaatcagacatggcagacgaggatgcagaagacgactacctagacgatgactcagaaatcgaatgggaaacagacgatgactacttcgaacctgaagaagtcgacatggacgaactcctcaacggtttcctcgaagattctgacatcccccaggaagtcaccttggaacgcattcgggcacaactgcatgccatcggcgtggtaaaaaccagcggcgaagacgatttcatcatcgcgtggatcaacgaagtgtttttaggcttcttcgttgataatggccccactttcctggtgaaaggtcactgggatcccagcatggaccccacacgcgacttcatgaaactgttcatgatgtgcaatcagtggaacgaaaactctctgactaccaaagctttttgccatactgatgacaagggtctccaggtccgggtagagttcgcggtctctgtcgctgaaggcctcaacgacgatcaactacagcacaacatcgcactgtcaattcatcatattttgcaagcgattgattccatcagcacagaagccactggatcatcaacggtggaatggccggagaaaaaccgctgatcattaaggtcttccaagaa

SEQ ID NO: 2084 - protein, 400 aa, Corynebacterium glutamicum
MDFTSVNDRNVPAPNTSIPFPVDLNRVTEAVDSLGYHYLSSEDRIIVPWQDHRISMYFSHESGQMLTILGRTRLNLDMFAINDAARAVTEWNAERIGPTALVHLGNDGEVELKFRTTICIDEGLSTQQLRQFINLSLDTTAMAVTYILERFSELNFSDTGSPDDTNNADELSDEQDQADLVEKIRGLYVPTPVEELIESLEDAEWEESDMADEDAEDDYLDDDSEIEWETDDDYFEPEEVDMDELLNGFLEDSDIPQEVTLERIRAQLHAIGVVKTSGEDDFIIAWINEVFLGFFVDNGPTFLVKGHWDPSMDPTRDFMKLFMMCNQWNENSLTTKAFCHTDDKGLQVRVEFAVSVAEGLNDDQLQHNIALSIHHILQAIDSISTEATGSSTVEWPEKNR

SEQ ID NO: 2085 - DNA, 774 bp, Corynebacterium glutamicum
  CDS (101)..(751): RXA01108
gtggccagtggaagttctgcgactaatccacagagcttaaaactccggttgtcagttcaggttgcaaagttaacagtcaacggctgtattctttagagccatgacataccccggcatcacctctgaccacaatccttatgatggatacacaggcgatgacggggccggaaacaagcgcaacctcccaaaccgaaagaaaataaacaaatcggtgggagtttacgctggtgtgtttgccctaacattggctttatacgccattgggggagccgcatggggactgctccgacccacttataccgcttatgttgaagacgctgaaacagcctccatagcggtggaaaccaacacttcttttgccggctatgcctggtttgcgatcgccaccggtgtgcttgcagcagcaatcgcattattcgttttcctgcgcacccctcaacatcgaggcccagttatgctcctatggctgggaattgtatctatcgcaggttccgtggcattcctggtgtttggaaacgtggcctcgacgatgcttcatggttcaccatctgattacgcctcagcgatcggtgcgtctttccaggtagcacccactattacccctggtgttgcgtttggggtcgctccatttttgagtgtgtgcatgtattggtgcgcggcatttgtgacacctgaagaagagatagaccaggacgacgcaggccaggggacttcgaaagcatcggggtctgagatgactggggctagtggctaggggctagatgtgcgcaaaca

SEQ ID NO: 2086 - protein, 217 aa, Corynebacterium glutamicum
MTYPGITSDHNPYDGYTGDDGAGNKRNLPNRKKINKSVGVYAGVFALTLALYAIGGAAWGLLRPTYTAYVEDAETASIAVETNTSFAGYAWFAIATGVLAAAIALFVFLRTPQHRGPVMLLWLGIVSIAGSVAFLVFGNVASTMLHGSPSDYASAIGASFQVAPTITPGVAFGVAPFLSVCMYWCAAFVTPEEEIDQDDAGQGTSKASGSEMTGASG

SEQ ID NO: 2087 - DNA, 765 bp, Corynebacterium glutamicum
  CDS (101)..(742): RXA01109
gggtcgtcagctagattgctttgctagggtaatctgcgtgaaccgtccgggaatttttaagttttccggagcatgtcgatgatttatcaggagcagaactttgtctattagcctttcctcaaagaaggttgctttcgcagcactcatggtcaccccacttctcttgaccgcatgtggcagtgattcatctgatactgaagcagcctcatccagcgcagcgacgacgacaaattcttcctcatccagcgcagcgacctcggcggaagcagcagaaaccacctcgtccgaatctgaatcttccgaagcaacaaccattaacgaagagcagcaagcacagcttgatgtactgtctcaagagctgtctgagaacccaattaccttcgctgaagctgcgccagttgaaaacggcgagaccgcttccccagaagacacagctgccatcgaggctctggttcgcggatacactgacaccaacaccttgcgtagctcccttgcgtacaccatcaacaacacctgcacccgcgttcttgaagccagcggcgctgacgctacccagcttgatctcaacaccatccctgatatcccactgggtggcgaaggcaccggaactgttgattccatcaccgatgttgtggtcaacggccaggaagcatccgcatgggtcgtagcaaccgccggtggaaccaccgactctgcaacccagcgcttcttcaacgaaggtggccagtggaagttctgcgactaatccacagagcttaaaactcc

SEQ ID NO: 2088 - protein, 214 aa, Corynebacterium glutamicum
LSISLSSKKVAFAALMVTPLLLTACGSDSSDTEAASSSAATTTNSSSSSAATSAEAAETTSSESESSEATTINEEQQAQLDVLSQELSENPITFAEAAPVENGETASPEDTAAIEALVRGYTDTNTLRSSLAYTINNTCTRVLEASGADATQLDLNTIPDIPLGGEGTGTVDSITDVVVNGQEASAWVVATAGGTTDSATQRFFNEGGQWKFCD

SEQ ID NO: 2089 - DNA, 1053 bp, Corynebacterium glutamicum
  CDS (101)..(1030): RXA01119
ccgtaaagacgttggcgaagtcatcatcaacggtgccgttgcccgtggcgaagccgaaccagagatgttggaagctgtcgcagaagaaaagaccgcgtagttggcaggagttatcaccggctttgccatcatcctgtcggttatcggcgttggatttcttctggcaaagctgggggtcatcaatgatgacaaacagcgcttggtgttaaaccgcattgctttttatgcggcaactccagcgctgcttttcaatgtcgttgcccgatcagatcccagcgcgttgatctcaccggtcattgtggtgacatttgtggccacgatcgtcacagcagctgtgtactgcgtgatttcggcgattttctttaagaaggatatcgccactacggcgacaggagctgcggcttctgcctacgtgaactccaacaacattggcctgccggtgtctatttatgtgctgggaacaggcgcatatgtggcaccgattctggtcatgcagatggtgattttcgcgcccatgatcctggccgcgctgacctctggtgatgtgaaaggctcgcgcgggcaaaaaatatgggctgcggtgaaaggttcactgctcagcccaattgtgttggcctctatcgcgggcctgatcgtgtgtctgttagaaattcagctgccagccgcagtcatggaacccaccatcattttgggcggcgcatccattccgttgattctgatgagcttcggcgcatcattgccctcaaccaacgtgctggcttccaaggcggatcgccccagcgttcttactgctactgcgataaaaattgtgggtatgcccgccatcacttggctgatcgccaaggcgtttggtctggagggcgattacctctacgccgctgttattttggcggcgctgcccgccgcgcagaatgtgtacaactacgcggcgacgtaccgcaagggcgagatcgtcgcccgcgatacggtcttcctcaccacgttcctagcgctgctgggcatgctaggaatcgcggccctatttggtcgctagggcttcaggctgcttttcga

SEQ ID NO: 2090 - protein, 310 aa, Corynebacterium glutamicum
LAGVITGFAIILSVIGVGFLLAKLGVINDDKQRLVLNRIAFYAATPALLFNVVARSDPSALISPVIVVTFVATIVTAAVYCVISAIFFKKDIATTATGAAASAYVNSNNIGLPVSIYVLGTGAYVAPILVMQMVIFAPMILAALTSGDVKGSRGQKIWAAVKGSLLSPIVLASIAGLIVCLLEIQLPAAVMEPTIILGGASIPLILMSFGASLPSTNVLASKADRPSVLTATAIKIVGMPAITWLIAKAFGLEGDYLYAAVILAALPAAQNVYNYAATYRKGEIVARDTVFLTTFLALLGMLGIAALFGR

SEQ ID NO: 2091 - DNA, 645 bp, Corynebacterium glutamicum
  CDS (101)..(622): RXA01122
tattcgaccaaggctgagcaaaaaggcgctaagctgtggggagatcgcaagcccctatccggcctctactaagccccgaagttgaagggaaactcccccaatgccgtttccagcactgttgttgccgctgattttctggacaggaattgcagctttgtcctcttgggcggtcagccgtgcacttccgctgcgcgccgataattccattgagattgatgcgccggtggaaaaggtctgggatttcatcgaggagaccaaccgcgtgccggagtggaatgagcacattctgtacgtgcaggcgcctggtgagatcgagcagggcatgaagctcaagatgaaaacaaggcacccagagaccaatcgcctcactttgaagtttcgccccaccatcgacgtgctgcgtccacaccgtgaattgacgtggtccaccaaaattgttgcgcgttggctgctcaccgtcaccgacacgatcgagctgaagcctttggaagatggtcgcactgaggtggatcaatcaatgtcctttagtggcgtactatcccccggagtgccctttttggccagcatcagcaggatcaaagagaactcaaaccgccagttgaaagcactgatcgaagccgagtaaacctccaacccctacataac

SEQ ID NO: 2092 - protein, 174 aa, Corynebacterium glutamicum
MPFPALLLPLIFWTGIAALSSWAVSRALPLRADNSIEIDAPVEKVWDFIEETNRVPEWNEHILYVQAPGEIEQGMKLKMKTRHPETNRLTLKFRPTIDVLRPHRELTWSTKIVARWLLTVTDTIELKPLEDGRTEVDQSMSFSGVLSPGVPFLASISRIKENSNRQLKALIEAE

SEQ ID NO: 2093 - DNA, 570 bp, Corynebacterium glutamicum
  CDS (101)..(547): RXA01123
aaagagcagtgatttttcccgatccccccctggccgcctagcggaaattattgataccgcgtggcggttggtggaaacacgtggctgggcgaatgtgagcatgcgaaccctggccgcggagctaaatatcaaggcgccgtcgctgtacaagcatgtaaaaacgcgcgaggatatcgccgcacacatcgccacgaaggcatttattcagctggggcaaagcctgcatgaacattgtgaaagtgtggaggatttgcttgcggaataccgctccatggctcgggaaaatccaaatatttaccggcttctcaccagttcagagttcccccgcgagctacttccagaaggcctagaaacttgggcaggaacgccattctacctggtcaccggccacgatccgatcaagggtcaagcactgtgggcattcgcgcacggcatggccatcctggaaatcgacgcccgattcgccggccccaacaatggatcccccgcggatggcgtgtgggagatcggcgcgcgggcatttgacacacaagtattcgaccaaggctgagcaaaaaggcgctaagctgt

SEQ ID NO: 2094 - protein, 149 aa, Corynebacterium glutamicum
MRTLAAELNIKAPSLYKHVKTREDIAAHIATKAFIQLGQSLHEHCESVEDLLAEYRSMARENPNIYRLLTSSEFPRELLPEGLETWAGTPFYLVTGHDPIKGQALWAFAHGMAILEIDARFAGPNNGSPADGVWEIGARAFDTQVFDQG

SEQ ID NO: 2095 - DNA, 302 bp, Corynebacterium glutamicum
  CDS (1)..(279): RXA01127
ggaattggcctcgcagcatccggcaacatcgatgccacgggcaccaacccttccatgttcgagccagtccacggctctgcaccagatatcgcaggccagggaatcgcagacccaacggcagcaatcctatccgctgcgatgctgctgcgtcacttaggtgatgaagacaacgcagtacgtattgaaacagccatcgcagctgatgtggctggccgagataactctcagccgatttctaccactgaggtgggagaccgcatcgtcaaggcgctgcaaagctaaatttcaacgccgaccccctt

SEQ ID NO: 2096 - protein, 93 aa, Corynebacterium glutamicum
GIGLAASGNIDATGTNPSMFEPVHGSAPDIAGQGIADPTAAILSAAMLLRHLGDEDNAVRIETAIAADVAGRDNSQPISTTEVGDRIVKALQS

SEQ ID NO: 2097 - DNA, 1989 bp, Corynebacterium glutamicum
  CDS (101)..(1966): RXA01129
caatataacgcactttaacatatttccccccatctttttgttctcaaatttatttgtactcgaatgcaggatttcgagacaatgaggcagtttttcttttatggttaatctcatgtcggtcgaactcgaagaaatccgcgatttcttagcaggatttgaacctttcgcgcagctaccagccgaggaactagatcagttacctggaaaaatgagcttgcgctattttcggcgtggggaagagatcatcccaattggtgtgcccaatcattacatgggggtaatcagatcgggtgccattgatgttcttgatcaggagggcgtactgctggatcgccgtgacgcggggcgctcgtttggctattccacgatggggccagaacgaaattctcggtaccgtatggttgccgtggaagattccttggtgttgcgtctggggcgtgatgattttgatgagttagccaagcgcaaccctgatctgaaccgttactactccagctggtcgaagcgtatccgcgccgctgctgatcaattgcgccaagaatctagttcgaaggtgctgcgcacgaagttgggggagttcaagatcgccaacccgatttcctgcagcccggacaccacgatcatggatgctgccatcaagatgcatgagttcggggtgtcttcgttgctggtgcagatcgatggggaactcaaaggcatcatcaccgatcactatatgcgcagcagggtggtggcgaagcatttggatattcagctgccggtctctgaggtcatgacggtggatccgcgttgcgcgacctcgcaggggttggcttttgaggccatgttgttgatgtcggagctgcgcattcaccacttgccgattgtggatgatggccaaatctccggcatcgtcactgcagctgacatcatgcgcttgctgcgccacgatccgatttacctcactgcggatctgtcgcgaaaaaataccgtggaggaattggccaacaccttccagtcggcagcggaggtggcttcgagatttattgatcggggagcttctgcggaagaagtcagtagcttgctcaccgtggctgcggattctttggcaagaaggctccttgtgctggcggagcggaaatttggtgcaccgccagttccgtattgctttgtggtggtgggctcgcagggcaggaaagaaatgggactggcctctgatcaagacaatgcccttgttctggacaattcctacaatgaccgcgagcatggacagtattttgcagcgctgagtgaattcgtgtgccagggcctcgaccgcgcaggacaggtgctgtgtccgggtgacatgatggcatccaatccggagtggcggaaaactgctgaccagtggatctccaccttccattcctggattactgcgccggagccggatgcgttgctgcatgcccagacattctttgatttcaggggaatttacggcgacaccgagatggctaaggatgtccaccaaaatgcggtgaatatggccaggggtgcgcgtcgcatgcatgcacacttggctagtcttgcggcccggcgcgatcctccgctggggtttttccgtggtcttgtggtggagcgttctggtgaatacggcgcgacgatggatattaagaagggtggcaccgcgggcatcgtgcagatggcgaggctgtatgcgctggccacgggtagtgatgcgattgggactcgggagcggttgattgctgcgtcgggccatggtcaggtgtcgcgtaagggtgcgcaggatttgttggatgcctttgatttcttagcggcgatggcgttccagcaccaggcgcggttgatcaaggtgggggagaagccgaactatcacattgatcccaagacgttgggcaagatggatcgggagcatttgcgcgatgcattttccattattaaagatatgcagtcggcgttagctactaaatatccggtgaggaacatctagtgttggggcgtcgaaaagcg

SEQ ID NO: 2098 - protein, 622 aa, Corynebacterium glutamicum
MVNLMSVELEEIRDFLAGFEPFAQLPAEELDQLPGKMSLRYFRRGEEIIPIGVPNHYMGVIRSGAIDVLDQEGVLLDRRDAGRSFGYSTMGPERNSRYRMVAVEDSLVLRLGRDDFDELAKRNPDLNRYYSSWSKRIRAAADQLRQESSSKVLRTKLGEFKIANPISCSPDTTIMDAAIKMHEFGVSSLLVQIDGELKGIITDHYMRSRVVAKHLDIQLPVSEVMTVDPRCATSQGLAFEAMLLMSELRIHHLPIVDDGQISGIVTAADIMRLLRHDPIYLTADLSRKNTVEELANTFQSAAEVASRFIDRGASAEEVSSLLTVAADSLARRLLVLAERKFGAPPVPYCFVVVGSQGRKEMGLASDQDNALVLDNSYNDREHGQYFAALSEFVCQGLDRAGQVLCPGDMMASNPEWRKTADQWISTFHSWITAPEPDALLHAQTFFDFRGIYGDTEMAKDVHQNAVNMARGARRMHAHLASLAARRDPPLGFFRGLVVERSGEYGATMDIKKGGTAGIVQMARLYALATGSDAIGTRERLIAASGHGQVSRKGAQDLLDAFDFLAAMAFQHQARLIKVGEKPNYHIDPKTLGKMDREHLRDAFSIIKDMQSALATKYPVRNI

SEQ ID NO: 2099 - DNA, 990 bp, Corynebacterium glutamicum
  CDS (101)..(967): RXA01131
gaattcattcaaggtggtaaggcggttttcgctcttttaatacagttttaaaggtagatttgggagagaagatttcccttaagaaaggttcttaacaaccatgccgcctgcgacgctgttcaatgttttgacttcagctggacttgaccctcaccagtcaggtgatgccattgttgtcgagtctgcccatttcacattgacgttcacgtgggatgagtggctgcgagctcaagcgacgtgggtgggggagttgagtgcgtcggattatgtgcgttctattgtggcgattaactctgcccatgatgcacgggcaacgccgaagatgatgttggatgccccgactggtctgacaacggtgcttaaggcggataagggtcagttgcaggcgtttgccgtggaggcgctgccgattggcgatggcctcagcgaggctcagttggcggggtttgtggctgccgcgtttgatggcgccatcgacctcactcgtgagtttcatgcactttacccggagcgctcgccgcaggagcgcggcgcaatgctcaacattaagcttgtcgacgcctccccctctcaaacagttacgcccgtgcgagtagctaactggttcatggatcagggggtggaggaagttccttatgatgcagcttctgggcgcatcagctttgagctgggtgacaccccagtggatgtgattttggatgatcccgagttgttgaagatccaagccgtggtggttgctgaccgcgatgtggaagccactgaagttttacatttgtgtaatcgagcgaacctggattctgatcactccaccatttttatgcgttcggatggggatgatgtggatttcgtcgccacggttgcggtgccgattcgtgctggtctgaacgatttccagttgagtcaagccctgcatgatggggtagtgggggttgttgggcaggtacgagctgtgatcaatcagctacactagtgaagtccatatagtgagaa

SEQ ID NO: 2100 - protein, 289 aa, Corynebacterium glutamicum
MPPATLFNVLTSAGLDPHQSGDAIVVESAHFTLTFTWDEWLRAQATWVGELSASDYVRSIVAINSAHDARATPKMMLDAPTGLTTVLKADKGQLQAFAVEALPIGDGLSEAQLAGFVAAAFDGAIDLTREFHALYPERSPQERGAMLNIKLVDASPSQTVTPVRVANWFMDQGVEEVPYDAASGRISFELGDTPVDVILDDPELLKIQAVVVADRDVEATEVLHLCNRANLDSDHSTIFMRSDGDDVDFVATVAVPIRAGLNDFQLSQALHDGVVGVVGQVRAVINQLH

SEQ ID NO: 2101 - DNA, 483 bp, Corynebacterium glutamicum
  CDS (101)..(460): RXA01137
tcggtttgaacgcaactgcttgcgcttgggtgagctttgaggatgtcttcattcctggggctcagattctaagccacgatttccttaccttgtggcatcggtgcgcccaaccttcgtgatcctacggatctccgaatacttcggtgtcgctgaagctgcgattaatgcagccactggacgtctgaccagcctcagcgaagtgtttatcgacaacgctgccgagatccaagacaacctttcttcgctggtcgcgcttcagaaagatttggcagagcgagtcaacgttgaaggagtcaatcctgttactccagttgatctactggaacttcgcctcggttccgcgcagctggccgttgctgcaactgccattgaggttcgtgttgctggaggagcaggttatgtaaagtcttcatcaacgtctcgtcgtttccgtgttgaaatgggagcttgcacgggtccgtgatctacaggccacgcaaaact

SEQ ID NO: 2102 - protein, 120 aa, Corynebacterium glutamicum
VRPTFVILRISEYFGVAEAAINAATGRLTSLSEVFIDNAAEIQDNLSSLVALQKDLAERVNVEGVNPVTPVDLLELRLGSAQLAVAATAIEVRVAGGAGYVKSSSTSRRFRVEMGACTGP

SEQ ID NO: 2103 - DNA, 257 bp, Corynebacterium glutamicum
  CDS (34)..(234): RXA01156
aagaactaagaaataccgatttacggcaggagagtgagtgtagtgaacgcaaagcaaacccaaattatgggtggcggcggacgtgacgaggacaacgccgaggattccgcacaggcatctggacaggttcagatcaacaccgaaggtgtggacagcttgctggatgaaatcgacggactgttggaaaacaacgccgaggaattcgttcgttcctatgtacaaaagggtggcgaatagtcactgtgagtaccgtggaa

SEQ ID NO: 2104 - protein, 67 aa, Corynebacterium glutamicum
VSVVNAKQTQIMGGGGRDEDNAEDSAQASGQVQINTEGVDSLLDEIDGLLENNAEEFVRSYVQKGGE

SEQ ID NO: 2105 - DNA, 1065 bp, Corynebacterium glutamicum
  CDS (101)..(1042): RXA01158
taggacgttcaaggaattggctgaatcaacaagcgccaaggtggttaagcgccctcggcgagttatctcaaaaaagaagaagaagtctcctacgggagagatgtccattgttgagcacatcaaagagtttcgacgccgacttcttatcgctctggcgggcatcctcgtgggcaccattatcggctttatttggtacgatttctcattttggcagatccccactttgggcgagctgctgagggatccgtactgttctctgcctgctgaatcccgctgggccatgagcgactcagaggaatgtcgactgctcgcaaccggcccgtttgatccattcatgcttcgccttaaagtagcggcgttggtgggtatggttcttggctcacccgtgtggctgagccagctgtggggctttatcaccccaggtttgatgaagaatgagcgccgttacaccgcaatcttcgtcacgattgctgttgtgctgtttgtcggcggtgctgttcttgcgtacttcgtcgttgcatatggtttggagttcctccttaccattggtggagacacccaggcagcggccctgactggtgataagtacttcggattcttgctcgcgttgttggcgattttcggcgtgagcttcgaagttccactggtgatcggcatgctcaacattgtgggtatcttgccttacgatgccattaaagataagcgacgcatgatcatcatgattttgttcgtgttcgctgctttcatgacacccggccaggatcctttcaccatgttggtgttggcgctttcactcaccgttctggtagagcttgccctgcagttctgtcgcttcaacgacaaacgccgggacaagaagcgcccagaatggcttgatggcgatgacctctctgcatcaccactggatacttctgctggtggagaagatgctccaagcccagtcgaaaccccagaggcggtggagccttcgcggatgctgaacccaagtggggaggcgtcgataagctataaacccgggcgcgccgacttcggtgacgtgctctagggcctagccaggtaccctta

SEQ ID NO: 2106 - protein, 314 aa, Corynebacterium glutamicum
MSIVEHIKEFRRRLLIALAGILVGTIIGFIWYDFSFWQIPTLGELLRDPYCSLPAESRWAMSDSEECRLLATGPFDPFMLRLKVAALVGMVLGSPVWLSQLWGFITPGLMKNERRYTAIFVTIAVVLFVGGAVLAYFVVAYGLEFLLTIGGDTQAAALTGDKYFGFLLALLAIFGVSFEVPLVIGMLNIVGILPYDAIKDKRRMIIMILFVFAAFMTPGQDPFTMLVLALSLTVLVELALQFCRFNDKRRDKKRPEWLDGDDLSASPLDTSAGGEDAPSPVETPEAVEPSRMLNPSGEASISYKPGRADFGDVL

SEQ ID NO: 2107 - DNA, 438 bp, Corynebacterium glutamicum
  CDS (101)..(415): RXA01159
catcaatcaatgtgcaagggtttcatttctggaaatcgtggtcaccccacattcaccagtcatgaacaagcttgtttaatgtgaatttggagtagaccacatgtccctcggaccatgggaaattggaatcattgtcctgctgatcatcgtgctgttcggcgcgaagaagctgcctgatgcagctcgttccatcggccgttccatgcgcatcttcaagtctgaagtcaaagaaatgaacaaggacggcgataccccagaacaacagcagcagcctcagcagcagattgcgcccaaccagatcgaggctcctcagccaaactttgagcagcactaccagggacagcaggttcagcagcctcagaaccctcagacccctgactaccgtcagaactacgaggatccaaaccgcacctcttaaagttgggcagtttgcatcta

SEQ ID NO: 2108 - protein, 105 aa, Corynebacterium glutamicum
MSLGPWEIGIIVLLIIVLFGAKKLPDAARSIGRSMRIFKSEVKEMNKDGDTPEQQQQPQQQIAPNQIEAPQPNFEQHYQGQQVQQPQNPQTPDYRQNYEDPNRTS

SEQ ID NO: 2109 - DNA, 998 bp, Corynebacterium glutamicum
  CDS (1)..(975): RXA01160
aaatcatccaacaaaatcagcgaccttgcccgccagcttaatctgttgccgtatttcaccaggtataaaggccgtaccgtcatggaagcagcgcgcgatcttggccaaccctcctcccaaatcatggaagacctcaacagattatggatgtgtggtctgccaggacttcttccaggtgacttggtggagcttgatcattcctttaaggaagtaaaaatccacaatgctcaaggcatggataaacccttgcgcctcacaccaactgaagccggtgttttgctgctgacacttgaatccctggaatccctccccggtattgcgaaacaggaagcggtcgtatctgctgcgaacaagctacgcgccatcatgggggagtattcctcgactgttttcgactccactggagaagacctcgatgctgaagttctagagatcatccgcgacgccatggatttacaccagcaggtcagttttgaataccactcgcacagatcagacaacaccagcctgaggcaagtcagccctgctcatatcttcacccatgaaggcgaaacctacatcaaagcctgggaagaagctgtgaaccaatggcggacgtttaggcttgatcgcatccgaagcattgtgcttcttgacagcaaagcagtgcacccggcgcgaggggtttcagtatccacggacgatccttttgagttcgcaaaatcttccgatattgccacgttattgctgcgtgaggacgcaatgtggttaggcaattacatggccatggaggtggatgaaacggtggaaccgattcgcgatagcgacggattcagctggcacacagtccactttccgctgctttctagggattggttcgtccgattcgcgattggccatgctgagcatttgaaagtaactagtcccgaagatcttcggaaatgcataaagcaaaaggcttttagtggtttgtcagcgtatgatcatcacgtagagtaacacccaagagtaagacgcaa

SEQ ID NO: 2110 - protein, 325 aa, Corynebacterium glutamicum
KSSNKISDLARQLNLLPYFTRYKGRTVMEAARDLGQPSSQIMEDLNRLWMCGLPGLLPGDLVELDHSFKEVKIHNAQGMDKPLRLTPTEAGVLLLTLESLESLPGIAKQEAVVSAANKLRAIMGEYSSTVFDSTGEDLDAEVLEIIRDAMDLHQQVSFEYHSHRSDNTSLRQVSPAHIFTHEGETYIKAWEEAVNQWRTFRLDRIRSIVLLDSKAVHPARGVSVSTDDPFEFAKSSDIATLLLREDAMWLGNYMAMEVDETVEPIRDSDGFSWHTVHFPLLSRDWFVRFAIGHAEHLKVTSPEDLRKCIKQKAFSGLSAYDHHVE

SEQ ID NO: 2111 - DNA, 805 bp, Corynebacterium glutamicum
  CDS (101)..(805): RXA01163
accgtacccacagacacaccagaattaacagaaacagactgaaaaacaacatcgctcgacatgcgcgtaatcctaacccgcgcacactaatgtggccgatatgggctacaccaacctcaacgacacacgggtcttgcgcgccgggtcatgtgatgcctggtggcgcacgatgtctccgctagtgcagcagggaagtgaggcagtctttcggcgcatcatgggtctctcgcggcgtcctgatcggaaacctggctttgacgatgtcccacatttcggcgcagctgttcgagttcccggtctaaaacacggcacgttggtcaatgctgcacccttgaaagttttgggcgcacggggcgagcccaaccccgcgagttcgtaccgttttgaatacatcaccggtgattccgcaggtcgagccatcactgcgaccggcgctgtcctcttttccacacgcccctggacaaccggcccgcgtcccgcgatcgccatggctccatccacccaaggcgtcgcacagcactgcgatccctcccacacctgcgccatcggactcaacgcattctatgacaaacccttcgacgcaatcattgcttacgaactccccgtcatcctctggtttctagctcacggacttgacgttgtgttcatcgattacccccgcgaccccgcaaccggcgtccaatactattgcgattccatcgctgcagctaaatcgcttctcgacgccgtcctcgcctccagacaactcggcctttcaccggaagcaccgcttggcctgtggggattctcccaaggaggcggcgcc

SEQ ID NO: 2112 - protein, 235 aa, Corynebacterium glutamicum
MGYTNLNDTRVLRAGSCDAWWRTMSPLVQQGSEAVFRRIMGLSRRPDRKPGFDDVPHFGAAVRVPGLKHGTLVNAAPLKVLGARGEPNPASSYRFEYITGDSAGRAITATGAVLFSTRPWTTGPRPAIAMAPSTQGVAQHCDPSHTCAIGLNAFYDKPFDAIIAYELPVILWFLAHGLDVVFIDYPRDPATGVQYYCDSIAAAKSLLDAVLASRQLGLSPEAPLGLWGFSQGGGA

SEQ ID NO: 2113 - DNA, 696 bp, Corynebacterium glutamicum
  CDS (101)..(673): RXA01165
agaccactcacattgcacatctgcagctgccaggaagtctccacccaacagttttctaggtcacagggatccattagccatttggtccttgtcgaaaggtatggtggggcatgtgcctgcagcaatagcaatcccatatttcattattgagatcctcgccttcattggtgtcgtcatgtggctcggtttcggctgggctttgggtctcctcgtattgttcttcgtcggtggacttcttctagccggcgtggagcttcgtcgcattagtaagagtgccgccattcatcaggcttcgggccagggaagtgcgggagcgatcgccggaaacattgggctgaccgcagctggtgccattttggtggccatgccggggtttgtgtcttcgattatcggtttgttgttcatttttgcaccaaccagggcgctgttccgcaaggttttggccaagcgcatgcgcagtgccatcgagaacctaggtgtgcgtggttttgaagccgttaatggttaccgcacccaggcatcctacggaaacttcggagcggcattcaatggtggtgcgcaacaaccatcaaatgagccgatcgtgattgatgaagacgagatccaagcctggacttctgatctcaaacctgaagatttcaccaaaggtaaagatgaatccgacggtgagaaataagtgacactgtttgttcggct

SEQ ID NO: 2114 - protein, 191 aa, Corynebacterium glutamicum
MVGHVPAAIAIPYFIIEILAFIGVVMWLGFGWALGLLVLFFVGGLLLAGVELRRISKSAAIHQASGQGSAGAIAGNIGLTAAGAILVAMPGFVSSIIGLLFIFAPTRALFRKVLAKRMRSAIENLGVRGFEAVNGYRTQASYGNFGAAFNGGAQQPSNEPIVIDEDEIQAWTSDLKPEDFTKGKDESDGEK

SEQ ID NO: 2115 - DNA, 506 bp, Corynebacterium glutamicum
  CDS (1)..(483): RXA01166
ctcaccggagtgattgcctacgccatcgcgggacttgcagtgaactcttcagagatgtttgaggaaatcatgtcggtgttaaatgaacgcggagtcagtgatgtgctgaaaaatatcaccagctgcgcgggaggttccttgttggccagtggctactcgtcttcccgcgggtggacacatcagggcacgccgctggcagacattctggacgatctgccacttgttgtcgctgagtttgggaagcaaaagctgggtcgtgtggcgccagaaatcccagtgctgttgtggggctctaaaaatgatgatgtcattcccattgatcccattagggaattgcgtgatagctgggcggacaagggtacgccattgacctggcatgaatcccaagcgccgcgtgtgccaggacgcacaggtctcaaccatttcgggccctattttagaaacctggaaaagtactcgggatggctcatagatcatcttgtctgagtgccgttttaaaggctcgg

SEQ ID NO: 2116 - protein, 161 aa, Corynebacterium glutamicum
LTGVIAYAIAGLAVNSSEMFEEIMSVLNERGVSDVLKNITSCAGGSLLASGYSSSRGWTHQGTPLADILDDLPLVVAEFGKQKLGRVAPEIPVLLWGSKNDDVIPIDPIRELRDSWADKGTPLTWHESQAPRVPGRTGLNHFGPYFRNLEKYSGWLIDHLV

SEQ ID NO: 2117 - DNA, 606 bp, Corynebacterium glutamicum
  CDS (101)..(583): RXA01170
tacaggaaactttcaggcataggggagtcatgaaacagaacggcaagctaaggtgacatagtcacttaaactaaacaagaagggtggaggacccaagcacgtgagtctttcaaacaaagctaaaggaatcgttgcagtaatcatcgtcgcctggatcgtcgcgatggctggcatggtcgcatacgcgtcaagcaataatgctgataagacatttccaactgcaggtgcgctagaacaaaccgtcgcagcatttgataggcaaggccttcaggtctctgcagtcgcactggcagacatctacggcgatgaatacgtctccgcggcgattctgtgcgaaggaactccaaccgcaacactcgagcagtcactgggcgtagacctgtctgagctgaacctggacgagtctggtgttccttcgggcgtgtcctacttggctctgtccaatcaggatggggaagttgtctacgacaagattgatcgtgccaacgttgatctctgcgcaacgccactcaatggtgctttcagcgcttattcattgatgccagttgccaaggttggcgagaactcctgggcgatcgccgcttagggttttaagggtcaatccgc

SEQ ID NO: 2118 - protein, 161 aa, Corynebacterium glutamicum
VSLSNKAKGIVAVIIVAWIVAMAGMVAYASSNNADKTFPTAGALEQTVAAFDRQGLQVSAVALADIYGDEYVSAAILCEGTPTATLEQSLGVDLSELNLDESGVPSGVSYLALSNQDGEVVYDKIDRANVDLCATPLNGAFSAYSLMPVAKVGENSWAIAA

SEQ ID NO: 2119 - DNA, 816 bp, Corynebacterium glutamicum
  CDS (101)..(793): RXA01171
gtagaaattttccatgcagaggaaagccgataatggggcagaaccccttcccgccaaaatgacataatgtacattatcggacaattatccatatctggccatgtcgcaggccgctggtaagtttaagcccatgacttcaacgctcgccgaatcaacacttacatcccttaaagaacttgaggatccaaagatcctttccgtcaatgaacgccacggcgatgatcacgcagtgaacctcaccaagcttcgcgccgttgccaaagagctgaaaaagaaccagccgctggctcgtgagctttgggcaaccgacgatacagccgcacgtttggtggcgttgcttatttgccgacccaaggaatttgatcagtctgaactcgactcgatgatccatgaggctcgcacgccgaaggttcttgattggttgatcaattatgtggtcaagaagaatcctcattggaacgatctccgtgtgctctggcttgaagatcccgccgagaatgttgcggccgccggctgggctctcaacactcatgccgttatcacaaagccggacgcattggacgattccgaaatccttgacaccattgaagctcagatgaaaactgccgagcctcgcgtacagtggtcaatgaatgaatgtttggcgcaaatcggcatccatcgtccagagcttcgtgatcgtgccattgccattggtgagcgcctggaagttctcaaagattatccgacccctccaaattgcacctcgccttttgctccgatttggatcgaagagatggttcgcaggaaaaaataaccgacctgttccctatcttt

SEQ ID NO: 2120 - protein, 231 aa, Corynebacterium glutamicum
MSQAAGKFKPMTSTLAESTLTSLKELEDPKILSVNERHGDDHAVNLTKLRAVAKELKKNQPLARELWATDDTAARLVALLICRPKEFDQSELDSMIHEARTPKVLDWLINYVVKKNPHWNDLRVLWLEDPAENVAAAGWALNTHAVITKPDALDDSEILDTIEAQMKTAEPRVQWSMNECLAQIGIHRPELRDRAIAIGERLEVLKDYPTPPNCTSPFAPIWIEEMVRRKK

SEQ ID NO: 2121 - DNA, 627 bp, Corynebacterium glutamicum
  CDS (101)..(604): RXA01176
gagctgtgcaccttgtgaccttttgtgacactgctcaatgctttacggctacgatgaacaacaaaccgacgttttcgacgctgtgaaggactaattgctagtgcgttatttttacgatactgagttcattgaagatgggcgcacgatcgaattggtctctattggaatcgtcgcagaagacggtcgcgagtattacgcagttagcacacagtttgattcctccaaggcgaacgcttgggtgcgcgccaacgtgttggacaaattgcctaatccttcctccaaagtgtggaaatctgcagacactataaagcgcgaagtttatgagtttctcacctccaccggaccaacccctgaactgtgggcctgggtgggcgcatatgaccacgtgttgttggcacaaatgtggggcgatatggcggggcttcctcgggagatccctcgttttacccgcgagcttcgccagtattgggacatggctggccgcccaacgctgccagagctgccgaacggcaaccacgatgcgttgattgatgcgcgtcataatttagccaagttcaaagtgtgcatggcagcgctgcctttgggtaaaagggatcgcgtctcttagtcgatctgctcccattccat

SEQ ID NO: 2122 - protein, 168 aa, Corynebacterium glutamicum
VRYFYDTEFIEDGRTIELVSIGIVAEDGREYYAVSTQFDSSKANAWVRANVLDKLPNPSSKVWKSADTIKREVYEFLTSTGPTPELWAWVGAYDHVLLAQMWGDMAGLPREIPRFTRELRQYWDMAGRPTLPELPNGNHDALIDARHNLAKFKVCMAALPLGKRDRVS

SEQ ID NO: 2123 - DNA, 2109 bp, Corynebacterium glutamicum
  CDS (101)..(2086): RXA01177
tgttcatcgtagccgtaaagcattgagcagtgtcacaaaaggtcacaaggtgcacagctcagttccttaaaaaccgctggatacggatacactatttttcatgcacggtgaaaaacttgtggatggcactgagggaaatctcagtcaattccaatggcgcgatatggctacaaatcagacgctgagaaaagcactgttagtgctttctaccatcgctctactcttgactttatggccttcaattttcaatgttcgggccatcgagtcttttgttttcttcttccatattgatactgacgtgtaccgcgccggtgctaatgcattcttgcatggcgagaatctgtatacccaggactaccaagttggtagcattcaacttcccttcacgtacccaccgatttctgctgcgctgtttgttccacttgcaatccttgcaagcagtgtagccggaatagcattaacgcttatttccacggtgttgctgtggtggagcgtagctatcgtcttgcgccgagtgctcaagggtctcacggatgctgattccaggtttgtgtcctatttgattctgcctatggcattgtccacggaacctgtattccagaccctgcagtttggccaggtcaacatcattttgatggcgctggttctcatggataccttcaccaaaaagccctggttgccacgtggtttttggattggtttggcggcatccatcaagctgacccccgcagtctttggcctttacttcctagtgaagaaggactggaagggcgctggagtagcaattgcttctggcgtaggtttttccgccttggcgtttatcctctcaccttcaagttccaagatttactggactgaaacactcaacgacccttctcgcatcggcaacctatcttatattgctaaccaatctgtgcgtggaacgctcagccgaatgatgcatgaacagcaggatctcgtcgaaaagctttggcttgtggcagttgtcttgtgccttgccgctgtcgccgtcgccatgtggcgcgtggtacgcgccggcaacccgtacggcgccgtcatgctcaactcgttgattgctctgctgtgctcccctgtttcatggtctcaccactgggtatggctgattccaatcgctattggtttgggggcaagtgcgtggaaccagcggcggactgctccaggaattgccgcgacggctggagtcttggcgcttctgaccacgattccgatgttcatcacaacattttggaacatgccatacgattcagagtcttacccattttggccattgattctgcagccgtcgggcaacgcgtatgtagtagtggtcatcgctattttgatcgtcgcgattgtgaatccaacagttttgggcagtggcaataaagctgtttcaggccaggcagagaagaagtcctcccctgcgttgcttgttgttttagcgattgccattttctacctctttgccaatatttggtttaagggaaacaatcaaaacaaagcgctcattcagtacccactgcagactatggaaggtcgcggtctcactgacttcggcgagcttatttttgaattcgcggcttcctccaaccagcttgtttccctctggataatcggcgccctcaacgccatcgcattggctattaccctgtggttcctccttcagcgttttgctgggaagaagagctcctggctgatttatctcagcaccgtggctgttgcgctgatgatgttctcagtgcaggatgccttgcagtttggttcgctgactctcgttgcactcgcattgatcactgttgatgtgttgagtgtcagagagattggccgccgcgggctgctcacaggacttgcagcagccctgtttggatggccaattctgattgttatcggattcctcattcaccgacgttatgcagcaacaatcacaaccactgtcaccgcagctgtgctgtggatcttaggaattctgctcaatccagacgccttcaacctcaacctgctgcgtcaatggttcaacgggcgcgatggtcgggacaatttgtccttctatgctttccttgccaggtgggtcagcgaatccccagcatgatgttcgtatggttcatcgtc

SEQ ID NO: 2124 - protein, 662 aa, Corynebacterium glutamicum
MHGEKLVDGTEGNLSQFQWRDMATNQTLRKALLVLSTIALLLTLWPSIFNVRAIESFVFFFHIDTDVYRAGANAFLHGENLYTQDYQVGSIQLPFTYPPISAALFVPLAILASSVAGIALTLISTVLLWWSVAIVLRRVLKGLTDADSRFVSYLILPMALSTEPVFQTLQFGQVNIILMALVLMDTFTKKPWLPRGFWIGLAASIKLTPAVFGLYFLVKKDWKGAGVAIASGVGFSALAFILSPSSSKIYWTETLNDPSRIGNLSYIANQSVRGTLSRMMHEQQDLVEKLWLVAVVLCLAAVAVAMWRVVRAGNPYGAVMLNSLIALLCSPVSWSHHWVWLIPIAIGLGASAWNQRRTAPGIAATAGVLALLTTIPMFITTFWNMPYDSESYPFWPLILQPSGNAYVVVVIAILIVAIVNPTVLGSGNKAVSGQAEKKSSPALLVVLAIAIFYLFANIWFKGNNQNKALIQYPLQTMEGRGLTDFGELIFEFAASSNQLVSLWIIGALNAIALAITLWFLLQRFAGKKSSWLIYLSTVAVALMMFSVQDALQFGSLTLVALALITVDVLSVREIGRRGLLTGLAAALFGWPILIVIGFLIHRRYAATITTTVTAAVLWILGILLNPDAFNLNLLRQWFNGRDGRDNLSFYAFLARWVSESPA

SEQ ID NO: 2125 - DNA, 573 bp, Corynebacterium glutamicum
  CDS (101)..(550): RXA01178
tcaacctcaacctgctgcgtcaatggttcaacgggcgcgatggtcgggacaatttgtccttctatgctttccttgccaggtgggtcagcgaatccccagcatgatgttcgtatggttcatcgtcgccctaggacttggtgcctgggcaatccaccgcacctggtcacatggattcaaggacctctccgttgcactgagcatcgcactaccaaccttggtgctccccatagtggaactccaccacctcgtgctacttcttccactgatcgcagtgttgcttcgtcaaggacgcgtggcaatttcctacctcatcggatttatctacctagtctcatggactccgcaacacctgtcctactccacggtattcccacttaatgatccagcaccagaagggtacgtcgcccactttggatggtatttactcgttgaaccaatggcggtagcaccggcagctataatcctcggagcatttattgcctgtgctgcaaccacacctaaaacaagtcagctcgtgcaggtcgacaagtcaagcgcggaaaacaccaagtaagccttacagtccgacagcct

SEQ ID NO: 2126 - protein, 150 aa, Corynebacterium glutamicum
MMFVWFIVALGLGAWAIHRTWSHGFKDLSVALSIALPTLVLPIVELHHLVLLLPLIAVLLRQGRVAISYLIGFIYLVSWTPQHLSYSTVFPLNDPAPEGYVAHFGWYLLVEPMAVAPAAIILGAFIACAATTPKTSQLVQVDKSSAENTK

SEQ ID NO: 2127 - DNA, 1589 bp, Corynebacterium glutamicum
  CDS (101)..(1573): RXA01184
taaaacacttctgaaactacagctgacgttgtggggaagaactattaaaggaaataaagcggcaatagtgatgatgtcgctgatatctttttacgccttgatgggtttgtttggtttcggcatctttttggctcttgggcttgggcaagaccacatgggcatccttgctggtgttgtctcggtcggcatggtggcttattgcattgctgcgtttatgtggccgtcaggtgaggggcagctggatccgactgcattttccaccatgccgctatcggcgaagcaattattgcctggattcgctatcggtacgctcctgcagtcacgggggattattgcggtgatttgtacggtggcgacatccattattgctgcggtgtttttacctgttggttcgtggccgatgatcgtgttcatgatggcggtatcgctggttactacgttgcttttgggtgagttgcttggggcgttgacctcgggttcttcttctagggtgagtaatgatcgccgtacagttcttacttccgttgtcttcatggtgtttgttgttggctataacatgctgattggcgcggatggaatgagtcgaatcgatgccattggggcttatacaaagtggacaccatttggggcgggtgcaggtgctattgaggcttttgctgttggtttgtggggtgaggcaggcctgttaacattgctggcttttgtttatgttgctgctggtttctggttatggtcacagctgattaatcgcgcgctcactgcgccgctggaccaaggtgggcaagggcaaagcgctaaagacagcgccggtgaaggcaagaaggttctctttctgccaggtattccttggtcagttggaggtgccattttctcgaggtcgctgcgttatatgttcagggactccaggttgttgggatcaatgattgtgttcccgcttcttggcgtgctgtttattttccagagcttcaccgttgagtttttcatgatctatgttgggttgatcatgatggcagtgttcgcaggatccgttgctaccaatgattttggctatgacggcccttcgttgtggctaaatatcgttgctggtgtcaaagcccgaacgttgttgatgcccaggcactgggcatcaatgctgccgggaagtgtgtcaattgtggtgtttatgatcatcaccattgtgctcgcggagaataagaccaccgctgtgctgatctgttttattggcctggggatctttatctccagtgcggctgtagcgttgttggtcaccacatttaatccgtatccgacttctaagccaggcacgagtccttggggcgatcgaagtggctattccggtgctgcgttcgtgggagcatttgccgcactgttactgggatggatcccgacgattcctactatcgcattgggtatctttggtctggttaccgatcagatgtggatgatcatcctcgcggaggtgctggccattattctcccagtagctgtgtacatcggcgttgctaaggtgtgtattcgcaaggtggagaaggatcttccggagatcttcgacaaggtgaaaactcacgtgaaatagaaaaatgcggggt

SEQ ID NO: 2128 - protein, 491 aa, Corynebacterium glutamicum
MGLFGFGIFLALGLGQDHMGILAGVVSVGMVAYCIAAFMWPSGEGQLDPTAFSTMPLSAKQLLPGFAIGTLLQSRGIIAVICTVATSIIAAVFLPVGSWPMIVFMMAVSLVTTLLLGELLGALTSGSSSRVSNDRRTVLTSVVFMVFVVGYNMLIGADGMSRIDAIGAYTKWTPFGAGAGAIEAFAVGLWGEAGLLTLLAFVYVAAGFWLWSQLINRALTAPLDQGGQGQSAKDSAGEGKKVLFLPGIPWSVGGAIFSRSLRYMFRDSRLLGSMIVFPLLGVLFIFQSFTVEFFMIYVGLIMMAVFAGSVATNDFGYDGPSLWLNIVAGVKARTLLMPRHWASMLPGSVSIVVFMIITIVLAENKTTAVLICFIGLGIFISSAAVALLVTTFNPYPTSKPGTSPWGDRSGYSGAAFVGAFAALLLGWIPTIPTIALGIFGLVTDQMWMIILAEVLAIILPVAVYIGVAKVCIRKVEKDLPEIFDKVKTHVK

SEQ ID NO: 2129 - DNA, 1221 bp, Corynebacterium glutamicum
  CDS (101)..(1198): RXA01186
ttgctcatacagccattgaactcgtagaatcaccgttccgccacccaaatcagcccaataagttcaacaattacataacatctgaaagaatagggacattatggctacacctgtaccactggtttttaacgcacctaagcgtggcatgcccccaacccactttgcggatcttaatgatgaggctcgcattgaggctcttaaagagctcggcttgcccaaattccgactcaatcagatcgctcgacactactatggtcgcctcgaggctgacccactcactatgacggacctgcctgaaggtgctcgtcaagaagtcaaggatgctctttttccaacgttgatgtctcctctgcgcgtcgtcgaaaccgatgacgatacaactcagaagacgttatggaagctccatgatggcactttgcttgagtctgttctcatgcgctattcagatcgctccacgctgtgtatttcttcgcaggctggttgcggcatggcgtgcccattctgtgcaactggtcagggcggtttggaccgtaacctttcaatcggtgagatcgtggatcaggttcgtaatgctgctgcaacgatgcagtcagagggcggtcgtctgtccaacattgtgttcatgggaatgggcgagcctctcgctaactacaagcgcgtggtgtcggctgttcgtcagatcacgcagccaagccctgcgggcttcggcatttcccagcgcagtgtgactgtctccaccgtgggcctcgctccagctatcaggaagcttgccgacgaagagatgtccgtaactttggcagtttccttgcacactccagacgatgagttgcgtgacactctcgtgccagtcaacaatcgttggcctgtcgctgaggtactggacgctgctcgttactacgcagataagtctggccgtcgcgtctccatcgagtatgcgctcattcgcgatgtgaatgaccaggattggcgcgcagatatgctgggcgagaagctgcataaggctttgggctcccgtgtgcacgtcaacttgattccattgaacccaactcctggttctaagtgggatgctgcaccaaaggctcgtcaggatgagtttgtgcgtcgtgtgatcgccaagggtgttccatgcactgtgcgtgataccaagggacaagaaatcgctgcggcttgtggacagcttgctgcggaggaatctgcttaagccctcaaagctcaaaagcc

SEQ ID NO: 2130 - protein, 366 aa, Corynebacterium glutamicum
MATPVPLVFNAPKRGMPPTHFADLNDEARIEALKELGLPKFRLNQIARHYYGRLEADPLTMTDLPEGARQEVKDALFPTLMSPLRVVETDDDTTQKTLWKLHDGTLLESVLMRYSDRSTLCISSQAGCGMACPFCATGQGGLDRNLSIGEIVDQVRNAAATMQSEGGRLSNIVFMGMGEPLANYKRVVSAVRQITQPSPAGFGISQRSVTVSTVGLAPAIRKLADEEMSVTLAVSLHTPDDELRDTLVPVNNRWPVAEVLDAARYYADKSGRRVSIEYALIRDVNDQDWRADMLGEKLHKALGSRVHVNLIPLNPTPGSKWDAAPKARQDEFVRRVIAKGVPCTVRDTKGQEIAAACGQLAAEESA

SEQ ID NO: 2131 - DNA, 1221 bp, Corynebacterium glutamicum; identical to SEQ ID NO: 2129
  CDS (101)..(1198): RXA01186

SEQ ID NO: 2132 - protein, 366 aa, Corynebacterium glutamicum; identical to SEQ ID NO: 2130

SEQ ID NO: 2133 - DNA, 573 bp, Corynebacterium glutamicum
  CDS (101)..(559): RXA01187
ctattctttcagatgttatgtaattgttgaacttattgggctgatttgggtggcggaacggtgattctacgagttcaatggctgtatgagcaacagacctgtggatccatttgagaccaacccaaacgaccttcccaccggtttagacccagcatacgaaggtaacagtgagttaaacccgcttggaggaaaaaatattcccgacgagcctgaggtgactgcaaacacacctgcagttcaagaagaacctgcttactcggagccagaaactgccgttgagtcgaagcgtcaggcgaagcagaacacaaagaagtccgaacctgttgtggctccaaaacaaacacttgccggtggcacgtgggtagctctcatcgtaggcgcacttttgctaatcctactgttggtcttcatcatgcagaaccaaaccaccgtagagcttaacctttttgcgtggaccttccaattcccagccggaatcggtttcctactagcagccattaccggtgcattgattatggcgcttggtggtggcgtgcgcatgtttgagtaccgtcgcagttaagaaaaatccgt

SEQ ID NO: 2134 - protein, 153 aa, Corynebacterium glutamicum
VDPFETNPNDLPTGLDPAYEGNSELNPLGGKNIPDEPEVTANTPAVQEEPAYSEPETAVESKRQAKQNTKKSEPVVAPKQTLAGGTWVALIVGALLLILLLVFIMQNQTTVELNLFAWTFQFPAGIGFLLAAITGALIMALGGGVRMFEYRRS

SEQ ID NO: 2135 - DNA, 570 bp, Corynebacterium glutamicum
  CDS (101)..(547): RXA01195
ggtttcgcgccaggcgacattgtgagtaggatcgtctaaaatcgttttcttatcgcaggaaggactcaaaaaggccgtggaatatttgacctggggtttggtgattgttgcagtgtcggcagttcttcttgctgcctggcggtttttcaccttacgttctcggggaaccactgtgattctgcgtgagttgccacaaagcggtgtgcatggctggcgccatggatcatttcgctacaacggcaacgacttggagtacttcaagctgcgctctttgtctcccatggctgaccttattttgaaccgcctttcagtaactttgcttgatcgtagagatccagctgctgatgaggcggtttttatgtctcaaggcttaaaaattctgcacattaaatccaaaaatgatcagattgaattagctttggacgcccacggggagatggcgtttactgcctggttggaagcagcaccagatgcgcgggcggagcattcattgaatccacgtgatttcaaccgctttcgagccagcaaagacacccgcaaaaaccgctaagtagacgtcattgttatggt

SEQ ID NO: 2136 - protein, 149 aa, Corynebacterium glutamicum
VIVAVSAVLLAAWRFFTLRSRGTTVILRELPQSGVHGWRHGSFRYNGNDLEYFKLRSLSPMADLILNRLSVTLLDRRDPAADEAVFMSQGLKILHIKSKNDQIELALDAHGEMAFTAWLEAAPDARAEHSLNPRDFNRFRASKDTRKNR

SEQ ID NO: 2137 - DNA, 813 bp, Corynebacterium glutamicum
  CDS (101)..(790): RXA01196
gggcggagcattcattgaatccacgtgatttcaaccgctttcgagccagcaaagacacccgcaaaaaccgctaagtagacgtcattgttatggtgggtgcatgcgtttagtcatcgcccgttgctcagttgattatgttggccgtttggaagctcatcttccgtccgccgatcgccttttgatggttaaggcggatggttctgtatccatccatgccgatgaccgtgcctataagccactgaactggatgacacctccatgttctttagttgaaactcccatcactgatgaagatggtgaagcaacaggggaaagcctgtgggtggtggaaaacaaaaagggcgagcagcttcgaattactgtggaagaaattcattcggaacaaaacttcgatctaggccaagacccaggtttggtgaaagacggagtggaagatcatctccaagagcttcttgcagagcacatcactacgttgggtgatgggtacacattgattcgtcgggagtatccaacagctattgggcctgtcgatattttgtgtcgcaactctgacggcgagactgtcgctgtggagatcaagcgtcgtggtggcatcgacggcgttgagcagttgaccaggtatttggaattgctcaaccgtgatgaattgctcaagcctgttcatggagtgtttgcagcccaggagattaagcctcaggcaaagactctcgcggaggatcgtggcatcaagtgcgtgacgttggattatcaagcgcttcgtggcattgagtccaatgagctgacattgttctaagaacatgggccgaaaaaata

SEQ ID NO: 2138 - protein, 230 aa, Corynebacterium glutamicum
MRLVIARCSVDYVGRLEAHLPSADRLLMVKADGSVSIHADDRAYKPLNWMTPPCSLVETPITDEDGEATGESLWVVENKKGEQLRITVEEIHSEQNFDLGQDPGLVKDGVEDHLQELLAEHITTLGDGYTLIRREYPTAIGPVDILCRNSDGETVAVEIKRRGGIDGVEQLTRYLELLNRDELLKPVHGVFAAQEIKPQAKTLAEDRGIKCVTLDYQALRGIESNELTLF

SEQ ID NO: 2139 - DNA, 576 bp, Corynebacterium glutamicum
  CDS (101)..(553): RXA01197
agcaacaatcatatctgccaccctaccttggggttggcatgtgatgactagcttgcccaatcctcaatattcccccacctgctatgcctaaaattaagccatgtctaccgaacagtctttgaatatcccccacgaatacgtcatctgcctcgatcatgttggcatcgccgtccctgacctcgaggaagccatcgaattttaccgttccgcattcggctgggtaaaccaccaccaagaaatcaatgaggaacaaggcatttcagaggccatgatcggccccaaagacattaaaagcacagaaggcatgattcagctcatcgcgccgctcaacgaggactccacaatcgccaaattcctcgaaaagaaaggtcccggcatccagcaaatgtgcctgcgcaccaacaacatcgatgcgctctccgagcacctgcgccgccaaggcgtgcgcctgctctaccccgaacccaaaaacggcaccggcggtgcccgcatcaacttcctgcaccccaaagacgcgggcggcgtgctgctcgagatcacgcagcctcaaagctaattgcttatcgacgctcccag

SEQ ID NO: 2140 - protein, 151 aa, Corynebacterium glutamicum
MSTEQSLNIPHEYVICLDHVGIAVPDLEEAIEFYRSAFGWVNHHQEINEEQGISEAMIGPKDIKSTEGMIQLIAPLNEDSTIAKFLEKKGPGIQQMCLRTNNIDALSEHLRRQGVRLLYPEPKNGTGGARINFLHPKDAGGVLLEITQPQS

SEQ ID NO: 2141 - DNA, 426 bp, Corynebacterium glutamicum
  CDS (101)..(403): RXA01198
ttcggtagacatggcttaattttaggcatagcaggtgggggaatattgaggattgggcaagctagtcatcacatgccaaccccaaggtagggtggcagatatgattgttgctttttctgtagccccgactgttactgataatccagatgctgagatggccgatgcggtcacggaggcgattcgaatcgtccgcgcatcgggtctgcctaatgaaactaacgcgatgttcacgctcattgagggggagtgggatgaggtgatggcggtgattaaggaggccactgaggcgatctctagggtatctccgcgtacatcgttggtaattaaggctgatattcgtccgggacacactggccaattgacgaggaaggtggaggcggtggaggaacgcctagctagggattagctttgtacttaaacttgttg

SEQ ID NO: 2142 - protein, 101 aa, Corynebacterium glutamicum
MIVAFSVAPTVTDNPDAEMADAVTEAIRIVRASGLPNETNAMFTLIEGEWDEVMAVIKEATEAISRVSPRTSLVIKADIRPGHTGQLTRKVEAVEERLARD

SEQ ID NO: 2143 - DNA, 771 bp, Corynebacterium glutamicum
  CDS (101)..(748): RXA01207
cttcatgatctcaccggcagagcgcgttttgttacagcgcgtaaactgtgactttgaaaaatttttgaacaatccgtacaccaacttcaggagaaaaacagtgagcagaatctatgactgtgccgaccaagactcccgtgcagcaggcctaaaggcggctgtcgatgcagtcaaagccggtcagctcgttgtccttcccacggataccctttatggactcggctgcgacgctttcaacaacgaggcagtagccaaccttctggccaccaaacaccgtggccccgatatgcccgttccagtgctcgtcggcagctgggacaccattcaaggacttgtgcactcctattctgcgcaggcaaaagcgcttgtggaggcgttctggcctggtggactgtccatcatcgttccgcaggcaccaagccttccgtggaaccttggcgatacccgtggcaccgtaatgctgcgcatgccactgcacccagttgccattgaattgctgcgccaaaccggaccaatggctgtctcctccgccaacatctccggacatactcctccaaccaccgtgctggaggctcgtcagcagctcaaccaaaatgtcgctgtctacctcgatggtggcgaatgcgcgctggccaccccttcaaccatcgtggatatttcaggccccgcaccaaagattttgcgtgagggtgccatcagcgcagaacgcgttggcgaagtacttggagtgtcggcagaaagcctgcgctaaatgggagtcggtttcgcggg

SEQ ID NO: 2144 - protein, 216 aa, Corynebacterium glutamicum
VSRIYDCADQDSRAAGLKAAVDAVKAGQLVVLPTDTLYGLGCDAFNNEAVANLLATKHRGPDMPVPVLVGSWDTIQGLVHSYSAQAKALVEAFWPGGLSIIVPQAPSLPWNLGDTRGTVMLRMPLHPVAIELLRQTGPMAVSSANISGHTPPTTVLEARQQLNQNVAVYLDGGECALATPSTIVDISGPAPKILREGAISAERVGEVLGVSAESLR

SEQ ID NO: 2145 - DNA, 1350 bp, Corynebacterium glutamicum
  CDS (101)..(1327): RXA01213
aactctggcaacaacatgcgccttcactccctcaaacaaattttcataaacaccccacatcatatcaaccaaacggtgtagttcttctaagctttcacccatgacaaatcccacagaggagcgcaacgcacgccgcctcatttgggccaacggcctgcaaaacatcggcgatcaaatcgttgccgccaaaacagtcctgccctggttgctgcaagccgctggcgcgccgggctttttgctggcgcttctggttccaatccgcgaagccggatcgatgctgccgcaagctgccattactggctgggtgctgaggcagacgtcgagaagcaaagtctgggtgattggctcgaacggccagttcgtctcggcgctgggtatcggcgtggctgcgctgtttttgcgtgggtgggcgctgggcatcacggtgatcgtgctgcttgcggcgctgtcgctgtttcgatcgatgtgttcgattgcatcgaaggatgttcagggcaaggtgatttccaagggcaagcgtgggctggtaacgggccgcgcgacggtgattggcggtgtgatgggcctggttgcaggcctggcgatcgctattttcttgggctcgcattccccgacgagggtgctggccgcagtggtgatcgcgagctcgtttagctggctgtttgcctccattgttttcgcgcgcatcgaatacgcgaagccagcgactccaaaaaacgcgccttccgcaaacccgtgggtgcgtcgctgcatcgccgcattaaaagatgataaagcttttcgacgtttcgttctggttcgctcaatgatgctggtgacagcactctccacggctttcatcgtcgcactcgccgctgaatccggaaacagcatcgactccttgggattcttcctcatcgcctccggcttggcgtccatggttggtggccgaatctctggaatctggtcggatcattcctccaaaaacgtcatggcgggcggtgccctattcggttccatcgtgttaatcctcgtggtgctcagctccgcgtttgcacccgcgcagatcaacacgctggtgttcccgttgagtttcttcctcatcaccttggcccacaccgccatccgcgtggcccgcaaaacttatgtaatggacatggctgaaggtgatcagcgcacccgctatgttgccgacgccaacacactaatgggtgtagttttgctcattgttggcgcattatctggcttcattgcaattttcggaaacgaagccgcactgctcttcttggcggcaattggcctgcttggaaccattagcgcccgtggcctcaaggaagtatccgccggatagttttacaacttttccaccca

SEQ ID NO: 2146 - protein, 409 aa, Corynebacterium glutamicum
MTNPTEERNARRLIWANGLQNIGDQIVAAKTVLPWLLQAAGAPGFLLALLVPIREAGSMLPQAAITGWVLRQTSRSKVWVIGSNGQFVSALGIGVAALFLRGWALGITVIVLLAALSLFRSMCSIASKDVQGKVISKGKRGLVTGRATVIGGVMGLVAGLAIAIFLGSHSPTRVLAAVVIASSFSWLFASIVFARIEYAKPATPKNAPSANPWVRRCIAALKDDKAFRRFVLVRSMMLVTALSTAFIVALAAESGNSIDSLGFFLIASGLASMVGGRISGIWSDHSSKNVMAGGALFGSIVLILVVLSSAFAPAQINTLVFPLSFFLITLAHTAIRVARKTYVMDMAEGDQRTRYVADANTLMGVVLLIVGALSGFIAIFGNEAALLFLAAIGLLGTISARGLKEVSAG

SEQ ID NO: 2147 - DNA, 552 bp, Corynebacterium glutamicum
  CDS (101)..(529): RXA01218
ctaaatatgctagcacgatggccaaacctaatccaaaaaccggcagtatactgattggggtcacattagccaaaaggcactttgaggaagtggaactcctatggcacgacttcagcacgacatgattttcatcaacctaccagtatctgaccttgcagcatctaagcgtttttatgcaggtcttggcttcaaagaaaacaccgtcttcagtgatgagcacactgcatcttttgaggtcagtgacgccatcgtggtgatgcttctggaaaccgcgcgcttcagtgatttcactaagcgccccatcgtggagaagaacggctcccgcgaagtgctcaactgcctgtctgtatgttccaccgaggatgcggatgagttcgtgcgtcgcgcccaggaattcggaggcacgatcacccgtgagcttgcagcggaaggccccatgtacggcggagcttttgatgatccagatggacacggttgggagctgatgtacttcgatccagaggcactcgctcagatgatgcctgagggctaaatattcttcagggcttctcg

SEQ ID NO: 2148 - protein, 143 aa, Corynebacterium glutamicum
MARLQHDMIFINLPVSDLAASKRFYAGLGFKENTVFSDEHTASFEVSDAIVVMLLETARFSDFTKRPIVEKNGSREVLNCLSVCSTEDADEFVRRAQEFGGTITRELAAEGPMYGGAFDDPDGHGWELMYFDPEALAQMMPEG

SEQ ID NO: 2149 - DNA, 507 bp, Corynebacterium glutamicum
  CDS (101)..(484): RXA01234
agaaacaatagccagacccagaagagcagactggagagcttcgaggatttagtgctcctgtgcatttattcgggtcacttcaacgttgaaaagcataggaatgtggaagttcatgaagactcaatacgtatgtaccacttatttcatcgctgcacccgaggatgaagacgaggcgtaccaaacttatcgcagccgaatgaactctttggcagcattgaacggcgctgacgtagtttcagtggcagatggcctacggatggaagtagaccaggatatttggggaagccttgctgagcagtatcagattgagcaagaaggcctgtatcccactggtcacaacttgtactttgttgtcaccgtggtgaacctagatgattcagatgaggtttatgaccgaacaatggagcatctgattatggatgacccttatgtgcgagtggatcgtttcccaagcactgtccatgccagcacccagatcatgttgtagaaaaagaaaaagcaccaccc

SEQ ID NO: 2150 - protein, 128 aa, Corynebacterium glutamicum
MWKFMKTQYVCTTYFIAAPEDEDEAYQTYRSRMNSLAALNGADVVSVADGLRMEVDQDIWGSLAEQYQIEQEGLYPTGHNLYFVVTVVNLDDSDEVYDRTMEHLIMDDPYVRVDRFPSTVHASTQIML

SEQ ID NO: 2151 - DNA, 564 bp, Corynebacterium glutamicum
  CDS (101)..(541): RXA01237
aaaccaaaaatcacgacgcattaagtaacagagacttaaattaagaactccgaacaacaacttcggattgtttcatttttgaggatgaaagagcttttcaatgaacgtacagtttgaatcagacatggccgtccaaccaggaaacaccatggaagctaccgtcaccgacattcgtgatgccaagcgtaaaacaacccagcttgattcagtaacgccgtttaagaagaattgcccgagccgcaccttgctcgacaccatcagtgacaagtgggcggtgctgatcctgctcagcatggaaaatggtccacagcgcaatggtgaaatcaaagatcaggtccaaggaattaccccaaagatgctcacccagcgtcttggagtgttggtggaagacggactggtcactcgcacctcccacgcagttgtgccgcctcgtgtggattatcagctcaccgatctgggtgcttctgtcattgagccttgccgtgcgatgtattcctgggcagtggagaacattaagcaagtggaggcctaccgctcagcataagaacacttggcaaacctcac

SEQ ID NO: 2152 - protein, 147 aa, Corynebacterium glutamicum
MNVQFESDMAVQPGNTMEATVTDIRDAKRKTTQLDSVTPFKKNCPSRTLLDTISDKWAVLILLSMENGPQRNGEIKDQVQGITPKMLTQRLGVLVEDGLVTRTSHAVVPPRVDYQLTDLGASVIEPCRAMYSWAVENIKQVEAYRSA

SEQ ID NO: 2153 - DNA, 1437 bp, Corynebacterium glutamicum
  CDS (101)..(1414): RXA01267
tgctagttttaaagaggcgttgaggggtagtatcgcgtaagtttattagtggttagcgtagatttttcgaattgaagatgtttctgaaaggtatttagatatgtatgcagaaattaatggcggttttattccagagggcaccgtgcgggtaagcggcgcaaaaaactctgctactagacttctcgcggcggcactgctaaccgatgaggtggtgcatcttggtaatttcccaaccaagcttgtggatgttgaacataaaattcgctttattgaagagcttggcggaaaagtgcatgtcgaccatgatgagcaaattttagtagttgatgctaaggatcttgcagcgcgagaaatgactactgatgaactgaatattccgattcgaactacttatctcctagcagcagcgcagattgggcgtggggaaattgctcgagttccttttcctggggggtgtgctattggaggaggtcctgctggcggacgaggatatgatcttcatcttatggtctgggaacagctaggttgtaaaattcttgaaaaagatgatcacattgaagtaactgcaccccagggctttatcgggggagttattgactttcctatttctactgtgggaggcactgaaaacgcgttactatgcgcaagtattgcttcaggggatactaaaattgccaatgcttatattacccctgagataactgatcttattgaacttctgcgacgtatgggtgcggagatcactgtctacggtaccagccgtattcatgtaaagggtcgagcaggtcttttgcagggcgcatatatggacgtaatgccggatcgtattgaggcattgacgtggatcgtgtatggaattatttcaggcggaaggattaccgtcgaaggtgttccatttagctcgatggaagttccttttatccaccttgagaaggctggagtggatcttttccgtaattcaagttccgtatatattacaccagaatgcttgccttcaggctcagttcagccatttgagctagcgtgtggaactcaccccggagtaatttcggacatgcaggcactttttgttcttttaggattaaaaggtgcaggaacttcacgcgtctatgactatcgatacccagaaagaattgcatttgttgaggaattgacaaatctagtttcgggcgacaaattaagtgcagaggctggcaagatcactatccagggagatgctactttccggccaggatatgcgaactcaactgatctacgtggttctatggctgttgttttagcggcgctttgcgctgatggaaagtccacgattaataacgtccatatggcgttacgtgggtacaacgagttggataaaaaacttcgtttacttggtgcggatttaactatcagagaaggcgaagttccttcaccttaagaacgaaagttttacattga

SEQ ID NO: 2154 - protein, 438 aa, Corynebacterium glutamicum
MYAEINGGFIPEGTVRVSGAKNSATRLLAAALLTDEVVHLGNFPTKLVDVEHKIRFIEELGGKVHVDHDEQILVVDAKDLAAREMTTDELNIPIRTTYLLAAAQIGRGEIARVPFPGGCAIGGGPAGGRGYDLHLMVWEQLGCKILEKDDHIEVTAPQGFIGGVIDFPISTVGGTENALLCASIASGDTKIANAYITPEITDLIELLRRMGAEITVYGTSRIHVKGRAGLLQGAYMDVMPDRIEALTWIVYGIISGGRITVEGVPFSSMEVPFIHLEKAGVDLFRNSSSVYITPECLPSGSVQPFELACGTHPGVISDMQALFVLLGLKGAGTSRVYDYRYPERIAFVEELTNLVSGDKLSAEAGKITIQGDATFRPGYANSTDLRGSMAVVLAALCADGKSTINNVHMALRGYNELDKKLRLLGADLTIREGEVPSP

SEQ ID NO: 2155 - DNA, 963 bp, Corynebacterium glutamicum
  CDS (101)..(940): RXA01268
taccgatgttaaatcattatttaattgggtgctattgcttaggaaaattcgtccaagagtgctgatagttggaactccgaaagcttcattgctgggagtcgtggcagcacgaattgctcgagtgccacgaattgtctatgtggcacatgggctgcgctctgaaactgttttaggcttaaaaaagaagattctagtgtttttggaatatttgacccagttgtttgcacatcaaactttggctgtaagtcattctctgaagaaagcaattgaagatgcgcaccctcgttttaaaggaagagtgcaagtcttaggttatggcagtatgaatggagttgagcttgatcgctttagagttccatcccttgaagagaaattatctgctcgtaatgctttaaacctgcctagtaaatctgtcattgttggttttgtcggcagaataaataaagataagggaggagatcttctcgctgctcttacaaaacatgaggcttttacccgattgcgactgcatctcttaattattggtgaattggaagacgatgacttgcgagaagcattcattaaattagttaatgaagggcaggttacgattacaggatggattgatttccctgaagaaccattagctgcagttgatgttttgcttcacccaactcagcgagaaggtttaggtatgtctttgctggaagctcaggctatgggagtgcctgtattgacgaatgctgtgactggaacagttgatgcagtaacaagtggagaaggtggcttttttgccgatgacgattctgttgagtcctgggtttctaagattgatttattagtttccgatcctaagttaagagaccggatgggacgtgctggtcgccagtttgtgtcagctcgtttcaatcgtgatgatgtcgcagctcgtttcagtcatttcgtggaacaattcaaaaaatagggctcattcaatttcaatat

SEQ ID NO: 2156 - protein, 280 aa, Corynebacterium glutamicum
VAARIARVPRIVYVAHGLRSETVLGLKKKILVFLEYLTQLFAHQTLAVSHSLKKAIEDAHPRFKGRVQVLGYGSMNGVELDRFRVPSLEEKLSARNALNLPSKSVIVGFVGRINKDKGGDLLAALTKHEAFTRLRLHLLIIGELEDDDLREAFIKLVNEGQVTITGWIDFPEEPLAAVDVLLHPTQREGLGMSLLEAQAMGVPVLTNAVTGTVDAVTSGEGGFFADDDSVESWVSKIDLLVSDPKLRDRMGRAGRQFVSARFNRDDVAARFSHFVEQFKK

SEQ ID NO: 2157 - DNA, 1935 bp, Corynebacterium glutamicum
  CDS (101)..(1912): RXA01271
gtgaatccgatgccggacagatcgcagcaactcaatttggagattcagttttagcctgggttggcgaaacccaatttatttcaaaagatggtggacaaacatggcaataagcattggtaaagcaggacagaacttaaaagggtcagtgcctatcggaaaagtcctttttctcattgatgcccttgcctggatttctgcactatttatcggtgtggttttgcggtatgaattcaatctgagttctatcaactggagtgcgtttgcatggttcgggcttgctgcagttattttgcagtttgttctcggactttctctccatctttaccgcaagggattacgtcaccttttcggtagcttcgaagatacactaaacgtttctatctcggtcattgttgtcggtgttgtcctttggatcgcctcactatttgttggtcagcgttggaaaatctcacgcggtgtcatgctgctagttatcccgcttgctctcgtattcgtattggcagtgcgttatctcgcgcgtatgcgagttgagcgttttcgtcgtccggctgcggattccacaccagcattgattcttggtggtggatacatcggtaccaacctgatccagtggatgatgtccgatcctaagtcgcctttccgcccagtcggcgttattgatgataaccctgaattagcatgccaacgcgtacgtggtgtgccggttcttggcaagtttgatgatatcgcccaagttgcatcagacactggcgcagaacttcttatcgttgctattggtgatgccgactctgcacttttaaggcgtgtccaagataccgctaataaaaatggtctttcagtaaaggtaatgccggctattgaccgcgtcgtttctaagggcgttcgtggaaacgatttgcgtgatctctctattgaagatttgcttggacgtcaacctgttgaaaccaatgtttcagaaattactggctatctaacaggtaagcgtgttcttgttaccggtgcaggtgggtcaattggttcccagctatgtacggaaattgccaaatacggacctgctgagcttatgatgcttgatcgcgatgagactggtttgcagcaggttctgattaacgttgctggtaacggtttgttggatacggatgctgtggttcttgcggatatccgcgaagcagacgcgatgaaagagatttttctcaagcgtaaaccagaagttgtcttccatgcagcagcattaaagcacttgccaatgctggagcagtatccagatgagggctggaaaacaaacgttctaggaactcttaacgttcttgctgccgcagaagctgttggtgttgagactttcgtcaatatttccaccgataaggcagctaatccaaccagcgtcttagggcactcaaagcgagtcgctgaaaagctgactgcctggtatggacagaattccaccagcaagtacctatcggttcgatttggaaacgtcattggtagccgtggatcgatgctcccgactttcaccaggctaatcatggaagataaaccgctaacagtgacgcacccggatgtcactaggttcttcatgacaattcctgaagcttgccaattggtcctgcaagccggtggtattggacgttccggcgaggttctcatccttgacatgggtgagcctgtaagcatccttgaaattgcacagcgcatgatcgcaatgtccggtaaagatattgacatcgtgttcaccggccttcgcgagggcgaaaagatgcacgaagagctggttggtgatggtgaaaccgaagatcgtccattccactcaaagatttcgcatgcacatgcagaaagcctcgctcctaataatctcgatagagatcgatttatgcaacgtgctggaaaactagcttcaacagattcggagatcatctaaatgactaatgaacgaatttt

SEQ ID NO: 2158 - protein, 604 aa, Corynebacterium glutamicum
MAISIGKAGQNLKGSVPIGKVLFLIDALAWISALFIGVVLRYEFNLSSINWSAFAWFGLAAVILQFVLGLSLHLYRKGLRHLFGSFEDTLNVSISVIVVGVVLWIASLFVGQRWKISRGVMLLVIPLALVFVLAVRYLARMRVERFRRPAADSTPALILGGGYIGTNLIQWMMSDPKSPFRPVGVIDDNPELACQRVRGVPVLGKFDDIAQVASDTGAELLIVAIGDADSALLRRVQDTANKNGLSVKVMPAIDRVVSKGVRGNDLRDLSIEDLLGRQPVETNVSEITGYLTGKRVLVTGAGGSIGSQLCTEIAKYGPAELMMLDRDETGLQQVLINVAGNGLLDTDAVVLADIREADAMKEIFLKRKPEVVFHAAALKHLPMLEQYPDEGWKTNVLGTLNVLAAAEAVGVETFVNISTDKAANPTSVLGHSKRVAEKLTAWYGQNSTSKYLSVRFGNVIGSRGSMLPTFTRLIMEDKPLTVTHPDVTRFFMTIPEACQLVLQAGGIGRSGEVLILDMGEPVSILEIAQRMIAMSGKDIDIVFTGLREGEKMHEELVGDGETEDRPFHSKISHAHAESLAPNNLDRDRFMQRAGKLASTDSEII

SEQ ID NO: 2159 - DNA, 1557 bp, Corynebacterium glutamicum
  CDS (101)..(1534): RXA01273
gacctattcagcgctggattttttctggcattttcttggcagtcagtgagttgctaacgttctattggttaaaaattgatctgcaagaggactgcaaaatatggaattaagggaatacgcgacaatcctgatgaagaattgggtgttgatcgttatcgcatccattcttggaattgcagcgggcgctggtttttcccttctagctacaccggagtatcagtcacgtactcagttgtatgtatcggtgcggtcgggggctgggacaacctctgacatggttcagggtgctaacttttcgcgtcagattgtgaatagttatgttgatgtcattaagacgggtgttgttctagagccggttgttgatgagcttggtctggagttgacggctaaccagttgagttctcatatcagtgcggcttctcctgctgatactgcgttgatcaacatcactgcttctagtccttctcctcagcaggcggctgagatcgccaatgcagtgggggagagtttcaagaatgtgattcagactgaattggaaccagactccggcgatggcatgagcccgattaacctgactactactcaggtggctctggaaccatcttctccggtcagtcctaatgtgatgatgaatatcctcctcggcctacttgtaggtcttgcaataggtgttggtattgcagtgcttcgcgcggctttggatactcgtattcattccttgcgcgatattgaagaggttactgataagccacttttgggcggaatcattgcggattctgaagttgagaagcacccgttgatcattaagcacaagccgcatagtcctattgcggagtcctttcgtgcgttacgtactaacctgcagttccttaacgtcggcggctcatcttcagtatttgttatctcctctgctaatcctggtgagggtaagtcaaccacttctgtaaacctagctttggcgcttgcagaggccggctcccgtgtagcgctgatcgaagctgatcttcgcttgccacgagtgagcaagtacctcggagttgagggcaacgcaggtctgactgacattctcattggcaaggccgaggttaatgatgtgttgcagcgttggggtaggactcagttgtactatctcccggcagggcgcattccgccgaacccgagtgagttgcttggttcagctgagatggacaaggtcattgcggagcttgaggaaagctttgattatgtgatcatcgatgcccctccggcgttggcggttaccgatgctgcagttattggtcatggcaaggctggcatcctgattgcggtctccgcaggttctacaaagaagcctgagttggaagctacgctgtccacgcttgagaatgcggatgccaatgttgttggcgttgtcgctacgatgctcccgcctaagtctgtggctggttatggctacggaaattacggctacggcgacacctccaaaatcaatgcccctaagcccgacaacaccgaactaaccaccaccgatgcttccaaggccaacaatgagcaatagcttcactattctcactgtct

SEQ ID NO: 2160 - protein, 478 aa, Corynebacterium glutamicum
MELREYATILMKNWVLIVIASILGIAAGAGFSLLATPEYQSRTQLYVSVRSGAGTTSDMVQGANFSRQIVNSYVDVIKTGVVLEPVVDELGLELTANQLSSHISAASPADTALINITASSPSPQQAAEIANAVGESFKNVIQTELEPDSGDGMSPINLTTTQVALEPSSPVSPNVMMNILLGLLVGLAIGVGIAVLRAALDTRIHSLRDIEEVTDKPLLGGIIADSEVEKHPLIIKHKPHSPIAESFRALRTNLQFLNVGGSSSVFVISSANPGEGKSTTSVNLALALAEAGSRVALIEADLRLPRVSKYLGVEGNAGLTDILIGKAEVNDVLQRWGRTQLYYLPAGRIPPNPSELLGSAEMDKVIAELEESFDYVIIDAPPALAVTDAAVIGHGKAGILIAVSAGSTKKPELEATLSTLENADANVVGVVATMLPPKSVAGYGYGNYGYGDTSKINAPKPDNTELTTTDASKANNEQ

SEQ ID NO: 2161 - DNA, 903 bp, Corynebacterium glutamicum
  CDS (101)..(880): RXA01282
caggatgggtcggaacgttcgcgtcgtttgcggtgtggttctgggtcatttggtgggcagcggtaggaaatacaaaaagcccactctaagatggcagggtatggatgagctgctcaaacaggaagtcaaggatttcctcaccaccaggcgtgcacggattacgccggccgctgcgggactagaaacgcagccgtggagtgatcgtcgggtgccggggcttcggcgggaagaagtcgcggatctggcgggcatttctttggagtattacatccggtttgagcgcggaaatctcaagggtgcatcgcctgaaatattgcaatcgttggctaaggctctccaactgagcccaattgagcgcgaacaccttcacaatttggcttatcgcgccgaccatccgcgcaacctacctagtgcagagaccccaacggcacccctccaggacatcgttgatgcggtcacagataaaccggcgtggatccgcaacgagcagatggatattttggctacaaatcggctctgcgcggaactttacgccccgattttcaaggatctgcccgatcggcccaacactgcgcggcattgctttatcggcgcaacagcctccgagttctgggtggaccgggatcagttcagtgcggagttcgctgccaaactacgcctcgagtacgcccggcgccccagcgtgccaggtttaaaggagcttatcgacgagctccatcagaaaagttctgttttccgcgataattgggcgtctgctgatgttttgtcattcggctctggcatcaaacgtttcaggcacccaacactgggggagcgggtctatgaatacgagacgtttaatctcaatagtgcaccggggtatgtgttgagcatttacttttaggtggtggaggggcgcgtcga

SEQ ID NO: 2162 - protein, 260 aa, Corynebacterium glutamicum
MDELLKQEVKDFLTTRRARITPAAAGLETQPWSDRRVPGLRREEVADLAGISLEYYIRFERGNLKGASPEILQSLAKALQLSPIEREHLHNLAYRADHPRNLPSAETPTAPLQDIVDAVTDKPAWIRNEQMDILATNRLCAELYAPIFKDLPDRPNTARHCFIGATASEFWVDRDQFSAEFAAKLRLEYARRPSVPGLKELIDELHQKSSVFRDNWASADVLSFGSGIKRFRHPTLGERVYEYETFNLNSAPGYVLSIYF

SEQ ID NO: 2163 - DNA, 789 bp, Corynebacterium glutamicum
  CDS (101)..(766): RXA01294
atgaagggataccgctccttttcgggggtacagcactccagcaagactcattcggctcagttagagttcaccacaacgactcaaaaaagaaagtggcagcatgtctacgattcctgatgttttcaccagtgaagtgttccctgaaatcagtggcaccaaagaattccgtggcctgacttatatgttctttgatcaattcactttgcccaccgcagaacagcttgagcaagctaaagcagctggctggtcactgatcacctggggatggtggaatagcgacaccgatcttgaggatgtcgaattggaagacatcactaatgaaggcgacagcctaccaaaactcacggatgaattcgctgtgtcttcactgagcaccttcgatctaaattcccaaggtctgcccaatgatgatcgtgagccgcaaccaattgaagaagccgactcactagatgacatcttctccgaggaagagggctggggtctaatggcaatcaattgcccgaattggcaagtcccagcagcgtgtgaatggctcggctgcatgaatgttggtgaaccatttgaaatgtcacacgtacttagggtgtggcagaacagttggggcgtcgaggccctggcttttggtggtgaagaagacgacgcggatctgctgcttcgagtccctgaagaaagcgaagagctactgaaggctctcgcagtcgcttctgaccaagtcactacctacaagcatgaagatctgggattcttagctagtctttggtttgactaactacaatcaatgtcatgacc

SEQ ID NO: 2164 - protein, 222 aa, Corynebacterium glutamicum
MSTIPDVFTSEVFPEISGTKEFRGLTYMFFDQFTLPTAEQLEQAKAAGWSLITWGWWNSDTDLEDVELEDITNEGDSLPKLTDEFAVSSLSTFDLNSQGLPNDDREPQPIEEADSLDDIFSEEEGWGLMAINCPNWQVPAACEWLGCMNVGEPFEMSHVLRVWQNSWGVEALAFGGEEDDADLLLRVPEESEELLKALAVASDQVTTYKHEDLGFLASLWFD

SEQ ID NO: 2165 - DNA, 1098 bp, Corynebacterium glutamicum
  CDS (101)..(1075): RXA01295
tttctggtgttaccctcgggtaattgtaaaaaattcattgattaaaaacgatcagccaattggcatgctcagactccttgtgaagaaagtgacagtttcgatgaccgaaaatcttgataatgcgttgctatccatgcggatgaaacctgtacaaatggcgcttatgacactgggctacaaccatgacatggcggtgaccgattccggtatggaacttatagtgcgccgcccagggctgaccgtgaacttcaacttggattcggtcaccttgtgcatcgtcgctgatttcatgtggcatggctgtgtccctgcaaagaaacaggcagagtacctgcgggccgctaatgaattcaacaggccaacccgtgatctgcaggtggttttagatgaagctgattcaaagaacatgactgtgcgaggtcgtgaattcttcttctcaagcgtcggcgcaacgtgggaacagtcggcagagttcgtgcactactgcatgaatgatgtggcaacgactttcgtgtcttggtgcgaacaaatctggccgaagttttcccctgaacgcgtagagttcaacgcaactcctccagatgtggatttcgagttctctgaagatcaactcaaagaaggcaatcccttcgggctgattgacgaacccaccccgctggtttctttggatcgtatctaccaacaatacgaattaatgggtgcggatcaactcaagatgggggaggacttcgttgagtatctgcatatgggtcaacgtgtcagtgcatggttgaccgatggcaacaacggcagcgatcgaaaaaccctagcggtgtcttccggtacaggtgtgaaaatcaaaaacaagaagcaacttcaggaacttcttggactgtgcaacctgtactcgaaagaacatgtactggtcacagtatttgcggaagagatcgaaaacggcgcaaggtggggtattttcgccgaagcacgcatcgatctaccggcagggttaaacgatcatcagttgtgggtattcctcgccaactccagcaaatggactgcagaggtgtgcctgaccgtggcacaccgactgcagaactaaaggcagaacttaagcgttca

SEQ ID NO: 2166 - protein, 325 aa, Corynebacterium glutamicum
MTENLDNALLSMRMKPVQMALMTLGYNHDMAVTDSGMELIVRRPGLTVNFNLDSVTLCIVADFMWHGCVPAKKQAEYLRAANEFNRPTRDLQVVLDEADSKNMTVRGREFFFSSVGATWEQSAEFVHYCMNDVATTFVSWCEQIWPKFSPERVEFNATPPDVDFEFSEDQLKEGNPFGLIDEPTPLVSLDRIYQQYELMGADQLKMGEDFVEYLHMGQRVSAWLTDGNNGSDRKTLAVSSGTGVKIKNKKQLQELLGLCNLYSKEHVLVTVFAEEIENGARWGIFAEARIDLPAGLNDHQLWVFLANSSKWTAEVCLTVAHRLQN

SEQ ID NO: 2167 - DNA, 609 bp, Corynebacterium glutamicum
  CDS (101)..(586): RXA01304
atgcaggtaaacgaatttgtgcttatatcaacattcgtgattcggcaaaattaattaaactgaaaaaggggattaattacccccacttgaggagaaattgatgcccgcacagaacaaaaacctcccaggatccgtcatcgttgtgtctgatcggattaaatcgggagaaagaattgataaagcaggacccgtagcagtagaccttcttcaggaatcaggcgtggagatttccacattcaccgtcgtggaggagggctttgaacctgtccatcaagaattggttaaggcgttggcgcgccgggatcgcgtcatcatcaccatcggcggaacgggcgtggggcctagaaatcggacgccggaggccacagaaccgcacatcgatacgctactgccgggtctgatgacgcagattttgttctctggactgtccaataccgcgcaggcggggttatctcgggggctggtgggcttgagtgctcgcgattccacggccgcgctcatcgtcaacgcgccgagttcttccgggggcgtgcgcgacgcgctcggggtggtctgcccgcttttcggttccatttttgagcgtctttaaaagatttttgcttatcgacg

SEQ ID NO: 2168 - protein, 162 aa, Corynebacterium glutamicum
MPAQNKNLPGSVIVVSDRIKSGERIDKAGPVAVDLLQESGVEISTFTVVEEGFEPVHQELVKALARRDRVIITIGGTGVGPRNRTPEATEPHIDTLLPGLMTQILFSGLSNTAQAGLSRGLVGLSARDSTAALIVNAPSSSGGVRDALGVVCPLFGSIFERL

SEQ ID NO: 2169 - DNA, 450 bp, Corynebacterium glutamicum
  CDS (101)..(427): RXA01310
aaggaacgtgcgcgtgcagctttccgaggcaaagacgactagtctttaatccaagtaagtaccggttcagacagttaaaccagaaagacgagtgaacaccatgtcctccgcgaaaaagaaacccgcaccggagcgtatgcactacatcaagggctatgtacctgtggcgtatagctctccacactcatccctcgagcgcagcgcaacctggttgggcatgggattcctcctcactgctctggcaggcgttggcgcagtcctcttcgcagtcggcgcaaacagcgttggccagcagcaggaacactgggtcctctacagcatcatcggtgttgtattcgccgttgtctgcacagttttgggcaccgtcctgatcatcaagggccgagcaccttacaaccgttacgtcaaggaaaccggccgtacgcagtagtttctgtatgcaggttcttt

SEQ ID NO: 2170 - protein, 109 aa, Corynebacterium glutamicum
MSSAKKKPAPERMHYIKGYVPVAYSSPHSSLERSATWLGMGFLLTALAGVGAVLFAVGANSVGQQQEHWVLYSIIGVVFAVVCTVLGTVLIIKGRAPYNRYVKETGRTQ

SEQ ID NO: 2171 - DNA, 968 bp, Corynebacterium glutamicum
  CDS (1)..(945): RXA01313
gccctacgcctcatttcacagctgcttgcaccatctgcggcgttgaattttaagtccgagcgcaatgccgtcgacgtggcaaaacacatgctcgccagccaggcccaacaacgcggttccgcactcgttgcgctagacacccgctcggaaaacgccgacgccgccacggcattaagaaagtcactgctcatccgcagctggacgcagcgcggcacccaccaaatacttgccgccgaagacgtccgctggatgacgctactatgctccccacgcatcctggctgcttcagccaagcgccgctccagcctttcgcttgatagcgccgcagtccagcgcgcccgcgacgcactaacaaccgccgccgaaaaatcccccgtatccagaacccaggcctacgaaattttccgatccgtagacgttgaccccggcgagcacagaggccaacatttactccggcatttcggtggcgaaggtgacatcgtacaaggcccgcccatcggaacggaagattcctttgtgcttctcgattccatctgccccctttccctagcacttaacggcgacgaagcgctcacagagatgacccgtcgctacttccactcccgtggtgctgccactgtgaaagatctggtgtggtggaccggactgactgtgcgtgatgtaaagaaaggcatcgctgccgtgtcttcggatggactgattcactctgttgaaggcccgaatggtgaagaaatgtggatccctacctgggcagatgatgtcacagacgcagaggtttctgatgcactagcgttggaactaaccctccccgcctttgatgaatacctactttcctacaccgaccgcagccacgtcatggatcccgagcaccttttcagcatcggtcccggcaaaaacggtgtgttcaaacccttcaaagtagttcagggtgaggcactgccggtttagcccagcaaaatcttcacttg

SEQ ID NO: 2172 - protein, 315 aa, Corynebacterium glutamicum
ALRLISQLLAPSAALNFKSERNAVDVAKHMLASQAQQRGSALVALDTRSENADAATALRKSLLIRSWTQRGTHQILAAEDVRWMTLLCSPRILAASAKRRSSLSLDSAAVQRARDALTTAAEKSPVSRTQAYEIFRSVDVDPGEHRGQHLLRHFGGEGDIVQGPPIGTEDSFVLLDSICPLSLALNGDEALTEMTRRYFHSRGAATVKDLVWWTGLTVRDVKKGIAAVSSDGLIHSVEGPNGEEMWIPTWADDVTDAEVSDALALELTLPAFDEYLLSYTDRSHVMDPEHLFSIGPGKNGVFKPFKVVQGEALPV

SEQ ID NO: 2173 - DNA, 774 bp, Corynebacterium glutamicum
  CDS (101)..(751): RXA01315
catgtgcggttgtgtcctaagtcattgatgtcacctaacgcccctaagttcactcggtgcaatattgcactgagtgcaagtttacactaggtttacttcagtggatattgaagagcagccctcgttaagagaaatcaagcgccaaatgaccctggaagcgatagaagataacgcaaccaggctcattctggagcgtggcttcgacaatgtcacaatcgaagacatctgcgcagaggcagggatatccaagcgcacattctttaactacgtggagtccaaagagtctgtggccatcgggcacacagccaagctcccaacggatgaagaacgtgaagcattcctggctacgcgtcatgaaaatattatcgatactgtatttgacctggtaatcaacctctttggcaaccacgacaactccaagtctggagttgcaggcgacattatgcgtcgacgcaaagagatccgggtgaagcatccagaactggcagtgcaacatttcgccaggttccaccaagcacgcgaagggctagaacacctaattgttgagtacttcgaaaaatggccaggctcccaacatctagatgagcctgcagatcgagaagcaatcgccatagttggcctgctgatctcggtcatgcttcaaggttctcgtgaatggcacgacatgccacaaggcacgcaagctgatttccaagcctgctgtcgcaaagcaattaaaaatacttttcttcttagaggtggattttcagaatgacatcacaggtcaagccggac

SEQ ID NO: 2174 - protein, 217 aa, Corynebacterium glutamicum
VDIEEQPSLREIKRQMTLEAIEDNATRLILERGFDNVTIEDICAEAGISKRTFFNYVESKESVAIGHTAKLPTDEEREAFLATRHENIIDTVFDLVINLFGNHDNSKSGVAGDIMRRRKEIRVKHPELAVQHFARFHQAREGLEHLIVEYFEKWPGSQHLDEPADREAIAIVGLLISVMLQGSREWHDMPQGTQADFQACCRKAIKNTFLLRGGFSE

SEQ ID NO: 2175 - DNA, 426 bp, Corynebacterium glutamicum
  CDS (101)..(403): RXA01316
aaagcgcaaggctaagaaggattccccagaaccaggcgatgacgatatcatcgatggagaagtaattcctccgcagaattaaggaagtcggtttcaccccatggatatttccatgctcaacgtaataacgagctacaccatttgggccatttttgccatcatcggcatctgcggattcgttggtgccttcttggcagccaccaccagagaagatgcctttgaggttgctgatcgccaaaagaaaatggtgtgggtagcaatccttatcgcatccggatttgtcctcaccgcgctaggtccatcgattccgatcctgccatgggtcgccatcatcatgatcggcctgtactggtttgatgttcgcccgcaaatcaagagcatccttgaaggtgccggcggctggtaaaagctccctgaactgcgaaa

SEQ ID NO: 2176 - protein, 101 aa, Corynebacterium glutamicum
MDISMLNVITSYTIWAIFAIIGICGFVGAFLAATTREDAFEVADRQKKMVWVAILIASGFVLTALGPSIPILPWVAIIMIGLYWFDVRPQIKSILEGAGGW

SEQ ID NO: 2177 - DNA, 543 bp, Corynebacterium glutamicum
  CDS (101)..(520): RXA01317
atacatccgccttaatggcacaattgtaggtgcattagcaggactggccatttacgctatttcccatatcctcttcggagcttaactaggagtaaccatcatgtccgatgcaaaagacgattccatcttgtccaagtggagcaatgcagcttccgagctcagcggtgccgtcagtggagtagcgaagaagctccgtgaagaactctctgagaaggaaaccttcagcaagcttaaaaccgaagccagcgaagccgtcgatcaagcaaagtccggctcctacctagatgccggtaaggaattcgcccgcgacgccggatccatcatcaaagatgcagccaaaaccgtcaaaggtgccgtcagtgattccgataaaaacgacgtgaaatccgccttcggtaacgccgtggaagcttcccgcgacaagttcgatgacaccctcgaaaagcgcaaggctaagaaggattccccagaaccaggcgatgacgatatcatcgatggagaagtaattcctccgcagaattaaggaagtcggtttcaccccat

SEQ ID NO: 2178 - protein, 140 aa, Corynebacterium glutamicum
MSDAKDDSILSKWSNAASELSGAVSGVAKKLREELSEKETFSKLKTEASEAVDQAKSGSYLDAGKEFARDAGSIIKDAAKTVKGAVSDSDKNDVKSAFGNAVEASRDKFDDTLEKRKAKKDSPEPGDDDIIDGEVIPPQN

SEQ ID NO: 2179 - DNA, 1425 bp, Corynebacterium glutamicum
  CDS (101)..(1402): RXA01318
ggacgcgttccagagaaaagtgcaggcataacccctaaaataccctgatcttcccccgtgtcctgcccccgtgtccacccctgcgtacataataggacgcatgggaaaacatgaggttgctcagcagacggttccgggtccttcgccggaaatggaagcgcagcggcgtaaagagttgcgcaagcacaaggccattgccactggcctgttgatttttgctgccgctgtatattttctttgccgtttcgtggagacccgtccgggtgaaactgcagcgtgggtaggttttgtgcgcgctgcggcagaggccggaatgattggcgggttggccgactggttcgcggtcaccgcgctgttccgtcatccattgtggctgcctattccgcacactgcgattatcccgcgcaagaaagaccagttaggtgaggccttaagcgggtttgtgggggataacttcctaaatgcccagctcattacggaaaaagtctctcaggcgcggatcccagagcgcgccggggagtggctcgcccagccggaaaacggggagaaagtttcgcgcgaagtcggcaaattgaccgctaatattgtgcgcgcaatcgatccgtcagatgctgaagcggtgattaaatctgcggtgatcgacaagcttgcggaacccacctggggcccaccagctgggcggttgctggaacaactcctcgccgaaggcaaagccgaaccagttgtccaggaactcgcgcagtggctgcacaaaaaggcgttgggctccgagccgctgattgatcgcctgctcaacgagcgccgcccgatttgggcgccgaaattcactgcgcagctggtcagcggcaaagtctatgacgaggtcataaaattcactgaagccgtcgctgccgatcctaaccacgaggcccgcaaatcgctgcgccgattccttaataaattggcgcaagacctgcagcatgacccaggcatgattattaaagttgaagaaatcaaacgcgacatcatgggctccggcgccatcgcgcaagccgcgccaaccatctgggcgtcagcctccgagtcgctcattgaatccgcagaagatgagtcatcaattctgcgtcgcaaaattgccgaagcagctaccagctggggtcaaagattgcttgtcgacgactccctccggcattcactcgacacccggattaccggcgccgctgctttcctcgccgacaattacgcccccgaagtcaccggcattatctccgaaaccattgaacgatgggacgctgaagaagcttcagagaaaatcgaactcatggtgggcaaagacctccaatacatccgccttaatggcacaattgtaggtgcattagcaggactggccatttacgctatttcccatatcctcttcggagcttaactaggagtaaccatcatgtc

SEQ ID NO: 2180 - protein, 434 aa, Corynebacterium glutamicum
MGKHEVAQQTVPGPSPEMEAQRRKELRKHKAIATGLLIFAAAVYFLCRFVETRPGETAAWVGFVRAAAEAGMIGGLADWFAVTALFRHPLWLPIPHTAIIPRKKDQLGEALSGFVGDNFLNAQLITEKVSQARIPERAGEWLAQPENGEKVSREVGKLTANIVRAIDPSDAEAVIKSAVIDKLAEPTWGPPAGRLLEQLLAEGKAEPVVQELAQWLHKKALGSEPLIDRLLNERRPIWAPKFTAQLVSGKVYDEVIKFTEAVAADPNHEARKSLRRFLNKLAQDLQHDPGMIIKVEEIKRDIMGSGAIAQAAPTIWASASESLIESAEDESSILRRKIAEAATSWGQRLLVDDSLRHSLDTRITGAAAFLADNYAPEVTGIISETIERWDAEEASEKIELMVGKDLQYIRLNGTIVGALAGLAIYAISHILFGA

SEQ ID NO: 2181 - DNA, 579 bp, Corynebacterium glutamicum
  CDS (101)..(556): RXA01330
ccgtccgttttcctggtgggtcggccccgcatccagccctagaaatatcggagagctgctcgttgaggcccaatgaaatgcctccgaaacagaaacaggcatgtggaaagacttaaccgaaccgctgcccgaagcttgcgctgagggcttagagatccgggtggttaaatctcccgaagagctggcagattacgctgcagttctttctgcgaattggaatccacccgccgaaactgtgcagcgtttctataccgaagcagctgaatacgcactgagaaagaactcgcccgcactttatctggtgggttatgcgggcaaccgcgcagtgtgttctgcggaagcattcatacacgcgagcgtagttggaatctacaatatctccacccttgagcacaaacgccggcgtggctacggcggagccatcaccttagccacgttgcataccgcacgtaacgcagggtgtgacaccgccgtgttgcaagcttccgaagatggtgagcccgtttatcgcaaactaggattcaccgactgcggtcgatttactgaatactctttgtgattagttagggaccgtatgcg

SEQ ID NO: 2182 - protein, 152 aa, Corynebacterium glutamicum
MWKDLTEPLPEACAEGLEIRVVKSPEELADYAAVLSANWNPPAETVQRFYTEAAEYALRKNSPALYLVGYAGNRAVCSAEAFIHASVVGIYNISTLEHKRRRGYGGAITLATLHTARNAGCDTAVLQASEDGEPVYRKLGFTDCGRFTEYSL

SEQ ID NO: 2183 - DNA, 1128 bp, Corynebacterium glutamicum
  CDS (101)..(1105): RXA01333
cgccctttaaggcccgtaaagcactccacaacacttcacggcaggccgtaatttccctgtgaggtactttcttgcaagttgtagcgcaccgccgataccaatgcctggcgggtgctccggtaacatcgtccgcatgctgcctaaatcccggattttctccgcaatcttgctcggaattggtgtggcacttgtggtctggggtctggtggctccgcgctttgtgcacgctgatggccgtttgcctcttgatttggaggcgacgacgtacgttctccatgactctgacgctcagaccactattaattctgatccgttggccggtgtggtgactacgccggtgactcgtcagttgcattttgaggtgatggatcctgcgagtgctgatgatgccactattcgtattggtgattcgatgttgcgtggtaatcctgatactcagggttttgagcaggaacggctcctgtcagcgactgtgtcgagtttccgcattgatcgcacctctggtgaggttttgtccgatattgcgctgactaatcagttggcgagccctacggtgcagtattcggtggatggcatttggttgaagttcccaactgacgcgcaggagaccacttacaacgtggtggatccggtgctgaggtctgcgctgccggcggattttgtggagtccacggagatcgatggccgtgaggtgctgcattaccgtcaggtgattgataacgtgaatgtggcggagtatttcgcggatgccaacaacaccaccacgttgactaaagaggatggcggtaccacgacgggctatttttatcacaatgtgactcgtgatttttgggtggatcagcgtaccggtttggttgtcgatctagctgaaaatattgatgatttttacggcgaccgcagcggccagaagtacgaacagaaattgcttttcgacgcctccctcgacgatgcagctgtctctaagctggttgcacaggccgaaagcatccctgatggagatgtgagcaaaatcgcaaataccgtaggtattgtgatcggtgcggtattggctctcgtgggcctggccgggtgttttggggcgtttgggaagaaacgtcgagaagcttaacctgctgttcaaatagattt

SEQ ID NO: 2184 - protein, 335 aa, Corynebacterium glutamicum
MPGGCSGNIVRMLPKSRIFSAILLGIGVALVVWGLVAPRFVHADGRLPLDLEATTYVLHDSDAQTTINSDPLAGVVTTPVTRQLHFEVMDPASADDATIRIGDSMLRGNPDTQGFEQERLLSATVSSFRIDRTSGEVLSDIALTNQLASPTVQYSVDGIWLKFPTDAQETTYNVVDPVLRSALPADFVESTEIDGREVLHYRQVIDNVNVAEYFADANNTTTLTKEDGGTTTGYFYHNVTRDFWVDQRTGLVVDLAENIDDFYGDRSGQKYEQKLLFDASLDDAAVSKLVAQAESIPDGDVSKIANTVGIVIGAVLALVGLAGCFGAFGKKRREA

SEQ ID NO: 2185 - DNA, 726 bp, Corynebacterium glutamicum
  CDS (101)..(703): RXA01336
catggcatccgcctccaacgcgccgggcgggggagtccacggaatgcccggctggtgggcagcgcaagccgttttagcagatcacaggtagaattgcgacatggagcccaccgtaaaagccagcgcgcgccacaccatccacgtcaccgccgacacctggcgcatccgcctgagtgcctcagcccactcacaccccaacgacgcgtacgcgcgccgggctacggcaatttccgccataggcagcgtgcttatcgacgtccccctccaaggcgaacgcatctctgaatccactgcatacgacggccaaatcaacgccgactggaacgcagaagtcaccggcaccgatgtgaacatcgcacgcgacatcatctcccggctcgcagcggtgccagacgttcaagtcgacggcccgttgtggtccttgagtgacagtttggctgcagaggctgctgtggaggcattgcaaggtgctgccgacactgcgcggaacaccgcgaccgccatcgcagaatccctcggcgggcagctaggtgcacttctctacgcaacaaccgacacccacagctccacaccgataccagcacgcgcagaaatgatggcagcaaaagcctccataccaccgcgcacactcgacctagaactcgccccctctgacatcgaagtcaccaaagaaatcgccgtgacctttgaattccttgcaggctaaaccgcgatttggtatttcgg

SEQ ID NO: 2186 - protein, 201 aa, Corynebacterium glutamicum
MEPTVKASARHTIHVTADTWRIRLSASAHSHPNDAYARRATAISAIGSVLIDVPLQGERISESTAYDGQINADWNAEVTGTDVNIARDIISRLAAVPDVQVDGPLWSLSDSLAAEAAVEALQGAADTARNTATAIAESLGGQLGALLYATTDTHSSTPIPARAEMMAAKASIPPRTLDLELAPSDIEVTKEIAVTFEFLAG

SEQ ID NO: 2187 - DNA, 1635 bp, Corynebacterium glutamicum
  CDS (101)..(1612): RXA01342
gatgagtattctctccgaggcaacgaagttaatatgtccatgagggcgaagttgtagacaatatttggcccatatggataattgacaggagtttaacgccatggaaaccccaacccaagacatggatgtccgctggttatacacccaaagccagctcaaactccgcgaaattctccccacaaacaaaaccttcgatgtcatccaaatcagcgaactcgttgaccccaccgacttcatcaggcccaacagcgtggtcttatccgttggcatcgccttcgcagaaacgcccgacgggcttcgcgattgggcacaccgactcgccgacgcaggggtcatcgcgatcgggttcggctccggcctcaccttcccacaggttccgcaggcgcttatcgacgcctccctccaccttggcctcggcctctttgaagtcccccgtgaaattccatttatctcgatcacctccagcgtgcgtgatgagcaaacccgccgtgccggccgcctgcaacaagaactcctcctggaacaggaacggcttaactccatcgccatctccggtggcatcgaagccctgtgccgtgctgccgccgactatttgggtggtgcagtaaccatcgtggacagcgacggccgcgtggcttgctctattaccaccgatgacctagacgcactcccccaagctgtctcgcgcctgaacggatccagtcaagcactcacggatgccaccaactttggattcatccaccgcatgacccgctacggcgaccgccaccacgtgctctcagtccttatgcccacccgccccacagaccaacaccgcgcgctgatcagacactgcgcaggccttgccgatattttgctccaacgccccgaagccatgcgcgaccgagaaatcgaagtgcgatcacttgccatgtcactacttctgggtcgaagcgacgacctggccaccattcaccgcgtgttcgctgacatcactgatgcttccggaaatatccgccccatcctcatcaccggcaacacaccccaatcagtacgaaaagcactctccagtgtcgccaccgcactgtacaaacaggaacgagcactagctcatctacgcctcgccgaatccaccgaactcctcttccttcgcggaagccgcagcgtgcacaacatcgtgcaactttttggtactgccgcaagcggagttcgcctctgcattggtctgcccacccgagcggaaaacatcgataagaaactcatccgcgaactcactgccaccgcaaaaaccctacaacttggaacccacgccgaaccccgtgacggcaccttgctgtggctccaaaaccccgagctgcgcaaaatccttaagatccgatcccgcgacacctacgaccgtctcctcgaccacgaccgcaccaacaacaccgagctcgcccccaccttggtgtcttttactcagcacagcggacatataggcgacaccgccaaagaactgggcatccaccgccacaccgtgcgcacccgcatgatccgcattgaagagatctgcgaaatcgacctcaatgatccactgaccagagcggagctgctcttagtgatcgcaacgaaggagggagacgtcgaaaagcaataaaaagaccccatgcaaagcat

SEQ ID NO: 2188 - protein, 504 aa, Corynebacterium glutamicum
METPTQDMDVRWLYTQSQLKLREILPTNKTFDVIQISELVDPTDFIRPNSVVLSVGIAFAETPDGLRDWAHRLADAGVIAIGFGSGLTFPQVPQALIDASLHLGLGLFEVPREIPFISITSSVRDEQTRRAGRLQQELLLEQERLNSIAISGGIEALCRAAADYLGGAVTIVDSDGRVACSITTDDLDALPQAVSRLNGSSQALTDATNFGFIHRMTRYGDRHHVLSVLMPTRPTDQHRALIRHCAGLADILLQRPEAMRDREIEVRSLAMSLLLGRSDDLATIHRVFADITDASGNIRPILITGNTPQSVRKALSSVATALYKQERALAHLRLAESTELLFLRGSRSVHNIVQLFGTAASGVRLCIGLPTRAENIDKKLIRELTATAKTLQLGTHAEPRDGTLLWLQNPELRKILKIRSRDTYDRLLDHDRTNNTELAPTLVSFTQHSGHIGDTAKELGIHRHTVRTRMIRIEEICEIDLNDPLTRAELLLVIATKEGDVEKQ

SEQ ID NO: 2189 - DNA, 615 bp, Corynebacterium glutamicum
  CDS (101)..(592): RXA01348
atgggacaatgagcacgtgactctacgatctgcattacttgcgctactaagttccggaccattgactgggtatgacgcctcccagcgatttggggcctcggtgggctttgtgtggagtggttccgattcgcagatttatcccgaacttcgaaaaatggaagccgaagaactcctcgtgggatccgatgttccctggggctccaaaggcgccaccaaaaccgaatacgccttgagtgaaaaaggctgggaagcgctaagaaaagcgtggtacgagccagtaacctacggtcccaccagagatcctgccaggcttaaagccgcctattttgaggtcggtacaaatggcgatgcacgccgacatttaagggcgcacatcgctcattttgaacagcagaaaattcaatcagaatcaatgattgatgagctgaaagcaaaaactcatccaaccttggcacggcgacttgagcgctccccgaaaaaggagcacgagcgaatagtcgcgtttaaagtgcttgcctatgaggggcagattgcacgcgctcaggcagagattgaatgggcggaaaagggcttgaaactactcgataccctttagttttcgaacacgtccgtatc

SEQ ID NO: 2190 - protein, 164 aa, Corynebacterium glutamicum
VGFVWSGSDSQIYPELRKMEAEELLVGSDVPWGSKGATKTEYALSEKGWEALRKAWYEPVTYGPTRDPARLKAAYFEVGTNGDARRHLRAHIAHFEQQKIQSESMIDELKAKTHPTLARRLERSPKKEHERIVAFKVLAYEGQIARAQAEIEWAEKGLKLLDTL

SEQ ID NO: 2191 - DNA, 900 bp, Corynebacterium glutamicum
  CDS (101)..(877): RXA01349
agttgtcagctgggatttgccgatggtgttatctttgatatttaccttaaccccgtttctaattcacgttttctcgttacccgaaaggaattgatcgattatggcgacatcacgtcgagatgccgaaaacatagaccaggccggtagcgaattcattgaatctgattcaggacacaccgcaacccctgaagaggtagtagccaccgctctgacattttttgcagaggatggttttagcgaaaccaaattggagaaaatcgcgaaggcatctggcatgtccaagcgcatgatccactatcactttggcgataagaaaggcctgtacatcaaggctgtttcctacgcgttgcgattgctgcgcccagaggctgaagcgatgcaacttgattccgcggtaccagttgatggtgtccgcaaaatcgtcgaggctttatatacctgcatcaccaagcacccagaagcagtgcgcctgctattgatggaaaacctgcatagccaagacagcgtggattccaccgcggcatattccgatgaatccaatgtgctgctcaacctggataagctgctcatgcttggccaggatgccggcgccttccgtcctggaatctccgcagaagacgtactggttcttattagctccctggcctacttccgcgtatccaacaaggtcacgttgaagaacctctactcccttgatttggaatcagaggccaatattgaaggcatgaagcgcatcgtcgttgacacggtgctggcattcttgacctcaaatattcaaaattctggcaactccagctacctggttgttggtggcaagactgcagaaccagaaactgatgacagcgtctacagctttgatacggacgtgttcgaaaactaaagggtatcgagtagtttcaa

SEQ ID NO: 2192 - protein, 259 aa, Corynebacterium glutamicum
MATSRRDAENIDQAGSEFIESDSGHTATPEEVVATALTFFAEDGFSETKLEKIAKASGMSKRMIHYHFGDKKGLYIKAVSYALRLLRPEAEAMQLDSAVPVDGVRKIVEALYTCITKHPEAVRLLLMENLHSQDSVDSTAAYSDESNVLLNLDKLLMLGQDAGAFRPGISAEDVLVLISSLAYFRVSNKVTLKNLYSLDLESEANIEGMKRIVVDTVLAFLTSNIQNSGNSSYLVVGGKTAEPETDDSVYSFDTDVFEN

SEQ ID NO: 2193 - DNA, 426 bp, Corynebacterium glutamicum
  CDS (101)..(403): RXA01357
acggcgcaagtcccgagcacagatatagttatgcaaatgtggccaaggcacaccaagaatggctacacgctgcagataatgacacgacggaaggtggagcatgagcgctgaagaactcgacaactacgaagcagaggttgaactctctctttaccgcgaataccgcgacgtagtcagccagttttcctatgttgtagaaactgaacgtcgcttctacttagcaaatgcagtgcagcttattccacacaacagcggaaacgatgtctactacgaagtccgcatgtctgacgcctgggtatgggacatgtaccgctcagcacgcttcgttcgctacgtccgagtgatcacctacaaggacgtcaacatcgaagaattagataagcctgacatcatcatgcctgagtagttcttaggtttaaaatcgct

SEQ ID NO: 2194 - protein, 101 aa, Corynebacterium glutamicum
MSAEELDNYEAEVELSLYREYRDVVSQFSYVVETERRFYLANAVQLIPHNSGNDVYYEVRMSDAWVWDMYRSARFVRYVRVITYKDVNIEELDKPDIIMPE

SEQ ID NO: 2195 - DNA, 1305 bp, Corynebacterium glutamicum
  CDS (101)..(1282): RXA01359
gttggaccttgtgcgatttggatggggaacagcagcccaatcttgaccatattgcgcgagccatggagcttcggggcactacatacagtgaggtagcagcatgattgactcccgcttgctggcatgggcgtatctctcaaaagtggtggagggtcccaatgcacacctgcaaaagctcctgaaagaaggtcatgatgtagagcggatcgcatttggtattaaacaccgcgaagagtggattggcgaaggtctgctgaaaaacaccgattcccggtactcgattgataccgcgcaaactgatctggaaactatcgccaaactcggtgggcggctcatcacacctgaagacgacgaatggccgatggaagaattagaccatgcttttggatttgccgcttctggcatgagtgatcatgtgcgtacctatcaagatgatgcgctgccaccgcatgcgttgtggattaggggaggaaatctcagaacactcagtgcacagtccgtcacactcgtgggcaccagggcaataagccaatatggcacggaagtaactcgggaattcacccaaaaccttgtgtctcatcagtggacaatcatctcaggtggtgccttgggagttgatagcgtcgcccatagtgaagccgtacgtgcacaaggctccaccatcgcgatcgcagcatgcggattggatcgctcgtaccccagccacaatcgagatctgttcaaccagattgccaaatccggaaagggggcgttggtgagtgaatatccaccgggaactccacctcaacgccaccgctttctcactcgcaatcgtctcgttgctgctctatctcaaggaactgtcgtggtggaggcagcctggaggtcaggcgcgctaaacactttgagctggtgtgctggtttaggcaggattgctatggcggtccctgggccggtaaatactgctggatcacttgggtgccacgaaaggattcgaaacggcagcgcacaaatggtcaccagtgcggatgacgttcggtcacttctgggtgcagtgggtgcaatggatagccaaactcagtatgaattaaacttcgcggccactccagtacagggtttaaccagaaatgagctgcgagtttttgatgcgttagacgaccgaggagaggggagggaagcggcgagtatcgctaccgaagccgggttgaccttgcagttaacaattttccttctcattgcattgaacaagcgcggaatcgtgaaacgcgacggaactgcttggtcgagaaatgcggaaatgccataaaacctgggggttatataaaa

SEQ ID NO: 2196 - protein, 394 aa, Corynebacterium glutamicum
MIDSRLLAWAYLSKVVEGPNAHLQKLLKEGHDVERIAFGIKHREEWIGEGLLKNTDSRYSIDTAQTDLETIAKLGGRLITPEDDEWPMEELDHAFGFAASGMSDHVRTYQDDALPPHALWIRGGNLRTLSAQSVTLVGTRAISQYGTEVTREFTQNLVSHQWTIISGGALGVDSVAHSEAVRAQGSTIAIAACGLDRSYPSHNRDLFNQIAKSGKGALVSEYPPGTPPQRHRFLTRNRLVAALSQGTVVVEAAWRSGALNTLSWCAGLGRIAMAVPGPVNTAGSLGCHERIRNGSAQMVTSADDVRSLLGAVGAMDSQTQYELNFAATPVQGLTRNELRVFDALDDRGEGREAASIATEAGLTLQLTIFLLIALNKRGIVKRDGTAWSRNAEMP

SEQ ID NO: 2197 - DNA, 513 bp, Corynebacterium glutamicum
  CDS (101)..(490): RXA01366
atgcatgaaaacaaattctatgtgtgttgagctgccaaaaggggttggcgcgccgatgatgactgtccaaacctaaaccaaaggtctaaactttggcttcgtgagtcagtttcgtcgttgttcccgccctggttgtggcaagcctgccgtcgcaaccctcacctacgcatattcggattccactgcggtggttggtcctttggcgcctgcagcagagccccatagttgggatctgtgtgagcatcatgccgagcgtattactgcgccccttggttgggagatgctgcgggtgaacgacatcaaagtcgatgacgatgaggatctgacggctcttgctcaggctgttcgtgaggctggacgcactgtgagtggtctggttcctgaagacgaagtgggcggcaaccatccggtgaaccggagtgcgcggatcgcggaacagaaggttcaccgcaggggtcatctctatgttgtgcctgatcaggacgaatcataaggtttgctattcggattgga

SEQ ID NO: 2198 - protein, 130 aa, Corynebacterium glutamicum
VSQFRRCSRPGCGKPAVATLTYAYSDSTAVVGPLAPAAEPHSWDLCEHHAERITAPLGWEMLRVNDIKVDDDEDLTALAQAVREAGRTVSGLVPEDEVGGNHPVNRSARIAEQKVHRRGHLYVVPDQDES

SEQ ID NO: 2199 - DNA, 525 bp, Corynebacterium glutamicum
  CDS (101)..(502): RXA01367
cgcgccaaccccttttggcagctcaacacacatagaatttgttttcatgcatacgagaactttccgcaatcggcacggacgcggtctccgcggcccactcatgcccgtcgaagttccccgccacgcctctagacgccaagccttcgaccgcgcagtcttagaggcctactcccctctttacgggatttaccaaaaagagctcagcaatctagacatcgctgtcgataccgttcctcgcatgcgactcagcgccgaccttgccattctccccgatgaaatcaccgccgacggccccgttccacttggtcgcgtcatcccaccggcgatcgataccaagggaaaccccacgagagcgcgcatcgttattttcagaatgccgatcgagcaacgagtcaccaacgctgtggaacgccacgagctattgactcatgttctcacctctttggtggcgaactatctgaatattgatccacgagacatcgatccgggattccaggatctctagcgtggccggtgcaccatggg

SEQ ID NO: 2200 - protein, 134 aa, Corynebacterium glutamicum
MPVEVPRHASRRQAFDRAVLEAYSPLYGIYQKELSNLDIAVDTVPRMRLSADLAILPDEITADGPVPLGRVIPPAIDTKGNPTRARIVIFRMPIEQRVTNAVERHELLTHVLTSLVANYLNIDPRDIDPGFQDL

SEQ ID NO: 2201 - DNA, 474 bp, Corynebacterium glutamicum
  CDS (101)..(451): RXA01370
ctgtctgaatcgtgtgggcgttagatgaattgttataaaccggatgtttaacggaatttaatacgtgtcttattacgcggactagaaaggttttagggacatgggtgcatgggacgatgcaatcttgactgaggaagtcaacgttgattttctcgacgagatctcagaattagatactcaagacattcttgaggcgttggaagacgcatgtttgctggtggttaaccaggacaacgccactgaagacgaacacctcaacggtcaggcggctgcgacgatcgcggccatcatgtttggcgctccatattctgcgggccaggtgctggagaattacccatttatccgcgaactcgtcggtgagggctctgaagctcttcgcggtgctgcagcgcaggttttggaagaggcagatgtggaatatgacctcgaagcttatttagaggccctcaactagccctccactaaacagcttca

SEQ ID NO: 2202 - protein, 117 aa, Corynebacterium glutamicum
MGAWDDAILTEEVNVDFLDEISELDTQDILEALEDACLLVVNQDNATEDEHLNGQAAATIAAIMFGAPYSAGQVLENYPFIRELVGEGSEALRGAAAQVLEEADVEYDLEAYLEALN

SEQ ID NO: 2203 - DNA, 614 bp, Corynebacterium glutamicum
  CDS (1)..(591): RXA01372
caggacaccttcgtccttcccaccttgcccacggccgcaggcttgtcgcctgcccgcatcgtggcgtcgataagcactcttttagatcttttagaagcagaccccagcattatttccgaccgcttggaacacctcgccgactgcattgatgaggaagtggaatcgctatcgccggaacgtgacgaactagtcaatcccggccgaaaactgcgcgcatacgtagatcacgcacggatcgtgcataccggccgaactgatgtgggactcgcgattgccaacgttatcgccccaatctggacccgacgaggcctggtatcagccgtgctggattttcccgagctcatggaatcattgccggaactccgcggacccgagccaattaccgacgatatattccatgacccattcatagatgacgaacccggggtggtaccgtttagggctgttgtctgggccgaagaggaacccggaatccccgatgccatggcgcaaagctgcgacggacctagcaaaggggcgctgacacaagcactgcgtttgctggtgcgcggacagtcagccacgacctattccattgaagaaaaggacttgtaaatggagctattggaaggctc

SEQ ID NO: 2204 - protein, 197 aa, Corynebacterium glutamicum
QDTFVLPTLPTAAGLSPARIVASISTLLDLLEADPSIISDRLEHLADCIDEEVESLSPERDELVNPGRKLRAYVDHARIVHTGRTDVGLAIANVIAPIWTRRGLVSAVLDFPELMESLPELRGPEPITDDIFHDPFIDDEPGVVPFRAVVWAEEEPGIPDAMAQSCDGPSKGALTQALRLLVRGQSATTYSIEEKDL

SEQ ID NO: 2205 - DNA, 1278 bp, Corynebacterium glutamicum
  CDS (1)..(1278): RXA01378
catgtgtggatttcaccaggtgcgagcaatccgatcaaggatcgcctcttcccttggacattggtgaaggcttttctctcctcccctgcagccttgggcgaaacagtgtccaatcgcctcaaaaaggcctctgcaccagaagaaaaacgcgccctagaaaccctttcacaacttaattctgcgatcaccccgcagacctcacagaagtaccaatctctactgagctacctcggtgacatcggagtgaagaagaactccgatacccgcgtggtgattttctctgagcgtgtcgctactttgcactggctgcaggaaaacctcatccgtgatctcaagatgccacccaactctattgctgttatgcacggcggtctccccgaccaggagcaaatgcgcctggtggatgagtttaaaaagacggattctcccatccgcatcatgatcaccggcgatgttgcctcagaaggtgtgaacctgcatactctctgccacaacttggtgcactatgacatcccgtggtcactgatccgcattcagcagcgcaatggccgtattgatcgttatggtcaaacccacaacccttccatcgttaccttcttgctcgatcccgccgaggattccaaagtaggtgaagtccatgtgctggagaggctcatggagcgcgaacatgaggcgcactctttgctcggtgatgccgcatctctcatgggcaagcactctgagcgtttggaagaagaaaccatccgcgaagtcctgcgcggtgcccaaaactttaatgatgcagtggctgatccagcggaagtcctagaaaacccagcaggcctagatgatattgattggttgctagcccaaatcgcccaagccgatgccaaggcagaaacagaagcagaagcagaaacagaaaaccaaacagcaccagatgcagcttccaatagcacgcagcatgcacaacgccggttgtatgcacaggaaagctctttcctctatgactgcctcctcgaaggtttcaataacgtaccggaggattccatcaaccgcggtggcgtggggttcaaaaaacacgataatgacatcgtggagctcacccccaccgatgatctgcgccgtcgtctagatttcctcccgcaggattatgtggctgctcggaaagttaaggaagatctcctactagcttccacactgatgcgtggccaagaacgcctcaacgctgcgcgcactggtgaagatggcagtacctggccaagtgcccactatctaggccccctgcacccagtcact

SEQ ID NO: 2206 - protein, 426 aa, Corynebacterium glutamicum
HVWISPGASNPIKDRLFPWTLVKAFLSSPAALGETVSNRLKKASAPEEKRALETLSQLNSAITPQTSQKYQSLLSYLGDIGVKKNSDTRVVIFSERVATLHWLQENLIRDLKMPPNSIAVMHGGLPDQEQMRLVDEFKKTDSPIRIMITGDVASEGVNLHTLCHNLVHYDIPWSLIRIQQRNGRIDRYGQTHNPSIVTFLLDPAEDSKVGEVHVLERLMEREHEAHSLLGDAASLMGKHSERLEEETIREVLRGAQNFNDAVADPAEVLENPAGLDDIDWLLAQIAQADAKAETEAEAETENQTAPDAASNSTQHAQRRLYAQESSFLYDCLLEGFNNVPEDSINRGGVGFKKHDNDIVELTPTDDLRRRLDFLPQDYVAARKVKEDLLLASTLMRGQERLNAARTGEDGSTWPSAHYLGPLHPVT

SEQ ID NO: 2207 - DNA, 2039 bp, Corynebacterium glutamicum
  CDS (1)..(2016): RXA01380
tcgctgattttgggatgcgacaccaaggctcgcctggaggatctgtacctgccgttcaaaaaacggcgcaagacgaaggccgatatcgctagggaggcgggcctggaggggctcgtcgataagcttatcgacgccccgtccctcgacgccgcagcgcaggcagctgcatttacgactgagggctttgaggattccaaaaaagttttggatggcgctcgcgccattttgattgaccgcttcgcgctcgatgccgatttggtgggcgaggtgcgtgagcaaatgtatcgcgcgggttccatggcggcatcggtggtggcgggcaaggagcaggaaggcgcaaagttcaaggactactttgagttttccgaaccttttgacaagcttccatctcaccgaattttggcgctgctgcgcggtgaaaacgaaggtgtgctgagcctcaacctcgatgcgggcgacgacataatctacgaaggtttgatcgccgaccgattctccctggacacccacacttctagctggctggctgaggctgtgcgctggggttggcgcaccaaactgtatgtgtcctccggattggatgtgcgcatgcgtctgaaagaaaaagcagaggaaggcgcactcgatgtgtttgccaccaacctccgcgacgttctccttgcagctcccgctggtcagcgctccacaattggccttgacccgggattccgcaacggtgtgaaagtagctgtcgtggattccaccggtaaggatgttgccaccacgatcgtctacccacaccagccccaaaaccgctggaaggaagccgtatccgaactggctaacctgtgcgcgacccacggtgtggaactcatggcgatcggcaacggaaccgcctcgagggaaacggaaaaactcgccggcgaagtagctgacatgatcaaagccgcaggtggcacgcgaccaacccccgtggtggtctccgaatcgggcgcatccgtgtactcggcatcaccgatcgcagccgaagaattccccgacatggacgtctccctccgcggtgcagtttctatcgcgaggcgactccaggatccactggcggagctcgtcaagattgagcccaaagccatcggagtcggccagtaccaacacgatgtcaaccaggttgcacttgccaaaacccttgatggtgtcgtcgaagacgcagtaaacgcagtcggagttaacctcaacaccgcatccgcaccacttcttacccgagttgccggagtgacctccaccttggcaaacaatatcgtggcctaccgcaacgaaaacggtggattctcctcccgaaaagaactgaacaaagttcctcgcctgggacccaaagcctttgaacagtgtgctggcttcctccgcatttctggatccaccgaccctctcgacgcctccgctgttcaccccgaggcgtacccagttgttcgcaacattgcgaaagccacaggattggatgtctcgggactgatcggaaactctgcggtgctcaccaaattgaagcccgctgatttcgctgatgaacgattcggcatccccaccgtcaccgacatcatcgccgagctggataaacccggacgtgacccccgcccagaattcaaaaccgccagcttcaaagaaggcgtggagaaaatctccgacctcacacccggcatgatcctggaaggaactgtcaccaacgttgcggcgttcggcgcattcgttgacgtgggagtgcaccgagatggcctcgttcacgtttccgcgatgagcgacaaattcatctccaacccccacgaagttgttcgctctggtgaggtcgtgaaggtaaaggtcatggaagttgacgtcgaccgcaaacgcatcggcctttccctccgcttgaccgatgaacccggtgccccagctccgcaaaagcgcggaaaccgaccagccaaacagcagcgagctccgcaaaaacagtccgctaagcccgccacaggttccatggcagatgctttacgacgcgccggcctcggtggctaaggcaactttcaaaccaagcg

SEQ ID NO: 2208 - protein, 672 aa, Corynebacterium glutamicum
SLILGCDTKARLEDLYLPFKKRRKTKADIAREAGLEGLVDKLIDAPSLDAAAQAAAFTTEGFEDSKKVLDGARAILIDRFALDADLVGEVREQMYRAGSMAASVVAGKEQEGAKFKDYFEFSEPFDKLPSHRILALLRGENEGVLSLNLDAGDDIIYEGLIADRFSLDTHTSSWLAEAVRWGWRTKLYVSSGLDVRMRLKEKAEEGALDVFATNLRDVLLAAPAGQRSTIGLDPGFRNGVKVAVVDSTGKDVATTIVYPHQPQNRWKEAVSELANLCATHGVELMAIGNGTASRETEKLAGEVADMIKAAGGTRPTPVVVSESGASVYSASPIAAEEFPDMDVSLRGAVSIARRLQDPLAELVKIEPKAIGVGQYQHDVNQVALAKTLDGVVEDAVNAVGVNLNTASAPLLTRVAGVTSTLANNIVAYRNENGGFSSRKELNKVPRLGPKAFEQCAGFLRISGSTDPLDASAVHPEAYPVVRNIAKATGLDVSGLIGNSAVLTKLKPADFADERFGIPTVTDIIAELDKPGRDPRPEFKTASFKEGVEKISDLTPGMILEGTVTNVAAFGAFVDVGVHRDGLVHVSAMSDKFISNPHEVVRSGEVVKVKVMEVDVDRKRIGLSLRLTDEPGAPAPQKRGNRPAKQQRAPQKQSAKPATGSMADALRRAGLGG

SEQ ID NO: 2209 - DNA, 1839 bp, Corynebacterium glutamicum
  CDS (101)..(1816): RXA01384
actgtccctcactctgcgagcagccattgcgctatcggcagctacctgcaaggtgcgctggtgggaagcgtcgacaagcatctttaagtagcgttgatgtatgcgctcacttcaatcggtccttgacctgctgacttctaagtccaaagtggctaccaaaattgtggtggaacgaattgaaaagcatcctgttcatggattgggatggatgatgtatccgccatttcatccatggactgatgcttcgaccttgacgattgagcgaaacggaaccagtcggcgcgcgagtcagaatggcgttgcggttcttcatcagcatgagcaagttcaaactatcggtctagccagctattttatcgactccaagatttgggtaaacgagctggctggccttgatcgtatcaacatttctgagagtgaagttgctggtcgtgacgtattagttctgccgttatctgatctgactttaagcatcgatgcgaaatacggcgtggttttggctgcggaagacagcgatgaatcagtgcgcgcggtatccgtggagttcctggaccagtgggtagatgaagaagaacccccagcggaagaagtgcctaaatatacggaaaccagggaggaacttcctccacttgagattcctccggctccttccggaaatcgtaatctccgagttctgtgcacgtggggagcgatggaaggaattattcctgagtggaaacccggcgatcaagtttcactgtttttgtctttcgacctcgacgatccgccgttcgaacagctcaaaaccactcgtcgcgggtacaccgaacctggcgagatttatggaaaccagcgcagctataaatttcacgctgatggttggaacgctgttatttccgccaaagtgccactgcgcaccgaagaaaacctcaccggctacttcacccacagctcctacgcggacacgagccgccgcacgtcagcggtcatcaccgcagtctaccgccacggtaaggacgcaattatcgacgtgaccctcgacggtgcgaaacctcctagatatcaagaatccttggattggagcagcaccagtacctgtgacggtgaaacaatctggctgtccgataagagcttgcccttcgtccgcggtttcaatgtctccacaggcaagctagtacacgagatctccatacccaccttcaatgagatcgccctcgaatccggcaatagagcccgcgcagcgaaaaaactttgggaacttccagatcttaaagaggcaaccgaccctgtcccagcgatccccgcgggctggaaactacacaaaagattcgggaaaaacttccatatcgtaagcgctgacaacggaacctggaaacaaaccatccttaggatcaaacccttcaaagcaattgagcttgatcttggatacgccaagatttcgacgatttaccaatacggtgaacgaatttatctgcgttccgatcttcaccagatcacgtttaatcaggatcttgaaatcctcagtgtagaggtccacggaaatcccgatgcaggttattggccactttccgatcttccaccaggggattctccaacgctgggatttcctatcggatcactcatgatgttccacgaacaacaagatatctacgctttccacgatcctaaaacaacaaagcaactaacaactgtgaacttgcccaaaaggcagtttgaagtggaatatgcttctcagaacagaattgttatttcgctgaaaaatccagaaagccgcctcattgacaaactgttggtgtgggaaccacaaaccaggtggcgggaacaaaacctggagagctgagcacggtttgattaacgtcg

SEQ ID NO: 2210 - protein, 572 aa, Corynebacterium glutamicum
MRSLQSVLDLLTSKSKVATKIVVERIEKHPVHGLGWMMYPPFHPWTDASTLTIERNGTSRRASQNGVAVLHQHEQVQTIGLASYFIDSKIWVNELAGLDRINISESEVAGRDVLVLPLSDLTLSIDAKYGVVLAAEDSDESVRAVSVEFLDQWVDEEEPPAEEVPKYTETREELPPLEIPPAPSGNRNLRVLCTWGAMEGIIPEWKPGDQVSLFLSFDLDDPPFEQLKTTRRGYTEPGEIYGNQRSYKFHADGWNAVISAKVPLRTEENLTGYFTHSSYADTSRRTSAVITAVYRHGKDAIIDVTLDGAKPPRYQESLDWSSTSTCDGETIWLSDKSLPFVRGFNVSTGKLVHEISIPTFNEIALESGNRARAAKKLWELPDLKEATDPVPAIPAGWKLHKRFGKNFHIVSADNGTWKQTILRIKPFKAIELDLGYAKISTIYQYGERIYLRSDLHQITFNQDLEILSVEVHGNPDAGYWPLSDLPPGDSPTLGFPIGSLMMFHEQQDIYAFHDPKTTKQLTTVNLPKRQFEVEYASQNRIVISLKNPESRLIDKLLVWEPQTRWREQNLES

SEQ ID NO: 2211 - DNA, 381 bp, Corynebacterium glutamicum
  CDS (101)..(358): RXA01396
tcaccaacccacttaacttcgagaccttcgattccctcgtcgttccagttggttcttctgcaaccgctgagatccaggctcagcttcaacctcccgcgttttgaaggctttcaacaccaacttcgcagccactttggctaccggaaaggttggcgatatcaccaccaccgttttagttgcaggcgatgatgaagacgcaaagaacgctcttatcaccgacgtcaacgctggcggcctcgacgcccttgacgctggttccctcaagcgtgcacacgagcttgaagcagttggtttcctgcagctcacccttgcaggttccgagaagattggatggaccggcggattcggcctggtcaagtaacacccagcctcaaaagcact

SEQ ID NO: 2212 - protein, 86 aa, Corynebacterium glutamicum
LKAFNTNFAATLATGKVGDITTTVLVAGDDEDAKNALITDVNAGGLDALDAGSLKRAHELEAVGFLQLTLAGSEKIGWTGGFGLVK

SEQ ID NO: 2213 - DNA, 543 bp, Corynebacterium glutamicum
  CDS (101)..(520): RXA01397
tgagctgctaaaagtctcgcattaaaggactgcttcccttcgggggagcatttctttttaactaattacttgacacgtcaagtaattagggtctagtgttgtgttcatgatcaaagaactgctcaacaagctcttcggaaacaagaaggcttccccggcaatgacacaatctgaaaccatttcacacaaggagaacaacacaatgaccacttacaccatcttcggccgcggcaacatgggcaccgcaatcgcaggcgtcctcaccaagggtggtgcaactgtagaacacatcggttctgcagattctgacatcgcaaccatcaacggtgacgttgttatccttgctgttccttacccagcagtagagtccatcattgcaagccacaaggatgctctcgcaggcaagaccgttatcgatatcaccaacccacttaacttcgagaccttcgattccctcgtcgttccagttggttcttctgcaaccgctgagatccaggctcagcttcaacctcccgcgttttgaaggctttcaacaccaacttc

SEQ ID NO: 2214 - protein, 140 aa, Corynebacterium glutamicum
VFMIKELLNKLFGNKKASPAMTQSETISHKENNTMTTYTIFGRGNMGTAIAGVLTKGGATVEHIGSADSDIATINGDVVILAVPYPAVESIIASHKDALAGKTVIDITNPLNFETFDSLVVPVGSSATAEIQAQLQPPAF

SEQ ID NO: 2215 - DNA, 384 bp, Corynebacterium glutamicum
  CDS (101)..(361): RXA01401
tgccaaacggaaggtttaattggtctacatgtgtcagtctcatggcactataatagacctagtatctatagattgatagaaaataatttaggaagtttccatgaactctcccctacaacacagcgccttccccgtccccggcgcgcaactctccacctcatacagcgacgaacacggccaagccgtcatccaacttcacggcctcacctcctcccgccaacgcgaccgcctcctcgacctcgacctcggccgtggcctttccggcacgcgccttttgcgttacgacgcccgcggccacggcacctccaccggccgcgctgcctccaccgattatcagtgggacaccctagcgggtgacctttaatgcttctcgacgcccacttc

SEQ ID NO: 2216 - protein, 87 aa, Corynebacterium glutamicum
MNSPLQHSAFPVPGAQLSTSYSDEHGQAVIQLHGLTSSRQRDRLLDLDLGRGLSGTRLLRYDARGHGTSTGRAASTDYQWDTLAGDL

SEQ ID NO: 2217 - DNA, 597 bp, Corynebacterium glutamicum
  CDS (101)..(574): RXA01402
cgctgcctccaccgattatcagtgggacaccctagcgggtgacctttaatgcttctcgacgcccacttccccacgaacaagtccacggcgtcggcccctcatgggttgcgccaccctcctcaaagccgcggtgttaaaccccgaccgcttcagtggattcacactcatgctcccacccaccgcctgggaatcccgaaaagcccaagcctccgaatacctatcccgagcagaattcctagaaacccacggcatggacgccttcctcaacgccgaaaaactccacgcccaaccaccagcaaccgtaggaacccccgacacagtccccgacatttccgccgaactcctcccctgggcttaccgaggcgccgcccaaagcgacctcccctcaaagaaagaaatcgccaaaataacagcccccaccactattctgagctggaccgacgatcccggacaccccgtatccacggcaatcgagctaacccgcctcatgccaaacgcccaactgcgcattgccactaccccagcggaagtcgcgcggtggccacaacaccttcgcgatgacctgcagttggactaaaaaccttcattatctggttt

SEQ ID NO: 2218 - protein, 158 aa, Corynebacterium glutamicum
MGCATLLKAAVLNPDRFSGFTLMLPPTAWESRKAQASEYLSRAEFLETHGMDAFLNAEKLHAQPPATVGTPDTVPDISAELLPWAYRGAAQSDLPSKKEIAKITAPTTILSWTDDPGHPVSTAIELTRLMPNAQLRIATTPAEVARWPQHLRDDLQLD

SEQ ID NO: 2219 - DNA, 579 bp, Corynebacterium glutamicum
  CDS (101)..(556): RXA01405
aattagacgtctgtctctagggatgccgcatcccgccggcgctcctagagtccgtttgtaaaacctagaattccgaatacgttccgaatagggtgggggtatgagtaagatagttgatctgcgctatgggacccggcgttcctcggagttgagcaaacgctctgctgaagtctttgccgaagctgaagaacatcccattactgtgacacgtcgtgatggtgaagcgttggtattgatgtcgcagcgcgaagctgacgggcgagcccgcctgctggagttggctgcacagttaattactgtggccactgatcatcagggcacgttagccgaacgtatggcgaaagtattcccgtggatgctggccctgtcagtggcggatcgtgaggcgtgtgcccgtgagattcttgacgctgcacgagcatcgtttgcaaccgaacaacctcacctcgctcttactgaactgacctcatggaaagaaacagcagcagctgttgctgctggattgagtaacactgatctgcagtggtacgacgatccgcatctggtggagcgtccctaagcgtggctggaaagaaaagc

SEQ ID NO: 2220 - protein, 152 aa, Corynebacterium glutamicum
MSKIVDLRYGTRRSSELSKRSAEVFAEAEEHPITVTRRDGEALVLMSQREADGRARLLELAAQLITVATDHQGTLAERMAKVFPWMLALSVADREACAREILDAARASFATEQPHLALTELTSWKETAAAVAAGLSNTDLQWYDDPHLVERP

SEQ ID NO: 2221 - DNA, 723 bp, Corynebacterium glutamicum
  CDS (101)..(700): RXA01413
tttgccctattggaagaagtaaattccacaccttcactttccaatacttcttttggtgagcgggtttcctcagcgtttaaccatctgaaaccatctgagattgacccatctgttcttagaactcgatgagcgtttagtactgggtgttcagcaagatggttaccaatggactgagcatttgttccggctgccactgcaacatctccgtaactcgcccaatgacctgcagggattgaagatacgatggtgtgaactttattccacaacggggaaagatcaaggggtagaacttctgcctcaagcaaccgtcgttaccccaaataacttcgaggcttccaccctctccggccttgagaagcttgagaccgtcgaggacctcaaggaggctgcccgcctcatttatgagcaaggcccccagtacgtagtcgtcaagggtggcatggacttccccggcgagaacgccgtggatgtgcttttcgacggatcctcctaccacgtcttctctgagccaaagattggtgaagagcgcgtttccggcgcagtctgcaccttcgcagctgttatcaccgcagagctagcaaagggtgctgaggttgtagacccagtggcaaccgcaaagcgtgtggtcacccgtgcggttcaagatgctgttgcatccaacgcaccttttacctccgtatggcttgctgaggacaacaagtagagttttaaaataccgatcaa

SEQ ID NO: 2222 - protein, 200 aa, Corynebacterium glutamicum
LTHLFLELDERLVLGVQQDGYQWTEHLFRLPLQHLRNSPNDLQGLKIRWCELYSTTGKDQGVELLPQATVVTPNNFEASTLSGLEKLETVEDLKEAARLIYEQGPQYVVVKGGMDFPGENAVDVLFDGSSYHVFSEPKIGEERVSGAVCTFAAVITAELAKGAEVVDPVATAKRVVTRAVQDAVASNAPFTSVWLAEDNK

SEQ ID NO: 2223 - DNA, 630 bp, Corynebacterium glutamicum
  CDS (101)..(607): RXA01414
tattgcctaagtagaccaataggtctatgcttcatagaacaactagttcataagtgattagttttaagaatttattacctctctacaggagaacccagcgatggccgtttttgatttccctaaccccgttaacgaatatgcagctcgctgcactgcgggtttggttgttttgctgagcgccgccacgctttttgcctctggtgaccttcgtattattttggcaagcatcttgaccttcggcttcgcattgcgcgtggccggcggaccccgttactccccctttggacgtctttcagtacacgtacttgtaccactgctgaagaaagcaccgatcctgacccctggcccaccaaagcgcttcgcgcagaccatcggcctgggctttagcggtacttcccttatccttatggcctttggatttaacgttgcagcttccgtagtcctagtcatgctcatcgcagcagccaccttagaatccgtctttggtatctgcctcggttgctggggattcggcaagctcatgcgctacggcgtcatcccagaagacgtttgcgagcagtgcttccagaaggaatcctcccgcaccggctggctcgttagcctgaagtagcacttcgaatctaagaccac

SEQ ID NO: 2224 - protein, 169 aa, Corynebacterium glutamicum
MAVFDFPNPVNEYAARCTAGLVVLLSAATLFASGDLRIILASILTFGFALRVAGGPRYSPFGRLSVHVLVPLLKKAPILTPGPPKRFAQTIGLGFSGTSLILMAFGFNVAASVVLVMLIAAATLESVFGICLGCWGFGKLMRYGVIPEDVCEQCFQKESSRTGWLVSLK

SEQ ID NO: 2225 - DNA, 720 bp, Corynebacterium glutamicum
  CDS (101)..(697): RXA01417
agcctccccaaggctggttagtcccactatcctctcagagagaagcaaaactgaaataacttcagcctcagctatccccgcaatttaaggaaaataggatatgactgacaagtttgacagagtccttgctgtagaggtgtgcattcaggagtggatcgacgagcaaaacctcacgctagaggtgccattaatgattgcacgtttgcagcttagagacgtcgcgaaggatatcactgctgttcacgaagaaaaattctacgacctcactgatatcgatactgatgcctttgtgaaaaacatcaaactgggatggaatgaacgcttgatcaagaaaagcctctttccacaaccggacgtgcataaacaacatttcacagaaactgaacatggcattgacgcgactgtgacggtctggtcgaagggcttcgatccggaaagtggccccgacttcttggtttcctatgtggatggtctttggtcagccgatattagaaaccgcatcacgaaatttcagaatagagaaatcgttagcaaattctattttactccagaacatattaaggaggatggagatttctccgcagagatttttattaaccgaccagaaaatgacgacgactcacaagatttggtcgaggtgtggactgatcaagacaccagatactgcggtgaaatgatcatctatttcaaatggctctaaattccacttttctgcatcag

SEQ ID NO: 2226 - protein, 199 aa, Corynebacterium glutamicum
MTDKFDRVLAVEVCIQEWIDEQNLTLEVPLMIARLQLRDVAKDITAVHEEKFYDLTDIDTDAFVKNIKLGWNERLIKKSLFPQPDVHKQHFTETEHGIDATVTVWSKGFDPESGPDFLVSYVDGLWSADIRNRITKFQNREIVSKFYFTPEHIKEDGDFSAEIFINRPENDDDSQDLVEVWTDQDTRYCGEMIIYFKWL

SEQ ID NO: 2227 - DNA, 510 bp, Corynebacterium glutamicum
  CDS (101)..(487): RXA01421
ttgatgcacgtgcagaaatcgtcggcggtccgtggcacccatctgttaagggagactcggttactgcagggatcctgcgagatcgagtaaacgcctaaagatgacgtcgaaaagcattagcggcaagcgcccgaatctgccgtcgctcactggagcgcggtggctcgcggcgctcgctgtttattttttgcatgcgttggtgtttttgtcggtgtatccgttccagcagtcggaactgtttgccacaatccataaatttgtccccatgcagctgggttcagctggtgtaaccttcttctttatcttgtccggatttttgatctattggtcaaatagccagctcaagggcatgaagaatgtgctgtattactgcaagcgccgcatcaccaagatttatcccatgcacttgattgcgttgccgatgtttattgaggcgtcggcgaagttcacgactacaggcattacctgggtgctgattttgcgcgagtaaagctgtggctgcggaatgcg

SEQ ID NO: 2228 - protein, 129 aa, Corynebacterium glutamicum
MTSKSISGKRPNLPSLTGARWLAALAVYFLHALVFLSVYPFQQSELFATIHKFVPMQLGSAGVTFFFILSGFLIYWSNSQLKGMKNVLYYCKRRITKIYPMHLIALPMFIEASAKFTTTGITWVLILRE

SEQ ID NO: 2229 - DNA, 1008 bp, Corynebacterium glutamicum
  CDS (101)..(985): RXA01425
agtccctattaatcccaaggagtttcgactcacagtgctcaatttcatttattggccaatttcggccattctgtggttctggcataaagcgttcagctttgtgctgagcccagattccggaattacctgggccttgtcgatcatgttcttgaccttcaccgtgcgtatggttctggtcaagccgatggtcaacaccatgcgttcacagcgcaagatgcaagacatggctccaaagatgcaggccatccgcgagaagtacaaaaatgaccagcagaagatgatggaggagacccgcaaacttcaaaaagaagtgggcgttaaccccatcgcaggctgtttgccaatgttggtgcagatcccagtgttcctgggtctgttccacgtgctgcgctccttcaaccgcaccggttctggcgttggccagctggaaatgaccgttgagcaaaacgcgaacaccccgaactacatcttcggtgtcgacgaggttcagtccttcctgcgtgcagacctgttcggtgcgccactgtcgtcctacatcaccatgcctgctgacgcgttcgacgcgttccttggcctggatgtctcccgcctcaacatcgcgctggttgcagctccaatgattttgatcattgtcgtggcaactcacatgaacgcgcgtctgtccgtcaaccgccaggaagctcgcaaggcagccggcaagcagcaggccgcttccagcgatcagatggccatgcagatgcaaatgatgaacaagatgatgctctggttcatgccagccaccattttgttcaccggcttcatctggaccatcggtcttcttgtctacatgatgtccaacaacgtgtggaccttcttccagcagcgctacatcttcgccaagatggacgctgaggaagcagctgaggaggaggaaaagcgcgcagcaaagcgcactaccgctccaaagcctggcgtgaagccagaaaaccccaagaagcgtaagaagtaaaacttcactaaaaaccgcca

SEQ ID NO: 2230 - protein, 295 aa, Corynebacterium glutamicum
VLSPDSGITWALSIMFLTFTVRMVLVKPMVNTMRSQRKMQDMAPKMQAIREKYKNDQQKMMEETRKLQKEVGVNPIAGCLPMLVQIPVFLGLFHVLRSFNRTGSGVGQLEMTVEQNANTPNYIFGVDEVQSFLRADLFGAPLSSYITMPADAFDAFLGLDVSRLNIALVAAPMILIIVVATHMNARLSVNRQEARKAAGKQQAASSDQMAMQMQMMNKMMLWFMPATILFTGFIWTIGLLVYMMSNNVWTFFQQRYIFAKMDAEEAAEEEEKRAAKRTTAPKPGVKPENPKKRKK

SEQ ID NO: 2231 - DNA, 741 bp, Corynebacterium glutamicum
  CDS (101)..(718): RXA01429
ggtaagaagaagggcaagctcgtggtggaattcggcgacaaggatgatttcgagcgcatcatgtccttgatccagggccaataattttaagtttggcgccatgctccaggcttcccttttcccgatcgtgcaggaacacatagatttcctgcacccccaggcccgcaagtcggtgttttgggagctcgcacctgaggttgcagctaaagctgatccggtgtttgagaaggaagcctggctgtccaccacgctgctggaatatgaatcctgcggtttcaacattggttaccgcaatggaactccggcgttggcgtcggtcattttctgcgagcgcgatgccgccccgggcgcgaaggcgctgcctacggcaccggtgtctagcgacgctgcgatcatcagcagcctgttcatcgacgaggttttccggggcacgggcatggaatcggcgcttctcgacgcttccctcatggaactcattcggcgcgactacccagccgttgaggcgtttggataccgctcggaaaacacagaagcggatgcgatcgcagctaggcgtttagaaatcggcctgattgatgtggaggcgttagaatcagccggtttcgaagtggttgctgaccatcccgtgttaccccgtctgcggatggaattaccacccgcaacggtgctgctcacagctaaggatgcccagcgactccttcaagagatgggcgcgatttagccagcctgctctgattgcaa

SEQ ID NO: 2232 - protein, 206 aa, Corynebacterium glutamicum
MLQASLFPIVQEHIDFLHPQARKSVFWELAPEVAAKADPVFEKEAWLSTTLLEYESCGFNIGYRNGTPALASVIFCERDAAPGAKALPTAPVSSDAAIISSLFIDEVFRGTGMESALLDASLMELIRRDYPAVEAFGYRSENTEADAIAARRLEIGLIDVEALESAGFEVVADHPVLPRLRMELPPATVLLTAKDAQRLLQEMGAI

SEQ ID NO: 2233 - DNA, 669 bp, Corynebacterium glutamicum
  CDS (101)..(646): RXA01439
gttaatccacagcgccctgtgtgcactctattagtgaatatccggtgaatgctcgtccctcgactgtctacttagtaggtttgcaggctagtcttttgtcatgacccgatactttgcagtttccaatcttcaggagcttggctccctcgaagtacacaaattgtacaaacttcgtgtagatattttcgtccacgagcagcagactccgtacgcggagatcgatgacaccgatgctgccccaaccaccaatcacatcctggtttgggagcgcgccgacgccaccccaaccaacctcatcggctgcgcacgcctcgcgcccatcaccgccgccgagcttaaggcgtacaccggcaagggcatttcgcttgacgacgccaccccgctctcacaactcggccgcgtagcggtggcacaggaagggcggggctcggggctctcaggtgagctcatgcgcaacgcgctgcgtcttgcatatgagcagtaccccgaccgcgatgttgtcctgaccgcgcagaagcctttggtagatttctacgcagaatacggctttgaggtcttgggtgaggaataccttgactcgggtgttcctcaccttccgatgttgctcaaggctgatgagcttgaaaggttctcagacctagacgcctaatccgtagtcactggaactca

SEQ ID NO: 2234 - protein, 182 aa, Corynebacterium glutamicum
MTRYFAVSNLQELGSLEVHKLYKLRVDIFVHEQQTPYAEIDDTDAAPTTNHILVWERADATPTNLIGCARLAPITAAELKAYTGKGISLDDATPLSQLGRVAVAQEGRGSGLSGELMRNALRLAYEQYPDRDVVLTAQKPLVDFYAEYGFEVLGEEYLDSGVPHLPMLLKADELERFSDLDA

SEQ ID NO: 2235 - DNA, 1131 bp, Corynebacterium glutamicum
  CDS (101)..(1108): RXA01440
ttgatggaaccaccctcacgctgaccacgcctcaggggaatcagtattgggcaaacacacacgattttggagccggcacacactaattttaggagcactgatgaaaaccaagtggttagcgatcattccattcgtggcgcttgcggtggttgcatgctctgatacgcagccgccggttacagaaacagtgacagaaaccgccccgcaacctacttctgaaacggcagcgcagccaccacaacccacgacacctgcggaaacgaccacgcagcaggcagaaggtatcaacttgacgcctcgctacactcgccaaaatgtggggcacttttccagtggttatcagcctggacaggtgagtttttcctcagctgatggaaccattaaatgtgagtttcgccccatggaacaggacgcacctatcaaccgggagccctccaccgattggcggttgagtttcgtgcagggtgcgtgccaattcgacgatggttacgtagtggcggatacaaatgtggaaaacagaccaggttttgctgagtacaccacggcgatttctcatgtcatgccggaaaattacaccacgttgccgccgggaacctacatcgatttacacaccatggcttgtttcaccgagtctgccgatgaaatttcctgcattaagtacgcgaccaatgaaacattccgcatcagcgcgcagggttttgagatgctctcaaatgcccagcgcgacgcggaactaaccacacaaggtggcttgtaccaggcattttccaacatcgcggaattacggttcagtgacggcaacgccatgtcatgtttctttgacgcgccgggatcgcaagatttctggtgccaaacactcagcacccccggctgggacgacggcagcaacctcattcatttgacggtcaccggcggaaaactcagcctgatgggcacccaagtgggcaaccccggcctcgactatttccgcggccgccagctcattgaggcgccaaattcgcttctcgacgcctccctctccgtaacactcgacggcgatcgggtgcgtttccgcaccgcgaccggcgaggagatgtgggtgagttccagtgactacggattaggcgtctaggtctgagaacctttcaagct

SEQ ID NO: 2236 - protein, 336 aa, Corynebacterium glutamicum
MKTKWLAIIPFVALAVVACSDTQPPVTETVTETAPQPTSETAAQPPQPTTPAETTTQQAEGINLTPRYTRQNVGHFSSGYQPGQVSFSSADGTIKCEFRPMEQDAPINREPSTDWRLSFVQGACQFDDGYVVADTNVENRPGFAEYTTAISHVMPENYTTLPPGTYIDLHTMACFTESADEISCIKYATNETFRISAQGFEMLSNAQRDAELTTQGGLYQAFSNIAELRFSDGNAMSCFFDAPGSQDFWCQTLSTPGWDDGSNLIHLTVTGGKLSLMGTQVGNPGLDYFRGRQLIEAPNSLLDASLSVTLDGDRVRFRTATGEEMWVSSSDYGLGV

SEQ ID NO: 2237 - DNA, 1152 bp, Corynebacterium glutamicum
  CDS (101)..(1129): RXA01441
ttataacaattagccgtgagggtattaatcaaggtttcgggagactaacgttttagaaacaagtggactccagcacacctcgtgagatggcaggttcatcatggctagaacgacaacagcgcacgcagttctcatggcgcttagttcagtcgggcttttgatgctccaggcctgctccgaacaggaacaaaccccagaacaaacgccagcgcccaccctgacttcgcaggctcccgagactcctcaagcctcaacaacctcctcagcaagctccacagcaactcccatagcaactcccatagcagccaccgagttggattatctccacatcgatccagcaacgtatgacatcggtgtccaagaccaagaaactgccgtatttaccactggcgatgggatcacagcgcagtgtttcttcgaggcaacaccgggggagaccagctatcagatcaaggagtttgatttcgacgaaactgcgggaacgtgcgcttttggtgatcaacacatcagcgtcaccacggatgaaaatgtccgggaacgctttgccgaattgagtgaaaccgaagaagaattaccagaagcgcaagcgactctcgatgttggtgagatggtgcatcttggtcacatgggttgttgggcgccgagtgtatcggagtttagttgtctcgatttcgcctccaaccaggcgttcaccatgaatgaacagggcttccatgagcttgatcctgcaaaagccactgagcagctaattaattcgagtggccaggttcaaacgttatcgaaaatgacgaatttccagttcaccgatggcaccagcatcacctgtgtcagtgagttgcaggcggaagagttcttgtgccacaacagtggtcctggaggctggtcaacttcagctggccctgccaacaccctgtggtggaatctgaaccaggccgactccgagtttgagggtgctcgccccacgaatccaacgcaaagcgtttataaatctcaacaaatattcggtccgggatcgtatctcctcgcgaacggtgtgagtgcagaatttgatggaaccaccctcacgctgaccacgcctcaggggaatcagtattgggcaaacacacacgattttggagccggcacacactaattttaggagcactgatgaaa

SEQ ID NO: 2238 - protein, 343 aa, Corynebacterium glutamicum
MARTTTAHAVLMALSSVGLLMLQACSEQEQTPEQTPAPTLTSQAPETPQASTTSSASSTATPIATPIAATELDYLHIDPATYDIGVQDQETAVFTTGDGITAQCFFEATPGETSYQIKEFDFDETAGTCAFGDQHISVTTDENVRERFAELSETEEELPEAQATLDVGEMVHLGHMGCWAPSVSEFSCLDFASNQAFTMNEQGFHELDPAKATEQLINSSGQVQTLSKMTNFQFTDGTSITCVSELQAEEFLCHNSGPGGWSTSAGPANTLWWNLNQADSEFEGARPTNPTQSVYKSQQIFGPGSYLLANGVSAEFDGTTLTLTTPQGNQYWANTHDFGAGTH

SEQ ID NO: 2239 - DNA, 1116 bp, Corynebacterium glutamicum
  CDS (101)..(1093): RXA01445
gagtctcgaatgtataacgagtttgttcctaataactttatcattaactatgcctgcaataggcttgggaaattttggcatccaggtaatcgcgctgtcaatgatcccacttattaatgtacgttttcccgttgccgccttacctctcgcattagtggcgactgtatggcttaatgcttgggcagaccatcttctcctaactggttttattgtttatcttgctgtggaatacgcaacaagccgtgggcgcttcgctctcgcattgattttgggagttgaatggatcttaattgcttatggggtagctttggaaaggcctcttgaggctaaagactctccatctctcattaccgaaattttgctcatacttgtagcagctggcacaggggcaggtcggtggaaaattttgagtgaacgcaagcaacgtgcaattactcagcaggaaatcatcaaaaaaatccgtactgatatagcgcactatttgcatgacagtatggcaagatcgttggcaataatgatagttcaatcaaagctgactgaactagagcctgatccaaaaaagattcaagaaaaactaaacagtattgccaaaattggacaagaggcagtggctgatttgcatcaattagttagacacctcgtggtcgaggagtctgctgaaaaagccacagcgtttggagcatgggctgcagtttctattcatgacacggttaattctgccattcagttattagtagatgcaggacatgtcgtttcctttgacagtagaaaaaagaactataagctggaccatattgctgaaacggcgtttgctttagccttcaatgaggcagtctgtaatgcaattaaacattctccgcccaaggcaaacgttactattcgcataacagaaaaagcacagtctcttcagattctagtaatgaatcctattggagattggcatgcaaatggggagtccgcaattccaggtgtgggcattggcgtagaaagcttaaccagaaggatacgtaatattaaaggacaggtctgtgtgacttcactgcaaggatactggaaagtagttatttcactacctttgaaatgtgaggattcttaaattgtctctatttgttgaac

SEQ ID NO: 2240 - protein, 331 aa, Corynebacterium glutamicum
MIPLINVRFPVAALPLALVATVWLNAWADHLLLTGFIVYLAVEYATSRGRFALALILGVEWILIAYGVALERPLEAKDSPSLITEILLILVAAGTGAGRWKILSERKQRAITQQEIIKKIRTDIAHYLHDSMARSLAIMIVQSKLTELEPDPKKIQEKLNSIAKIGQEAVADLHQLVRHLVVEESAEKATAFGAWAAVSIHDTVNSAIQLLVDAGHVVSFDSRKKNYKLDHIAETAFALAFNEAVCNAIKHSPPKANVTIRITEKAQSLQILVMNPIGDWHANGESAIPGVGIGVESLTRRIRNIKGQVCVTSLQGYWKVVISLPLKCEDS

SEQ ID NO: 2241 - DNA, 972 bp, Corynebacterium glutamicum
  CDS (101)..(949): RXA01447
tccatgaagttggagtatgcacgcgtgtgcgcacacagacgttatttcatcttactatcccatgtgaggtttttaatcatcgcgatactaagcttgcggtatgcgtcttctggttttgcggtgcgatgccccacacatcaacgaattccctgccctttccacctctgtggagatccacgatttgcctgcggtgcccacccgaaaagacctcaaaattcttgatgatgtggcctttgatgtgctccctcaggatcccacgccttctctcgatgagatcgccaagcagcctgatgtcgagcatttgagcagccctaagtttgcgccacaacagcctgaaacccgtttgcgcatcgtggtgatcggttcggatgcagcgctgtctgcggtcctgactcgtctcatgcgcgccgataatttgtgggcggagattggattcgtgcccgttggtccttcaacggctgcgaagaactggggtctgcccgccgatgaggctgccgcgcttgagctcgcactgaccggattggtcaatcctgccccgctcatccgcgatgacgttgcggtcgccgtcgccggttcagccaccatcaccaactgggagccgggtgagatcaccggcgaagtcatcgtcgatgatcatgttctcatccgccacgaggctgcctcgaaggccccacgccgtggcgtctacggtgcccgcttggtgccgatgcttgacgccccaggcatcgctgcggtcatcatggacactcccctgcccggcgaggtgccctcccgcagcctgttccctcgcccctcgggctcggttattccagagagcttttcgacgggccgtgccatgcaagccggcggcccctcgctacaaatccgggttgacggaatttcccgcaaacgtaaagtggagcgcgttaccttctatcgacatttgcgcgatctccaaatcgtgcggccgtaaaacaaggagccagcatggca

SEQ ID NO: 2242 - protein, 283 aa, Corynebacterium glutamicum
MRLLVLRCDAPHINEFPALSTSVEIHDLPAVPTRKDLKILDDVAFDVLPQDPTPSLDEIAKQPDVEHLSSPKFAPQQPETRLRIVVIGSDAALSAVLTRLMRADNLWAEIGFVPVGPSTAAKNWGLPADEAAALELALTGLVNPAPLIRDDVAVAVAGSATITNWEPGEITGEVIVDDHVLIRHEAASKAPRRGVYGARLVPMLDAPGIAAVIMDTPLPGEVPSRSLFPRPSGSVIPESFSTGRAMQAGGPSLQIRVDGISRKRKVERVTFYRHLRDLQIVRP

SEQ ID NO: 2243 - DNA, 402 bp, Corynebacterium glutamicum
  CDS (101)..(379): RXA01452
ccgccaagaaggtaaggactacgtgatggtcgatggcgacgttgtggagttccggtttaacgtctagcgttattgacgctcctcgttatacgctggtctcgtgatcagatcgttcgccgaccgcgacaccgagttggtctggttgcgtgaaggtgcgaaacgcgtcgatccgcgaatacacaaagtggcgaatcggaagctgcatctgctggacgcggcgacgaccctcgatgctctgcgtgtgactccggggaatcgcctggaaacgctcgagggtgatcgagtcggtcagtacagcattcgagtcaacgaccagtggcggatctgcttccgttggaacgactcgggccccgaaaacgtcgagatcgtggattatcactgaggaggagacgatggctcaga

SEQ ID NO: 2244 - protein, 93 aa, Corynebacterium glutamicum
VIRSFADRDTELVWLREGAKRVDPRIHKVANRKLHLLDAATTLDALRVTPGNRLETLEGDRVGQYSIRVNDQWRICFRWNDSGPENVEIVDYH

SEQ ID NO: 2245 - DNA, 645 bp, Corynebacterium glutamicum
  CDS (101)..(622): RXA01456
aagacaatatccttatatgtacgtgattatgcgtttctcccccactctacggtttaatcacctataaaggccaacaagtagttcacaaaaggaaaaaattatgaacgattccatttttagtccccaagcactgaataaagcgatgctcgaagccgtcgagtttatccacgccgaaggttgggacgccggccctaccctgttcgcattggtccccactgaaatgctggtggatactcttgatgaggcagctgacgactccccactaacccttgttgtacaggacaacctccctgacaacttgctgccaggttccgaagcgttaggtgactatgtgtcccgtttggcgtggccagcagagattgccggcgcggtgttggctcaggaaattatgttcaccgatgctgccgttgcaggctcagaaccacgacccgctcgtcttttttccggcgttttgcgcggcgaagcagaactcacccttctgcagcttcgccccaccgaagaggaattggcagaacgcggaccgtttgctgaagatgaaatcgaactgcgcggcggcccaggggttgcaccgggtgtaatcgcagcactgcgctacaccctcgaagcggacccagacgaaatctaaaaactgacttttcgtccagg

SEQ ID NO: 2246 - protein, 174 aa, Corynebacterium glutamicum
MNDSIFSPQALNKAMLEAVEFIHAEGWDAGPTLFALVPTEMLVDTLDEAADDSPLTLVVQDNLPDNLLPGSEALGDYVSRLAWPAEIAGAVLAQEIMFTDAAVAGSEPRPARLFSGVLRGEAELTLLQLRPTEEELAERGPFAEDEIELRGGPGVAPGVIAALRYTLEADPDEI

SEQ ID NO: 2247 - DNA, 798 bp, Corynebacterium glutamicum
  CDS (101)..(775): RXA01457
gaagcggacccagacgaaatctaaaaactgacttttcgtccaggttcgctaggataaattaagttaaccccgcccacaatttatttgaggagttcacactgtggcgtccaccccgcacaagcatgtccgcgttgcactgggattagtggcgctcattcctcttttagctgcatgtacgggcggcggatccaccgaaacttccactgaatccacggcagaaacaactcctgcgacaacaacggaagcaacgacaactcctgctaccactgcttcgtcttcagtaattgaaacgacagagtcaagcactgccgaaacgtcgacgaaagagagtggggagacgtcgacaagcaaacctcgtatgaccaaggacgttgaagtcgcctataaagctttctcctcgctcgcgcccgtcgagctttttgagcaattcgaaacctgcgacccgtcaggggtcgaggattccttcgcgtgcaacgggccggaagttggccaattccaattctttgacaatgcgtcgaaggccacgagcacgacgcagctgctcacggaactgcgcagctcacgcgtggttgaggattccggatccaaggttgtgggctggaccacgattggcacgatgtcgattatcacggtcgttgataatgaccaaggcctagtgctgcagcaaatggtgtcctccgacaaaatcgatccggaggaacgcatctacgaacttgggctgtcgacaccgaaggacactgaagagtcctcggaagaaacctcagcgtctaaaaactagccacacgtctggaaatcaga

SEQ ID NO: 2248 - protein, 225 aa, Corynebacterium glutamicum
VASTPHKHVRVALGLVALIPLLAACTGGGSTETSTESTAETTPATTTEATTTPATTASSSVIETTESSTAETSTKESGETSTSKPRMTKDVEVAYKAFSSLAPVELFEQFETCDPSGVEDSFACNGPEVGQFQFFDNASKATSTTQLLTELRSSRVVEDSGSKVVGWTTIGTMSIITVVDNDQGLVLQQMVSSDKIDPEERIYELGLSTPKDTEESSEETSASKN

SEQ ID NO: 2249 - DNA, 1287 bp, Corynebacterium glutamicum
  CDS (101)..(1264): RXA01463
attagaacaaatattcgttagaacacttgtttgttttgatttgtgtggttagggtgggtgctaatgagttaaaaaggggaaatttaaaccattagggggcatggaaatgtcatacttcagccatcaggacccaaataatccagagagtcacatcaacttcaccatggcgcaaatggagatccagcgctggactttgctgatctcaaacccagaggcggacgctagcactcttgtcatggagttgaaaaccgtcacgggggaatccaagcattttatcaaccaggctattaacgccatgtgggctttaatgaagctgcccattttaagagtggtggtagaaactcacttccacgttcggattccgtacctggcccgcattatgcaggcagtcaagcaggctaaaccggagttgtgggatgagttggaccatcgcattgccgaaaagctgacaccgcgcattgctggccaggcactgatggaagcctccgcacttgcagggctgattactcgctggatcaaggaactggatccaaccttcacaggaaagaagcgtgggccaaaggggagtgatggcaccttgactttccgccacgtggacgggcgtacgtacatcagtggaaatattgacggtgtcaccggcaagctgttccaaaaagctctggaaaaagtgaaacagaagggcgaggacctcgcgcgggccctggtcaccttcctggcggggcggaccaaagtgaaaatcgtcagcgcggtatacacgcccctggtgggtggcgtgtcctggattccgggggtgggattcctgagtcaagaggagtcccggaagctgggtaagactgcctcgaaggtcattgacctggatacgatcgccactcgtgtggaaaatggctacaccccaagtcccgagctacgcctttatgtgatggggcgggacggcacctgtaggcatccgggctgcacggtgtctgccgacaactgccagatcgatcacgtgatcccgttcggtgagggtgggttgactgtggcctggaacttgcagtgcctctgcgcgcatcatcacaatatgaagactgatgggcgcatccaggcggcgattgattccatgggtcgggtcgcctggattgggccgtgcaatcgcacagtggtaaccgaacctgtcggaccgttggcgcaagagatgcccacggggcagtgggggcagactctggaagcacggatggagaagacttttgaaaagctccgcagttcactcgaggtattggatgactaaacccttatgcacacccctag

SEQ ID NO: 2250 - protein, 388 aa, Corynebacterium glutamicum
MEMSYFSHQDPNNPESHINFTMAQMEIQRWTLLISNPEADASTLVMELKTVTGESKHFINQAINAMWALMKLPILRVVVETHFHVRIPYLARIMQAVKQAKPELWDELDHRIAEKLTPRIAGQALMEASALAGLITRWIKELDPTFTGKKRGPKGSDGTLTFRHVDGRTYISGNIDGVTGKLFQKALEKVKQKGEDLARALVTFLAGRTKVKIVSAVYTPLVGGVSWIPGVGFLSQEESRKLGKTASKVIDLDTIATRVENGYTPSPELRLYVMGRDGTCRHPGCTVSADNCQIDHVIPFGEGGLTVAWNLQCLCAHHHNMKTDGRIQAAIDSMGRVAWIGPCNRTVVTEPVGPLAQEMPTGQWGQTLEARMEKTFEKLRSSLEVLDD

SEQ ID NO: 2251 - DNA, 1155 bp, Corynebacterium glutamicum
  CDS (101)..(1132): RXA01469
tccatcgccgatcttgccgattgctgggacgatcctttcggtgacggtgcatttcacgtaccagatgagcagcagttcactgactagtattctgtaggtcatggcatttgcagacattgtgcgcagcgtcgaaaaccgcaccaacgcagcgaccctcaactggtccatcaaaaatggctggaagcccgaagtcaccggattttccgggtacggctccgggcgtcgagtgcgcgtccttgcgcgcgtgctcatgtccaaccccgaaaatttgcttgtcgacgccccctcccaatcaattacccaacaagcacagcgcggttggcgccagttcttcaccatccaagtgcccaacctgccagtaactgtcaccgttggtgggaaaacagttacctcatccaccaacgacaacggctacgttgacctcctggtggaagaccacaaccttgaccccggctggcacaccatccagatccaagccgaaggttccacccccgccgaagcccgcgtcctcatcgtggaaaacaccgcccgaatcggactcatctccgacatcgacgacaccatcatggtcacctggcttccccgagcactcctcgccgcatggaactcgtgggttttgcacaccaacacccgcaaaccagtccccggaatgaaccgcttctacgaagaactcctcaaagaccaccccgacgcacccgtgttctacctctccaccggcgcatggaacacctttgaaaccctccaagagttcatcaacaaacacgcactccccgacggccccatgctgctcaccgactggggaccaacccccacaggactattccgctcaggtcaagagcacaagaaagtccaactgcgcaacctgtttatcgaataccccgacatgaaatggatcctcgtcggcgacgatggccaacacgatcccctcatctacggcgaagcagtcgaagaacaccccaaccgcatcgcaggcgttgcaatccgtgagctctcccccggcgaacatgtgctctcccacggaacaactgcgtcactgtccaccatcacgaccaacgggggccaaggagtcccagtagttcacggccgcgatggatatgagttgctgcagcgctacgagacgaagccgttcgcctgagtcctactgggtgtctcatg

SEQ ID NO: 2252 - protein, 344 aa, Corynebacterium glutamicum
MAFADIVRSVENRTNAATLNWSIKNGWKPEVTGFSGYGSGRRVRVLARVLMSNPENLLVDAPSQSITQQAQRGWRQFFTIQVPNLPVTVTVGGKTVTSSTNDNGYVDLLVEDHNLDPGWHTIQIQAEGSTPAEARVLIVENTARIGLISDIDDTIMVTWLPRALLAAWNSWVLHTNTRKPVPGMNRFYEELLKDHPDAPVFYLSTGAWNTFETLQEFINKHALPDGPMLLTDWGPTPTGLFRSGQEHKKVQLRNLFIEYPDMKWILVGDDGQHDPLIYGEAVEEHPNRIAGVAIRELSPGEHVLSHGTTASLSTITTNGGQGVPVVHGRDGYELLQRYETKPFA

SEQ ID NO: 2253 - DNA, 549 bp, Corynebacterium glutamicum
  CDS (101)..(526): RXA01470
aagacgaacctcgtcttacttcctttagtaactgcacatatctacttgtatatgtgtgcgggaattgaaggcagttaagtgttgccgaaggaaaccgaacatgacgaacaatgcattaaccgtgccaacccggacccgtcatcaggcggatttgctcacggcagacttctgggaagacatggggttgccccaactgaaaactaccatcgaagaatccatcgacgatgtagccctcccaatgcataccgctgttctagaaatcagcggaatgccaaaggaactgcgtcagaccgtggaatccgcaatggttgtgtgtattccgagtccttcggagctgtccggctccaacagggacccgctcaccgcacgatggttcactgcatggcgccgtgacccattcgaacttggcctcactgagtgtcgagaggtgatcaccggaactccacgcgaactcgacaaacttcgaggagtgctggaatctctggctgatgaataccgttttgaagttgagctgcgaatcgttgactagaaagccagtgattctttagc

SEQ ID NO: 2254 - protein, 142 aa, Corynebacterium glutamicum
MTNNALTVPTRTRHQADLLTADFWEDMGLPQLKTTIEESIDDVALPMHTAVLEISGMPKELRQTVESAMVVCIPSPSELSGSNRDPLTARWFTAWRRDPFELGLTECREVITGTPRELDKLRGVLESLADEYRFEVELRIVD

SEQ ID NO: 2255 - DNA, 579 bp, Corynebacterium glutamicum
  CDS (101)..(556): RXA01472
gcacgtccacgcgccggacttgcgcgcctatttacaagcacgcttatcgacgtaattacactcggtggaaaccgtcgcggaaaaatggaggatcctcgccatgaaccaagcaaacctgcctgccgaaatcgcggacctctccgatgaaaccgcactgtgggaaatcatcaacgaatacaactgggacgacggcttcgcggttccccttgcagtagtccgacaccccaaatgcgaccgagcgctagcccttcgcctgttttgggacatcgatgaaaccgcccaaatccaccactccgacgaagaatcagcgatcgccgagttgtacgccagcaccgcagaaaacgacccagcagaattcgacagaatcatggactactgcaccacactggtcgaagggctccgcaagcagacctatcctcggggcgccaaccgtttcgacacgggatttttcaacctcgaggacccttctttgaccgaccgtcagcgcaaaatccgcgccgggaaaaccaaatttgcgctcaagaatttcgaggaagctttcctccaaccagagctataaaaaaggttgtagaagaaatt

SEQ ID NO: 2256 - protein, 152 aa, Corynebacterium glutamicum
MNQANLPAEIADLSDETALWEIINEYNWDDGFAVPLAVVRHPKCDRALALRLFWDIDETAQIHHSDEESAIAELYASTAENDPAEFDRIMDYCTTLVEGLRKQTYPRGANRFDTGFFNLEDPSLTDRQRKIRAGKTKFALKNFEEAFLQPEL

SEQ ID NO: 2257 - DNA, 888 bp, Corynebacterium glutamicum
  CDS (101)..(865): RXA01473
cgtaagcaattcccaccaatgcagtttcctcggtgcgttatagtgtcgagtagggccaaaaaccaacaatatcctggtagccaagaataagatcgtgcttatgactgacatcggtgatgtcgatcaaatagtctgggaattcatccatttccacgatgactcgataaatccattctttgagttcatcaagagtgattgcatcaacgatgaggcaatcgaacgcaaaacccagatcctcggaatcatcttgggtaacgagccatgcgggagtgttattcacgcccgccagaatacaataaagcccatgagccatacggtctcttttggcgacggctggatccaagtccttgaggatgctgcagaaaccgtgtcgatcaccgacacgttggatgccctccgattttctcccgagcaagcggaatgggctgcagaattcggaccactactgtgcggcccagcgaaccaaccgccggcgtatctcacggctttagacgggcacacaaagctaccgcttagcccgcagctgacggagttctatagctacgcccgatcctggacaaacagtgaggccttgggaaacgtcattgatcccgatgactacctcgatcatctcaccgaccctcgccttcatttgcaggatcttctggataatgagtttgaacgggtgggggtgctcgtcgataagcaaaatcgcccgctcgaccctgcccggtgcgcgctgttctcgctcgacgcacttgcacgcgcgccctacaaccgcgcctacttcgtcttcgccgcgcccgagcctgagatctgggcgtttgagaacgagcacgtccacgcgccggacttgcgcgcctatttacaagcacgcttatcgacgtaattacactcggtggaaaccgt

SEQ ID NO: 2258 - protein, 255 aa, Corynebacterium glutamicum
MTDIGDVDQIVWEFIHFHDDSINPFFEFIKSDCINDEAIERKTQILGIILGNEPCGSVIHARQNTIKPMSHTVSFGDGWIQVLEDAAETVSITDTLDALRFSPEQAEWAAEFGPLLCGPANQPPAYLTALDGHTKLPLSPQLTEFYSYARSWTNSEALGNVIDPDDYLDHLTDPRLHLQDLLDNEFERVGVLVDKQNRPLDPARCALFSLDALARAPYNRAYFVFAAPEPEIWAFENEHVHAPDLRAYLQARLST

SEQ ID NO: 2259 - DNA, 669 bp, Corynebacterium glutamicum
  CDS (101)..(646): RXA01474
catcaccgatgtcagtcataagcacgatcttattcttggctaccaggatattgttggtttttggccctactcgacactataacgcaccgaggaaactgcattggtgggaattgcttacgcccgtttccctgatacccgcgacgattccatcagccgcggcaaagcacgatcagcgttggagaaatccacgggccttaaagagcgtttcgcgcgtcattttcctgcaatttccatacctgtcgatacgggtgatgctgcagatattctcgtatcgggttggtggctttcaggttctaaaaagaagatcctgactgcagcggaaatccagaccttatttatcaaccgattggccacaggtccattgagcactcaattggaaactgctaccgggttgaaactgcaggtggtgaccaatcgagagcgtatgaagatcactctcattgaacccaaaggcacatcaggacatgccatcgacccccaagctggcaagggttcaaggggtggcttcctcctggacaatggccaagaagatgaatacgacgatgtcgacaccgtcacaatccccgatgcactcaatgtcatcggttacattcttacccatggaactccacctcaagaaggctggaaggtagacgtgttggagcgttagtcctcgatgaattcttctcc

SEQ ID NO: 2260 - protein, 182 aa, Corynebacterium glutamicum
LVGIAYARFPDTRDDSISRGKARSALEKSTGLKERFARHFPAISIPVDTGDAADILVSGWWLSGSKKKILTAAEIQTLFINRLATGPLSTQLETATGLKLQVVTNRERMKITLIEPKGTSGHAIDPQAGKGSRGGFLLDNGQEDEYDDVDTVTIPDALNVIGYILTHGTPPQEGWKVDVLER

SEQ ID NO: 2261 - DNA, 549 bp, Corynebacterium glutamicum
  CDS (101)..(526): RXA01475
tggatctcaatgtagtcgcaatacggcttttattcgtcaggcagttctgcgaatagtattcgtgcacattggattcacacccgtagtagtttttgggggaatgagcatccaagggttttccgcaggtgactattctgcatgttttgaaccgcgcatcgatgcgtgggttgatattcgcggtccgcggaagcccgagtggttggcggaaaatatcgataatccgctgagacactggggcgataatcctcatatcccggtgtctgctgcgaaaaaggctggaaatatttacaaagagacccttcgaaccatgagagcctcaacaaagaccccagaccaggatcccttaaaagaaaccctgcgcagcttcatcgcaagcatcaaccagctcgccgcaaagaagaatttcattgatgccggggtgcgcgaagatatcgttgttgcgctggaaaaactatgcgaagcagcagaagctagcccagaagaaattcagcaggcgatcgtgatgggagaagaattcatcgaggactaacgctccaacacgtctacctt

SEQ ID NO: 2262 - protein, 142 aa, Corynebacterium glutamicum
MSIQGFSAGDYSACFEPRIDAWVDIRGPRKPEWLAENIDNPLRHWGDNPHIPVSAAKKAGNIYKETLRTMRASTKTPDQDPLKETLRSFIASINQLAAKKNFIDAGVREDIVVALEKLCEAAEASPEEIQQAIVMGEEFIED

SEQ ID NO: 2263 - DNA, 465 bp, Corynebacterium glutamicum
  CDS (101)..(442): RXA01476
atccaagaaatttcgcacctcaggagtagcgatacttcgtaaatttgggaagaaggagtagccacatgacgttgatcgacctcactgctggagtgagcgcatgagcgattcaccgtgcaccgtcgtcatcctgaaccgcacagctactgcgacttccatcctgagagatattaaagccctcaccggttacggcctgtctgagatcaggtcgcgcatcgttgcgggacttcccgtcgtgatcgaggagatgttctcaaacgcctggtacgacgaacgcgcacaactgttgctggcactgctgaccaaatggcagaacgaaggaatcacattcgagattcgggaagtcgctgaggatgatcccatcgaagcaggggcattgatctctctagaagtgctgcgaaacatcattgagccagacgataatgaatcgagggacggtatctagtggtgaacgtaaacccccgg

SEQ ID NO: 2264 - protein, 114 aa, Corynebacterium glutamicum
MSDSPCTVVILNRTATATSILRDIKALTGYGLSEIRSRIVAGLPVVIEEMFSNAWYDERAQLLLALLTKWQNEGITFEIREVAEDDPIEAGALISLEVLRNIIEPDDNESRDGI

SEQ ID NO: 2265 - DNA, 954 bp, Corynebacterium glutamicum
  CDS (101)..(931): RXA01488
ccttgatatcgccaccggcatcgatgatgccctcgcacttgcctacgcactgggctcacctgaactagagctcattggtgtcaccaccacctacggtaacgtgctactcgaaaccggtgcagtcaatgacctggcactgcttgatctgttcggtgcaccagaagtacctgtgtacttgggtgagccacacgcacagaccaaggatggctttgaagttcttgagatctccgcgttcattcacggacaaaacggcatcggcgaagtcgagctgccagcaagcgagtcaaaggcactccccggcgcagtggatttcctcattgattccgtcaacacccacggcgatgacctggtgatcatcgcaactggtcccatgaccaacctgtctgcggcaatcgcaaaggatccaagctttgcttccaaggctcacgtggtcatcatgggtggcgccttgactgtcccaggcaacgtcagcacatgggcagaagcaaacatcaaccaggacccagatgcagcaaacgatctgttccgttccggtgcagatgtcaccatgatcggtcttgatgtcaccctgcagacccttcttaccaagaagcacactgcgcagtggcgcgaactgggcactccagctgctatcgcactggccgacatgactgattactacatcaaggcatatgagaccaccgcaccacacctgggcggttgcggcctgcacgacccactggcagtaggcgttgcagtggacccaagcctggtcactttgctccccatcaacctcaaggtagacattgagggcgagacccgtggacgcaccattggcgatgaagtccgcctcaacgatccagtgcgcacctcccgcgcagctgtcgccgtagacgtggatcgtttcctttctgaattcatgacccgcatcggccgagtcgcagcacagcagtaaaagcagctctggtgaaggtt

SEQ ID NO: 2266 - protein, 277 aa, Corynebacterium glutamicum
VLLETGAVNDLALLDLFGAPEVPVYLGEPHAQTKDGFEVLEISAFIHGQNGIGEVELPASESKALPGAVDFLIDSVNTHGDDLVIIATGPMTNLSAAIAKDPSFASKAHVVIMGGALTVPGNVSTWAEANINQDPDAANDLFRSGADVTMIGLDVTLQTLLTKKHTAQWRELGTPAAIALADMTDYYIKAYETTAPHLGGCGLHDPLAVGVAVDPSLVTLLPINLKVDIEGETRGRTIGDEVRLNDPVRTSRAAVAVDVDRFLSEFMTRIGRVAAQQ

SEQ ID NO: 2267 - DNA, 1119 bp, Corynebacterium glutamicum
  CDS (101)..(1096): RXA01494
gcgatgaggagctggctaaattgcgcgaaggtgcagcgcctgcaggtgatgcagatccttacaagacttcatccaagtctgaatctgaggaataacaccagtgacggataatagtcagtttcatgctgcttcagcattagtccaggcagctcacacggttagcgttgtggggcatctgcgacccgatgctgatgcaatcggcagtgtagctgccacagtggcggcactacagcaacttggtaaagacgccgtaggtgcaatcggccagctagattcgatgcccgagaacttgtacaccattcctggggcatcaaacattaagtttggcgattcactgccggaatctgacctcatcattgttgttgattgtgggtcaatcgaacgcaccggtgcgtttgaaagcatcatcgtcaacaatcctgacaaagtattggtggttgatcaccacgccaccaatcctgggtttggtgccgtcaacttaatcgatgtggaggcagaatccaccaccacgattttatatgactggtttgatgcgatgtcggtgcaaattactcccgatatcgcccacggcctttatgctggactgctcaccgataccgggtgcttcaggtggggtcgaccagtcatgcatgacatggctaaagaactcatggagttcggtctagacattcgtgccatttcatcagcattgcttgatcaaacctccgtggatgatttgcgtcttgttggccagattgtctctcggatcgagctgcgggaagcagggccatatactcttgctgttctcgtggcagacttcgataccatcaacggccgttcacgcgccgttgtggaaggcttgatcgaaatggttcgcgctgtggaaggcgcagacttcggagcagtattcaaagaatatgaacgtggcgtctataccgtgtcactgcgttcctccaatttgagtgtcgcttccttggcagtgcatcttggcggtggcggacacattcctgctgcaggctataccgctcgtggtacggaaatcgaagccctcgatacgttgattgaagcaaccgttaccttgggggagtctttgcgaagctcggcgcatgtcgatgtctaacaacgactttgagcatgagt

SEQ ID NO: 2268 - protein, 332 aa, Corynebacterium glutamicum
VTDNSQFHAASALVQAAHTVSVVGHLRPDADAIGSVAATVAALQQLGKDAVGAIGQLDSMPENLYTIPGASNIKFGDSLPESDLIIVVDCGSIERTGAFESIIVNNPDKVLVVDHHATNPGFGAVNLIDVEAESTTTILYDWFDAMSVQITPDIAHGLYAGLLTDTGCFRWGRPVMHDMAKELMEFGLDIRAISSALLDQTSVDDLRLVGQIVSRIELREAGPYTLAVLVADFDTINGRSRAVVEGLIEMVRAVEGADFGAVFKEYERGVYTVSLRSSNLSVASLAVHLGGGGHIPAAGYTARGTEIEALDTLIEATVTLGESLRSSAHVDV

SEQ ID NO: 2269 - DNA, 1041 bp, Corynebacterium glutamicum
  CDS (101)..(1018): RXA01497
cgcccacgggcaaagttttcaaaaactctgatccatatggatcagagttttttcgtatctgccaccagaaagacgcccctttggcacgccgaattagtcaatggtgggtaaacttcccatcatggctgaaaccaacgaaaatgatcttccagttatcgaccttgcccaaatcgaaggctatgttgtagatgactcggatgaagatgatccagtacttctgcgtccagatggaacccccattgaaacctggcgcgaagacttcccttatgaagagcgcgtcacccgcgaagactatgagaaggtcaagcgctccctccagatcgagctgctgaagtggcagaactggaccaaggaaactggccagcgccacatcattttgttcgaagggcgtgacgccgctggtaagggtggcaccattaagcgcttcaacgaacacctgaaccctcgtggtgcccgtactgttgcgttggagaagccatcaccacgcgaatccacctcatggtacttccagcgctatattcagcacttcccagctgctggcgagatcgttttctttgaccgctcttggtacaaccgttccggcgtggagcgcgtcatgggtttctgcaccgaatcacagcatgcagagttcctgcgtgaggttccaatgctggaaaacatgatcctgggctctggtatcagcttgaccaagttctggttctcggtgacccgtaaagagcagcgcacccgttttgctatccgccaggttgatcctgtgcgtcagtggaagctttccccaatggacttggcttcacttgatcgctgggatgattacacccgcgctaaggaagagcagttccgttacaccgacactgatgagtccccgtggatcaccatcaagtcgaatgacaagaagcgtgcgcgtatcaacgcgatgcgttatgtattgtccaagtttgattacaccgacaaggattacgagctcgttggtgagcctgaccctaaggttgtgcttcgtgggcgcgaccagatcggtgactagtcactaggcgggcatgaaaa

SEQ ID NO: 2270 - protein, 306 aa, Corynebacterium glutamicum
MVGKLPIMAETNENDLPVIDLAQIEGYVVDDSDEDDPVLLRPDGTPIETWREDFPYEERVTREDYEKVKRSLQIELLKWQNWTKETGQRHIILFEGRDAAGKGGTIKRFNEHLNPRGARTVALEKPSPRESTSWYFQRYIQHFPAAGEIVFFDRSWYNRSGVERVMGFCTESQHAEFLREVPMLENMILGSGISLTKFWFSVTRKEQRTRFAIRQVDPVRQWKLSPMDLASLDRWDDYTRAKEEQFRYTDTDESPWITIKSNDKKRARINAMRYVLSKFDYTDKDYELVGEPDPKVVLRGRDQIGD

SEQ ID NO: 2271 - DNA, 411 bp, Corynebacterium glutamicum
  CDS (101)..(388): RXA01501
ctaacgaaatcgccggactcctcgcaatcacaagaagcgacgactagcctgtggggacaaactatttcaagaatttattcaacaaaggagttcttcacaaatgaaggaagtagcagtcaacgaagtcccagcaggcgcacagttgatcgatgtccgcgagaccgatgaatacgcagaggttcgagcacagggtgccgtcaacattcctatgagcgagttcgttggccgcatcgatgagatcgatctggaccgcgacatttatgtcatttgcaagctgggtggacgctcagctcaggttgccgaataccttgagcagcgcggaattgaagccatcaacgtaaacggtggcaccgacggctgggttgctgcaggattgccaaccgaggcataagaacccgccgcaaaagatcc

SEQ ID NO: 2272 - protein, 96 aa, Corynebacterium glutamicum
MKEVAVNEVPAGAQLIDVRETDEYAEVRAQGAVNIPMSEFVGRIDEIDLDRDIYVICKLGGRSAQVAEYLEQRGIEAINVNGGTDGWVAAGLPTEA

SEQ ID NO: 2273 - DNA, 732 bp, Corynebacterium glutamicum
  CDS (101)..(709): RXA01504
gcatgtagcgagtttgatgaagttgtcgcgataagaggaggggcgtgtcggtctgtaggattggctcgtaccgaacttagaaaactcatgggagtttcgcatgaatatcacgtggcttatcctggccggtgttttagccatcatcgctgtcgtgttcttttatctttcagcacagaagaaaaagagcgaaccgcagcctcctcgtcagcgtcaagatcctctgaaatttgccgacggatccgacacttttaatgcccgcattttgggtcctggagcaattatttcccgcggtggcgtggattatgtctgccgcggagccatccagttccgtcaaggccaatacatttggcacgagtatctactcgacggtggcaaaggcagtgagtacctgagcgtggaatacgatgagggccaactcaacctcggatggtggattacccgccctgacctggcacaacagcccgcacatgatgtcaccgtggagggcgttcgctaccgtaaaaccgaatctggcgtgggcaccttcacctccgaaggcaccaccggcgtggctgatcaaggtgaatttgaatactgggatctcgccgaagttggcggaaacaggttgctcagttttgaacgctacggcaaagacagtccatttgaagtatcgctcgggtggacggtgctgcccggcgaactcaccgtttacccagcaccagaggcctcatgattcatcacatcgattgcatg

SEQ ID NO: 2274 - protein, 203 aa, Corynebacterium glutamicum
MNITWLILAGVLAIIAVVFFYLSAQKKKSEPQPPRQRQDPLKFADGSDTFNARILGPGAIISRGGVDYVCRGAIQFRQGQYIWHEYLLDGGKGSEYLSVEYDEGQLNLGWWITRPDLAQQPAHDVTVEGVRYRKTESGVGTFTSEGTTGVADQGEFEYWDLAEVGGNRLLSFERYGKDSPFEVSLGWTVLPGELTVYPAPEAS

SEQ ID NO: 2275 - DNA, 621 bp, Corynebacterium glutamicum
  CDS (101)..(598): RXA01505
tcagttttgaacgctacggcaaagacagtccatttgaagtatcgctcgggtggacggtgctgcccggcgaactcaccgtttacccagcaccagaggcctcatgattcatcacatcgattgcatgcctacagatgtctccgccgaagcgctcggcgtgagctggaatggggaatcgccggaggtgctcgtcgataagcttatcgacgcatccccacaccccagcacctgccatttagcggtgattggcggctcgcatgtggttaccgttgaaacgcccgatgggcgtttccgggaagaaatttcctgccatgcacaagaagcggaagattcccgctggccgctgcccgacagcatcacgcgggaaaactacctgctgcaaaccaacgtcgccgtgctgtctgaggaagattttgcccgcgcagccgaagaaatctccaacggcgacgacgactggttgatcgccagtttccccggcgccggcgaacaccacctcaccgcgctgaccgcagaatttctggaagacgtatgggaatggtttagccaccacctctacccagaagagctcaccatcgtgagcacgaggagcatttacaaaccatgagctcccgaaactaccgaagc

SEQ ID NO: 2276 - protein, 166 aa, Corynebacterium glutamicum
MIHHIDCMPTDVSAEALGVSWNGESPEVLVDKLIDASPHPSTCHLAVIGGSHVVTVETPDGRFREEISCHAQEAEDSRWPLPDSITRENYLLQTNVAVLSEEDFARAAEEISNGDDDWLIASFPGAGEHHLTALTAEFLEDVWEWFSHHLYPEELTIVSTRSIYKP

SEQ ID NO: 2277 - DNA, 534 bp, Corynebacterium glutamicum
  CDS (101)..(511): RXA01506
cgctgaccgcagaatttctggaagacgtatgggaatggtttagccaccacctctacccagaagagctcaccatcgtgagcacgaggagcatttacaaaccatgagctcccgaaactaccgaagcataggattcatcctgctgtttttagcagtgttgtgcctgttcgctgcggtttttgccaagcctgcggtgggaagccaagtctccgaccgctggcccggaaacaacggcacctactcatgcgctggcgaaagtggggtggtggatgaaatcgtgaacatgtccaccccaaccgaccgcgccaccgaccccgcaactggcgatacttacctgcgatacagcaaaaacctgatcatcatctcaggtgaaggcacgccggaatgcaccatcaccgtcgaaggccttgaccgcgtcaacagtggtgcgttcatctggctcggcggcggtttcggcccatcctcaccaagcagttccagcggcggatcctccggttccggcggtggcgtgaaatagaaagaacactatgagtcaat

SEQ ID NO: 2278 - protein, 137 aa, Corynebacterium glutamicum
MSSRNYRSIGFILLFLAVLCLFAAVFAKPAVGSQVSDRWPGNNGTYSCAGESGVVDEIVNMSTPTDRATDPATGDTYLRYSKNLIIISGEGTPECTITVEGLDRVNSGAFIWLGGGFGPSSPSSSSGGSSGSGGGVK

SEQ ID NO: 2279 - DNA, 546 bp, Corynebacterium glutamicum
  CDS (101)..(523): RXA01507
gcgttcatctggctcggcggcggtttcggcccatcctcaccaagcagttccagcggcggatcctccggttccggcggtggcgtgaaatagaaagaacactatgagtcaatatcttgtcgacggagtgctcggcaccctttcatatttcgtgttggccgcagtgatcctcgtggtcggttttgtgattttggacttgatcaccccaggtaaactgcatgaactcgtgtttgtgcaccatctgcccaacgccgctgtgatcaccgtggcgcagcaggtttccatcggaatcatcgtggtcactgctgtgctgacctcctcagatattttgagtgaaggtttgctggagactgcagtgttcggtgcccttggtctggttatccaagtggtggtcatggcggtgttggaagctgtcattccgggacgtttccgtgatctcgtggaagatcccaaactccgttccggtgccgtcgtggccgccgtcatcttgatcgtggtgggaaccgtaaacgctgcatgtctgatttaggacccatctggcgctggctg

SEQ ID NO: 2280 - protein, 141 aa, Corynebacterium glutamicum
MSQYLVDGVLGTLSYFVLAAVILVVGFVILDLITPGKLHELVFVHHLPNAAVITVAQQVSIGIIVVTAVLTSSDILSEGLLETAVFGALGLVIQVVVMAVLEAVIPGRFRDLVEDPKLRSGAVVAAVILIVVGTVNAACLI

SEQ ID NO: 2281 - DNA, 870 bp, Corynebacterium glutamicum
  CDS (101)..(847): RXA01519
ctgggcggaatcgcactctcagctgccggactttatttagagcgaagctgtgaggctccgcctccccaatctggcgaagcgatcagctagattggaattcatgaatcaagacctgtcacacgaggattccggcgacggcaattctgtcgaccgtggacagattctgctagcagtactcattggacttgccctgattgccagcgtcatcatgctgctggccaacagtgacggcgccatgaaaatagcacttcttgcagcgctgtgggcggcaatcatcggattcttccttgtttatcggtcccgcaaacaagtcgaagctgctgcgcgggagaaggaaaccctcgaatacgcacaccaatctgaactcaaccgactagaagctgaactcgtccaagaaaaaatggagatttctgaatcccgtcgtgcacgcgatcaggaaacccttgaggaaatcaaacttcaactggaggaaatgcgcacccagctgtctgagctttctggccgtgaatggggctatgagccaaccatgctgcgtgccgaagcccgacgaatccttgagttggaatcccagcagctttcccagcagttccaggcaccgcagccagaagtcccggagcctgttgcagttccagagccaatgccggaacctgcaccggtgccggaaccagtaccagaacctgagccagttgaagttgctgtcgaagctgaggaagaaccagcaccaggtcgcagaaggcgtaggcacgcagctcccgaagaaactggcggacgccgacgcaaagatgaacgccaaggcggtttgagcgtggctgatcttctggcagcagcaaggaaaaaggaaaacaactaatgcaggctcctcgccttcgc

SEQ ID NO: 2282 - protein, 249 aa, Corynebacterium glutamicum
MNQDLSHEDSGDGNSVDRGQILLAVLIGLALIASVIMLLANSDGAMKIALLAALWAAIIGFFLVYRSRKQVEAAAREKETLEYAHQSELNRLEAELVQEKMEISESRRARDQETLEEIKLQLEEMRTQLSELSGREWGYEPTMLRAEARRILELESQQLSQQFQAPQPEVPEPVAVPEPMPEPAPVPEPVPEPEPVEVAVEAEEEPAPGRRRRRHAAPEETGGRRRKDERQGGLSVADLLAAARKKENN

SEQ ID NO: 2283 - DNA, 507 bp, Corynebacterium glutamicum
  CDS (101)..(484): RXA01520
ctgcatacctcgctcacgcacggcatcactgtgatggatccgctgcagacgtccggcaggcatcgtgatgtctgcgcacccgattggtcaggaccggtgggtggcgtccgcgttggatgagttgggggagaccatcgtggggcttttggtgggggagctcggtggctcgattgtcgagatcgccgatgacaagcgcgcacagttggctgcagcgctgacctatgccggatttttaagcaccttgcagcgcgatgcgtcgtatttcctggatgaatttcttggcgatcccgatgtgacctctgacatcgttatggattccgcacagcaattccaggcactgccttcgttggatgaggtcattgcccagtacgattcgattaacaaccccggcaggcaacgccttttccgggatttggcgcgcaggcaggcagagatttcccgcgcgcaagatattgagctgtgggcaattcagaaggaggaccgttgagtttcacgcatggtcagggc

SEQ ID NO: 2284 - protein, 128 aa, Corynebacterium glutamicum
VASALDELGETIVGLLVGELGGSIVEIADDKRAQLAAALTYAGFLSTLQRDASYFLDEFLGDPDVTSDIVMDSAQQFQALPSLDEVIAQYDSINNPGRQRLFRDLARRQAEISRAQDIELWAIQKEDR

SEQ ID NO: 2285 - DNA, 1074 bp, Corynebacterium glutamicum
  CDS (101)..(1051): RXA01523
aatcctccaaacctgtggatagaacaatctatccacaggttttcagttttctgcaaagttcatccttggcttcttatgccttcggatccatagtggggtcatgaaaaactggcaagaagaattccaactagtcaatctcacgaaacttctgcatagcgataccgagacttctgcggcaatcagtaatggtcaaatgattaaactcactcatgaagtcgcaatcaatgctgaaaagtaccgaagccttcctgcatgggataaagcagccgcccgagcttttgcagtgggtatgactgtggacaaagcagtggtagcggggcagtctgcggcgaggttatggggataccaaactttgactgttgagaaaaccgtgttgtgtctgttgccggaaaggctacgttcaaaatcctccaagcattggccgtccgggatgcgatataaagatcgttacctctcgtcgcgtgatattcgagaggttcatgggatccgagttacgggagcgttccgcacatttttggacatcgctttggatgatggggtggtggcggctgtggtcactattgattcagctcgaagacagaatccatcgcttacgcgtgagaagttaatgcacagtgcggaaagtttcccgaggcatcggggtgtgaaggcgtatcggcaggcgattgagttgtcgattcccaattcggatagtgctcaggagacgagggctcggttaatccttcgggaggccaagctcccggaaatccagtcagtgaaggtgcaggcccgtttcgatcaatcgcacaacaagtatttcctcgtcgatttcttgatcaatgagtggatcatcgtggagattgatggacgttcgaaatatgattccccggagctcaatgaggtgctcatggctgaacgcgatcgggagaaattcttcctcaatcagggctatgcggtcttaagaatcgatccgaaacagttagacctcaaccaagatggggagtgtgagttcatcggaatcctcaaaaacactttgcagaagaccccacctgagcacctcaagcaagccgcctaaacactccaagaaccaccatt

SEQ ID NO: 2286 - protein, 317 aa, Corynebacterium glutamicum
MKNWQEEFQLVNLTKLLHSDTETSAAISNGQMIKLTHEVAINAEKYRSLPAWDKAAARAFAVGMTVDKAVVAGQSAARLWGYQTLTVEKTVLCLLPERLRSKSSKHWPSGMRYKDRYLSSRDIREVHGIRVTGAFRTFLDIALDDGVVAAVVTIDSARRQNPSLTREKLMHSAESFPRHRGVKAYRQAIELSIPNSDSAQETRARLILREAKLPEIQSVKVQARFDQSHNKYFLVDFLINEWIIVEIDGRSKYDSPELNEVLMAERDREKFFLNQGYAVLRIDPKQLDLNQDGECEFIGILKNTLQKTPPEHLKQAA

SEQ ID NO: 2287 - DNA, 1845 bp, Corynebacterium glutamicum
  CDS (101)..(1822): RXA01525
gtctctgtagaaatctagggctttcgacgcttgagccccgcgcacctgcaaggtgcgctgtagggaggcgtcgacaagcatctttaagtagctttgaagcatgcgttcctttcaatcgatccttgacctggtaaattcagcatccgaggtggctaccaaaattgtgttgaagcgcttcgaaaaacggataaccagcgaaactgactgggtaccgtatcagcggtttagtctttggtcggttggttctccgctaacgatcgaacgcaaaggccccgatgtgcgtgtgagcaaggacaacactgccgttcttcagcgctatcaaagaccggaagcagaaggactgatcagctacttcatggatccaaagccatggataactgaattggcaggcctgaatctggacgatgtttccgaagatacagttgcaggtcggacagtattagtggttcccctatccaatgtcattctcagcatcgatgcggaatttgggatgattctaactgcggaaaacgacatagaaaagatccacgcaatatctgtcgaactcttagaaaaatggagatcatcccattaccctgagccgcattttcctgcagcggttctcccacctgcgtcgactggaaaccgcaacctccgagttctatgccctgagttttccattccaagtgtcaacgttggtgatcaggttttactatttttaacatttgatcaaaccctgccaccagtagatcagcttgaaactactcgccgcggatacactgatccaatccagcttgactacgaccaccgccaatacaggtttcacgccgacggttgggatgccatcatctccacggtggagccactacacgacgaagaagaactcacaggttacttcctgcaccgccttgacccagatagcgcgtacccaaccattgcagtcgttacagcagcgcactaccacggtacggacgcaattatcgacgtgaccctagatggtgtgcatccacccaaaaaccaagaaactcttgaaggcatcagcactagtaccagtgacggtgacatattttggctctccgatgaaagcttgcctttcgtccgtggattcagcgtgtcaacaggcgaactattacacgagatctccatccccacgttccaagagatcgtcctcgattccgctaatagagcccgcgtaaaacaaaagcaatggcctcacgatttcagtgattgcaagggaaaaacatgggagcttccggatcttaaagaagtattcgaagctgtcccttcgattccagcaggttggagattgttagacagcttcgggaaaaacttgcacaatgtcacacgcgaaaaccctcgtcttaatgacaacttttggcttcaaacaatccttaggcttaaaccatttaaagcagtagatcttgatatcggccgatcgataatcacagcaatttacccatacggtgatcgaatttacttacgcgctagtaaccaccacatcacgtttaaccaggacctcgagattctcaacgtagaagtctttggcgaccctgaggttcccgaatctggtctaatttatcttccacctggggattctccaacactcggttttcccaccggaacactcatgatgtttcatgagcaagaaggcacatatgctttccacgaccctgaaacaacagaacaaataacaactgtgaacttagacaggaatagtttttcagtggcatattcttcccgaaccaaaattgttatttcactgaaaaacccagaaagccgacctaccaacaagctgttggtgtgggaaccacaaaccgggtggcgagaacagaacctggagcgctgagcacgcttaaggtgaggtgg

SEQ ID NO: 2288 - protein, 574 aa, Corynebacterium glutamicum
MRSFQSILDLVNSASEVATKIVLKRFEKRITSETDWVPYQRFSLWSVGSPLTIERKGPDVRVSKDNTAVLQRYQRPEAEGLISYFMDPKPWITELAGLNLDDVSEDTVAGRTVLVVPLSNVILSIDAEFGMILTAENDIEKIHAISVELLEKWRSSHYPEPHFPAAVLPPASTGNRNLRVLCPEFSIPSVNVGDQVLLFLTFDQTLPPVDQLETTRRGYTDPIQLDYDHRQYRFHADGWDAIISTVEPLHDEEELTGYFLHRLDPDSAYPTIAVVTAAHYHGTDAIIDVTLDGVHPPKNQETLEGISTSTSDGDIFWLSDESLPFVRGFSVSTGELLHEISIPTFQEIVLDSANRARVKQKQWPHDFSDCKGKTWELPDLKEVFEAVPSIPAGWRLLDSFGKNLHNVTRENPRLNDNFWLQTILRLKPFKAVDLDIGRSIITAIYPYGDRIYLRASNHHITFNQDLEILNVEVFGDPEVPESGLIYLPPGDSPTLGFPTGTLMMFHEQEGTYAFHDPETTEQITTVNLDRNSFSVAYSSRTKIVISLKNPESRPTNKLLVWEPQTGWREQNLER

SEQ ID NO: 2289 - DNA, 2634 bp, Corynebacterium glutamicum
  CDS (101)..(2611): RXA01527
atttggcttttgcggatgagcggaagttggctaggcaggcgcatgatttgttgcctgagtttgctttgaaggaaaaggcggagggaaggtccaccccaaggtgattccgaaccccaacccgaaccccaaagccaaaactcttcgcctcgtttcagcgctgaccgccatcactgtggtgggttttagcgcttcacctgttcatgcgttgccgattccgttggatccttctgatccggcggtgtcggagttgtgggtgaatccgaatgcgcgggctgatgatgagctttctggtgtggatgtagagatctcggattttgtcatgccgaatagcaatctaactgtgcaggtgggggagtcttttaaggcgcaggttcgggtgactaatcgttcgtcggagacgttgagcaatattacgttgcaggcgcgtcgtgcggaggcgtcgtttgatatggcgagtgctcgggtggcggcgacggataataattatggctacttcggcgcgatggtgactcttgatgatgagttggagccgggggagagtgttgagactgaggtggagatttctaccgatagtttgtcgatttctcagccgggttcttatccgacgatgttggcgttgtcggggcagcttgatggggtggcgcagcatttggattcgcagcgtttccttctgccagtcctcagcgatacaactgatacagaagacaccgccacccccacgacgatgatttacccgatatcagcccagacgaatgtgttgggtggtgagaccggcgaggcgccggaagagccgcctttgctggtcagttccgacgcgcttgcgggcgagttggatgagggcggtcgtttgcaaaagcttatcgacgcctacctccagtcttcacccgccgtgcagcaagccacgtgccttgctattgatccgcagcttcttgatgtggtggatcgcatgaccggcggttacaccgtgaccgatactcgtcccagtacggtgcggcagaatcagcggcttcgtgagttgtggactgccgataatcaacccaccaatggtgtcgcgggcacgggtgcggaaaacgctgccattttcttggagaaactccgacaggccacagccacctcgtgcaccgtggcgttgccgtgggcgaatgctgatctaaatgcagtgagccaaaccggtaatcagtggttgatgcgcgaggcgctacagcgaggtgtcaccacctttgaagaagtgttgggtgttattccggaatccaatgtggtgattcctggaaatggttttgtggagccctccaccgtgggtgatctcggatgggcggaagtaacgcttaatccggatcaggcgtgggaggtgcagtcagaggagttggttgctgcccctgatgccacagagcaaagcgcattggataaccctaagccaacgccaggcacggtgacgccgccaacccctatgtcaacggtgtccgtgttggtttctgataacacggtgtggcgcacaacgagcgcggatcggttccactctttggctccgggaataactggggtgtcgtatcagggatcgttatcggcaaccttggctaccttgggacaaaaccctgagactgtgggctattccaatccggattcgcgttatgactacgccatggattctgagagcgcccgcaatctcaccggccaggcggcgctgcgcttgacggtggacaacggcgatgaagactctcccgtgttgatcatgccgagcgcggtgctgggcgccgaagacggcgcgatgttgcttgagaccaccggggctttgcttgccgacggctccgcccgacctttttccctgcagcaatatgtcactgccaatgcggaacaaagaaatactttggccacagcaacaactccaccggatgacactgcttttggtgcaccctacgacgatcctgcgtcattgacggaaaccgaaattctgcgaaccactcagcaggcggagtacatcgatgatctcactggcatcatgtccaatgatcccagcattgcactgacccgttatgggtttacagcaccgctgcggcaagatctgctgcgcgcgttgagtatcagtgagcgtcgttcgttagctcgccacacccaggcaacctctgctgccgataaattacttaatcgcaaccgcgatactctgcagaagctgcgtagctctgtggcgttgttgccgccgggaaatgtgtatacccgaacctcggaatcgtctccgttgttgattgtggcgcaaaacggtttgccattgcccgcggagactcagattttgtattccggaaatcaggatgcgcacatcaatactccgggtgtggttcgtattccggcgcagggttccatcaccttgcagatgactgcggatttgcccgatgacaatctgcgcactgatctcacgttgtggttggcatccccagatggggccaccattagtgaacctgtggaaattactgtccagcctcgcccgaatttgggcaccacgctgtttttcgtggcagcgggcattctggcagtaggagggttgttgtttatacggaagaaacgaaacgtcgaaaagcgctcgcccggtacgggatcgcccaaaccgccaccaacccactaacgtatcgcatagttattttc

SEQ ID NO: 2290 - protein, 837 aa, Corynebacterium glutamicum
VIPNPNPNPKAKTLRLVSALTAITVVGFSASPVHALPIPLDPSDPAVSELWVNPNARADDELSGVDVEISDFVMPNSNLTVQVGESFKAQVRVTNRSSETLSNITLQARRAEASFDMASARVAATDNNYGYFGAMVTLDDELEPGESVETEVEISTDSLSISQPGSYPTMLALSGQLDGVAQHLDSQRFLLPVLSDTTDTEDTATPTTMIYPISAQTNVLGGETGEAPEEPPLLVSSDALAGELDEGGRLQKLIDAYLQSSPAVQQATCLAIDPQLLDVVDRMTGGYTVTDTRPSTVRQNQRLRELWTADNQPTNGVAGTGAENAAIFLEKLRQATATSCTVALPWANADLNAVSQTGNQWLMREALQRGVTTFEEVLGVIPESNVVIPGNGFVEPSTVGDLGWAEVTLNPDQAWEVQSEELVAAPDATEQSALDNPKPTPGTVTPPTPMSTVSVLVSDNTVWRTTSADRFHSLAPGITGVSYQGSLSATLATLGQNPETVGYSNPDSRYDYAMDSESARNLTGQAALRLTVDNGDEDSPVLIMPSAVLGAEDGAMLLETTGALLADGSARPFSLQQYVTANAEQRNTLATATTPPDDTAFGAPYDDPASLTETEILRTTQQAEYIDDLTGIMSNDPSIALTRYGFTAPLRQDLLRALSISERRSLARHTQATSAADKLLNRNRDTLQKLRSSVALLPPGNVYTRTSESSPLLIVAQNGLPLPAETQILYSGNQDAHINTPGVVRIPAQGSITLQMTADLPDDNLRTDLTLWLASPDGATISEPVEITVQPRPNLGTTLFFVAAGILAVGGLLFIRKKRNVEKRSPGTGSPKPPPTH

SEQ ID NO: 2291 - DNA, 1365 bp, Corynebacterium glutamicum
  CDS (101)..(1342): RXA01536
agcatagatgacttgacactgttgcagcaggcggttttcacctggcctcttaggatttggtcaaatggttgcaacgacgccagggaaggaggcgcaccccatggcatttggattttttagtagacgtaagaaaaagaacaaagacaaaaacccgaatgaaaattcagcagtgcccgcacactctgaagattcacctcaggaggtttttgagggtaatggtcgtcaggtaggcgaccccattgaacagcaggttgatcgagatgctaaaggtcgtctcacagcggcggatttcttgccggacgctgatctgccacagctgaatcgttcgcgtgcaaatatgctgcgccgtgaattggagtaccgtttttcactccagaatgcccacattaatatcgatggaaacacggccatgattcagcgttcagatggcggggcagcacatgtctcgttgcgcaccctcgcgatgaatgcagctggccttgataactttgatcaactccctgaactggtggaaagcttcgttcacggcacgctggccgatgcaacattaaacgatctttctactgctgacctgtataaagcactgcgccttcgcctgctgccaacacctggcgaaggcgacgatctagttgagcatggactcgaccgggaaagccagatccgcgacgattcaatcctgcgcaccttcacctctgacatgtcgatcgcgctggtgctcgataccgagcatgccatccgcatccagccactcaaagagctcgaggagttcgatgacctcagcgccctagagcgggctgcggaccgcaatacctggcaagagctttacgacgcaaacgttgacgcttccttcgtcgacgctgaatcagacagcgaagggtcatcattttgggctttcgaatctaactcgtactacttgggtagtgcaccactgttcctcaacgatctgttggcaaagtgggcacctgacctggaccaaagtgatggcgtcatctttgctgtccctgatcgtgatctgttgattgcgcgtcctgtgaccaccggcgaagatctgatgaacggaatcaccgcgatggtgaggatcgcgatgcgctttggcctcgggaacccgacgtcgataagcccgcgcctgcacctgctgcgcgacaaccaggtgaccaccttcaccgacttccgcgtcgtctctcctgaaatggaagctgaatgggaagacagcgcgtttgacgcgccaccggccggcgcgatcggcattgaggtgcgcccagatccgtatctgatggagcgcctccaacagggcggctttggtgatttcggagatttcggcaagccccgcgatctagatatgtagcgaaaaagggaccttcactt

SEQ ID NO: 2292 - protein, 414 aa, Corynebacterium glutamicum
MAFGFFSRRKKKNKDKNPNENSAVPAHSEDSPQEVFEGNGRQVGDPIEQQVDRDAKGRLTAADFLPDADLPQLNRSRANMLRRELEYRFSLQNAHINIDGNTAMIQRSDGGAAHVSLRTLAMNAAGLDNFDQLPELVESFVHGTLADATLNDLSTADLYKALRLRLLPTPGEGDDLVEHGLDRESQIRDDSILRTFTSDMSIALVLDTEHAIRIQPLKELEEFDDLSALERAADRNTWQELYDANVDASFVDAESDSEGSSFWAFESNSYYLGSAPLFLNDLLAKWAPDLDQSDGVIFAVPDRDLLIARPVTTGEDLMNGITAMVRIAMRFGLGNPTSISPRLHLLRDNQVTTFTDFRVVSPEMEAEWEDSAFDAPPAGAIGIEVRPDPYLMERLQQGGFGDFGDFGKPRDLDM

SEQ ID NO: 2293 - DNA, 825 bp, Corynebacterium glutamicum
  CDS (101)..(802): RXA01540
ccatgcagcactatgggttccctgatcccgatgcgtactttgaccatgccactatcgcaggaaaacaccacacactcatcacaagaaagtaggtctcaccatgacttttgcagaacttagctcaccgcgtaccatcatcgcttttaatggccgtgccgaatctggcaaagatactgcagcacagtatctcacccatatgcacagttttcaccgcatcgcctttgccgatggtgtccgtgacgcactctatgcgcttaacccactggtctgtgtggagcaggctatcaccacacatggtgccatttatgaccgcgtggccactgttgtggacacacttggttgggataccgcaaagcaaatccccgacatccgcgcacttatgcagcgtattggtaccgaagctggttggcgcatccacggcgagcatctgtgggtcaatcttgctatcaaaaagatcaatgaactgcccgctgaccacgccattgtcatcactgatttgcgattccccaatgagattgagtggttgaacagcctcaaagccaacccgatgaacaccattcagaccgtcaaagtcatccgaccagatcatgaatcgaccttgactgcaggatcattcggtactacctcacatatttccgaaagctttaatctcactaccgacactgtgctccgcaacgatggcaccattgacgatttgcactcaaagctggctgattttttgagcacttccccgcagcccgtgctctctcgtaacgcccctgtaccaaaacacaacgcaccggcaccaaccactgatgccatgtaaataacccccgtatcaagatc

SEQ ID NO: 2294 - protein, 234 aa, Corynebacterium glutamicum
MTFAELSSPRTIIAFNGRAESGKDTAAQYLTHMHSFHRIAFADGVRDALYALNPLVCVEQAITTHGAIYDRVATVVDTLGWDTAKQIPDIRALMQRIGTEAGWRIHGEHLWVNLAIKKINELPADHAIVITDLRFPNEIEWLNSLKANPMNTIQTVKVIRPDHESTLTAGSFGTTSHISESFNLTTDTVLRNDGTIDDLHSKLADFLSTSPQPVLSRNAPVPKHNAPAPTTDAM

SEQ ID NO: 2295 - DNA, 2889 bp, Corynebacterium glutamicum
  CDS (101)..(2866): RXA01543
gtgctttagccaaggtgaggcatcaagagaagcaacagcgtcgttaccgtttttttggtgggggcgctgttgttgtagttaaagaaagagcggtgggaaaatgagtttgaaacaagccattatcgtgcgcaatgaatatacgattaagcaggcaaatggcaaaggttcacgaggatcatcgccaggtaaatatatctctggctatatggcacgcagcgatgcggtagaagcagtagcacctattgtgcgcaataaattagatgatttcatcatgcggtatatggcacgtgatagtgccgtggagcagctcaccacggacagtaacgcagactatgaccagcaacctgaaatgaactctcgtcgtggccggcaaggtcgccgcgcgaccttgaaacaacgtcgtgcagaacgcagcgcccggcgagcagcattgcgagcgggcgtgaatacagactccgacaccaccaacccatcacaacctgtgcacccgagggaactcgcggaatttactacccaggatgggcagcgcgttcatgatctcatgctgagggctcagggtaatgggggagtggcctttgggtatggcgatgtctcgctgtcacatgatgatcttcatgcagcaagtaataacgtccaagagctctatgaaaataggcataccgtgatgaaagtggtcctatcttttacccaggattacctgaccgcgcatggccttattccagaggatctcgatattaagcgtgctggtgattatcgcggccaggttgaccaaatgaagctacgcatggctgtcatgcatggtgtggatcgtctagcccagcgtcattatgatgatttgcgctatgtcggcgtgattcaggttgatacgaagcatgtgcacgcccacttgaccatggtggatgctggttatggacaccgggctgctgatggtacgcaaaaaggcaaaatcaataagccaggtaaggctattttgcggcgtggtattgacgcctggcttgatcagcatcagcatatggcgcacttgtcagcagcagtggggtatgaaaaacgcaatgtcaccagctacgtcaagcgctgggcgtttcatcagctcacccaagaaagtgctgcgcaatttgtggtcgcttgtttgccagaggataagcgactgtggcgtgcatcgaccaatgccaaggaaatggataagccgaatagattagtgcgcgagttggtggaggcgcgacttggtgagactgattcaccgatgccggcagcactgtcgcaggtctatcagtatgcgcaaaaacgccgcgttaaagaaggtttaagcaagcaggacacccagcgtttgattgataatggccgcgaaaagatcattgagcaggccatgaacggtgtctacagtgtcctatccgcgatttccgatgagcaacgcgatgtctctacggccatgttgacagtcatgcgtcaagactatgaggatttgctcgatggtattgcgcggaagaagagcaaggatctagacgagcagggtagtagtggatcacaagaggtggggaaagaagagcctgagccaagtattgaggaatttgggctgcgtttgcggtcgtattcagcacgcttgaatcatcaccgagaacaacgagaagcctttgccgtgaaaaaacgctcgtgggaggacgctaactctcaaggtttggctgatcccacctcacaggtaatgtggagtttttatgacactgaggagcagtatcatgcgatgtgccaatccaagtaccagcactttttgacctttgccccacctgtcggtcagtgggagaagcaatgggctgaggttgctgattacggtaaaagggttgtgggtctgcgtgcactgcgggcagatcgttctttggcacgcatgagcgatgaacgtgcagctgaagctttgggtcggcaactttatgaccaacccggtggtgggttattggctcgaacaggcgctgagggtaaagctgggcgtgcggtcctggatggccgaattgagcgcatgatggtgacctatcagcaaaaaattgatgatttgcgacgagaatgggcacagctcggtgcacgtttagaggttgaaggtgatgctgtattgatggatgcagcagatctacgtgaatctgggggagagggtgcagatgaacgccagatacagcagcaaacaattgagttgccggtcgctgatgtatctgattctgtgcgcacataccttgacgaagagttacgtgatagtcgtgatgtgagcgctcatgatccagtgcacaccttgcgtggcaggtttcaggtcgtgtttcgaccggagcatgattttgagcaggtgggtggccctgacctgcgcgatcttcactatgcctggtttagcgatcagaaggtcagtcagcccattgtgtgtagttacggtgagttagtcacccagcgacgttatgcttttgaacgcgctcgggagtggatgatcagttcgcagcaggaaccagaagcagtggcagaagagcttgatcatgccggcgcggacataactcgcatggaagcaaccagtagtgaggtatcccgtacaggtattttgcgtagtgccatgcttgccagaattagagagcaggcgcgacaacgcgctcagcgtgcagcggaagagcaggctcgtcgtgagcgtgagttggtagcacagcgacaacaagaaattgatcaggagaccacgcaaccagcgttcgaggtggtgcaacgacatgtacaaccggagtcggtgcagattaagcggggtagaacagttgcgctagataagcgagtgcagccactgattcgtgatgctgtggatcgagctgtgctggattcacagctgcggagtacccgtgatggtggattggggtaggcggttgattaaaaaaaaag

SEQ ID NO: 2296 - protein, 922 aa, Corynebacterium glutamicum
MSLKQAIIVRNEYTIKQANGKGSRGSSPGKYISGYMARSDAVEAVAPIVRNKLDDFIMRYMARDSAVEQLTTDSNADYDQQPEMNSRRGRQGRRATLKQRRAERSARRAALRAGVNTDSDTTNPSQPVHPRELAEFTTQDGQRVHDLMLRAQGNGGVAFGYGDVSLSHDDLHAASNNVQELYENRHTVMKVVLSFTQDYLTAHGLIPEDLDIKRAGDYRGQVDQMKLRMAVMHGVDRLAQRHYDDLRYVGVIQVDTKHVHAHLTMVDAGYGHRAADGTQKGKINKPGKAILRRGIDAWLDQHQHMAHLSAAVGYEKRNVTSYVKRWAFHQLTQESAAQFVVACLPEDKRLWRASTNAKEMDKPNRLVRELVEARLGETDSPMPAALSQVYQYAQKRRVKEGLSKQDTQRLIDNGREKIIEQAMNGVYSVLSAISDEQRDVSTAMLTVMRQDYEDLLDGIARKKSKDLDEQGSSGSQEVGKEEPEPSIEEFGLRLRSYSARLNHHREQREAFAVKKRSWEDANSQGLADPTSQVMWSFYDTEEQYHAMCQSKYQHFLTFAPPVGQWEKQWAEVADYGKRVVGLRALRADRSLARMSDERAAEALGRQLYDQPGGGLLARTGAEGKAGRAVLDGRIERMMVTYQQKIDDLRREWAQLGARLEVEGDAVLMDAADLRESGGEGADERQIQQQTIELPVADVSDSVRTYLDEELRDSRDVSAHDPVHTLRGRFQVVFRPEHDFEQVGGPDLRDLHYAWFSDQKVSQPIVCSYGELVTQRRYAFERAREWMISSQQEPEAVAEELDHAGADITRMEATSSEVSRTGILRSAMLARIREQARQRAQRAAEEQARRERELVAQRQQEIDQETTQPAFEVVQRHVQPESVQIKRGRTVALDKRVQPLIRDAVDRAVLDSQLRSTRDGGLG

SEQ ID NO: 2297 - DNA, 723 bp, Corynebacterium glutamicum
  CDS (101)..(700): RXA01544
ctagatctataacgaggatcggcgctactttaagcatgtttgtgctgttggcgccgattttttcatagctgtacacacataaggcaacaggagaaatacagtgaaacttgacgacgctatggtcatgatcgaacagcgcctggtcaaaggtcgcggcgcaaccaagacgcaactagcaccctatgagcatatccagcgcaatattgcagcccgagggttgagagccgatgacggaggctcgtgcttcggttatggggatgcgtcgctgagtaatgacgatgtagcaactgctgcagaagatattcaggatttgtttgcgtgcgggcatacggttatctcagcgattgtcgtttttgataagagctatctcagtgagcatggaatcatgagctttgatccgaactattttggtcaggatatttatgcggacacccatccagagattgatctcatggaattgcgtttagccgtgatgaatgggctcttggggcttgagggaacgttttttgaggatatgcgttatgtcgcatctatcgaggtgagccggagctatgtctatgcgcacataatgatggcggatgcaggcgttgacgatgcacgcggtaatgcacaggtgaagattacggacaccgaacgagtgctgtttagacgtggtgttgaatcccggtttgtggagcaagaggcacgcaacgtcgtgctttagccaaggtgaggcatcaagag

SEQ ID NO: 2298 - protein, 200 aa, Corynebacterium glutamicum
VKLDDAMVMIEQRLVKGRGATKTQLAPYEHIQRNIAARGLRADDGGSCFGYGDASLSNDDVATAAEDIQDLFACGHTVISAIVVFDKSYLSEHGIMSFDPNYFGQDIYADTHPEIDLMELRLAVMNGLLGLEGTFFEDMRYVASIEVSRSYVYAHIMMADAGVDDARGNAQVKITDTERVLFRRGVESRFVEQEARNVVL

SEQ ID NO: 2299 - DNA, 1374 bp, Corynebacterium glutamicum
  CDS (101)..(1351): RXA01545
ataagaaccgacacgacgccctcaacgacgctgttgcagcagctcgcaactagctagttaccacgcctgacacacgatacgtagagaaaagagaaatgatatgaagcttgcaggttttaacaccaattcacccgcagcgcagcgggttgccgaacagggtgaaaaggtacagctcgatgcaccggtgtacgcggtgtttaccccagatgttgttgaagttgagtttattggcacgcagcatgagccggtattgcacgttgagggtgccatcgacagcgtgactgcattgtcgcagctaccgtacgacattcaaaaaattacgtttgattcagaaaaccaacagcgttttagtggattttataaattcagtccacagcagcataaagagctcattgataaaggtctgtatctagaaggtttccagccaccgcgcgagatgatgacgagcctgccgtgggaactacccatgaatgccgatgtcactgtcgtggcaccagagtcgcaggatgcgccaccgattgtgcttgtgggcttatctgagattcatggtgtggattttagtcaagaatcctctggctatgagctcaccagcatgtttgaggactaccgtagccagcgtgaagcgggcgaggcggacaaggatttctctgagtcaatttctcgtgcagagattgaaggcaaagatattttcgctgatgctaaccgcacccgtaccggtgtcagtgcacatgcacagcgccttgagcaggagcgagcgctgagcgcagcacagttgatggcgaaacttgctggcatttccttccagactgaacccgtgcttgttggtgcggaagagagctttgatgctgagcaattcctcgcccatgatcttgatgacaccgctggtatgagtgagtgggagcgcgaggttaccgagttctacaacgagaagattcgcgcccaggagcctgtggtggagcgggaggctgagcgggatagcgatattgagactgaggttgatgcagcaccaactgtcagtgctgcagagattaacgatgttattcatgatcttgatgagcttgaattcgatgacgtgattgatcttgatgcagatgatgttgtcaataccgccgaggtagaggcgccagcaagtgtcagtgctgcagagatttctgcgacagagcttgattttgatcgcgagtcacgggctaagaccgcgcagcgagaagccagccgacgtgttgcacagaagattcagactcaagaatctgtgcgtgaggcatatattcgcgagcaaaagcatggctatgacgcatcacctgcggaggggcgcaagtttgatgagaaaattgcagaacgcgggctagatctataacgaggatcggcgctacttta

SEQ ID NO: 2300 - protein, 417 aa, Corynebacterium glutamicum
MKLAGFNTNSPAAQRVAEQGEKVQLDAPVYAVFTPDVVEVEFIGTQHEPVLHVEGAIDSVTALSQLPYDIQKITFDSENQQRFSGFYKFSPQQHKELIDKGLYLEGFQPPREMMTSLPWELPMNADVTVVAPESQDAPPIVLVGLSEIHGVDFSQESSGYELTSMFEDYRSQREAGEADKDFSESISRAEIEGKDIFADANRTRTGVSAHAQRLEQERALSAAQLMAKLAGISFQTEPVLVGAEESFDAEQFLAHDLDDTAGMSEWEREVTEFYNEKIRAQEPVVEREAERDSDIETEVDAAPTVSAAEINDVIHDLDELEFDDVIDLDADDVVNTAEVEAPASVSAAEISATELDFDRESRAKTAQREASRRVAQKIQTQESVREAYIREQKHGYDASPAEGRKFDEKIAERGLDL

SEQ ID NO: 2301 - DNA, 819 bp, Corynebacterium glutamicum
  CDS (101)..(796): RXA01546
atagttagttggtgactagctattgggggttttgtcttttaatattataaaaagaaagtgacaaacatacttgcattaaaaaggaattgagataggcactatggcacgagcgaaaaataagaaacagcgtcaattgcagcacgctcatgatgcagcacaggctgagattgcagaagcggtagcggttaacacggttgaaccaattaatgcacgcaccggtggatggccttcgtgggtcgataaggtctggaagctcactggttcacttggtggttggtttgctttcctggtttttgccatcgccgtgtggccggtagcgatccttgcagctggcactgtggtcaccatcatcggtacgtggggagtatcagtactgccaagtctggttatttccagcatcggcgcttctgctggtgtgattatctccactactgatgggttcctctttagctgggtcatcccggtgctgtttctcatgattgtgctggcactggtggtcatgaaagtgctcaatcttatttttggtgcattgtggcgcttcaccatgactttgcgacaggggttatacgcaggtcgtgaaaagatttctcgcgacgacgcgaagcgcgcacgagcagaaaagaagctgactaagcagcaggctaaagaagccaaaaagcagcgcaaacttgatgccatttactcggctcaacaggctgaagagactctggcgcaacaggcacagtctgagccagaagagtcagacgataagaaccgacacgacgccctcaacgacgctgttgcagcagctcgcaactagctagttaccacgcctgacac

SEQ ID NO: 2302 - protein, 232 aa, Corynebacterium glutamicum
MARAKNKKQRQLQHAHDAAQAEIAEAVAVNTVEPINARTGGWPSWVDKVWKLTGSLGGWFAFLVFAIAVWPVAILAAGTVVTIIGTWGVSVLPSLVISSIGASAGVIISTTDGFLFSWVIPVLFLMIVLALVVMKVLNLIFGALWRFTMTLRQGLYAGREKISRDDAKRARAEKKLTKQQAKEAKKQRKLDAIYSAQQAEETLAQQAQSEPEESDDKNRHDALNDAVAAARN

SEQ ID NO: 2303 - DNA, 786 bp, Corynebacterium glutamicum
  CDS (101)..(763): RXA01547
tgcagcgggcactagagatcgctcagctgaacaaacaggagaacagataatgacgacacgaaatgtagataaccagagtggtgtaactgaggacgagccgatgttcgatcaggtcaagcgcttttttgttcgcaatatcgtcatgatcattgcgttgatcttggcagtggtggtcattattgttgccaccagcacctctgcggatcgacatgctgtacttaagcgtcaaactggtgagattatggccttgcaacaggaacgtgatgcattaaacagtaagcttgagggccaacttgagcaggtggtgcgtgacgctaccggtggtatggatattgaacacaaggctgcagatgatgctgttgttcgagaatttttgtccatggcgctgacgtgggacagcgtgcgcgactaccttgatgtgcgcgagcaagtgatgcgggtttatgacctggatgaagaatcacagtttatgtcggtgtttatgcctggtgaaatggcgggcattgctcgcaccgatccaactggcgaagtgcactatgcctatgatgcagatctgtccaaccgctttagcagcttagaatccgtggttactcgcattaatggtacagagtacagctatgtatccacggtgacgatgaagtcgaagcgctctggtggtgaggcagaaacaacctctacctcacgccttgcctatgacgtgatcgacggcaaaattcgtaacctcgaagcacgtactgtccccggtggtgtgaaatactcgggctaaaagtttctggggcaaccccc

SEQ ID NO: 2304 - protein, 221 aa, Corynebacterium glutamicum
MFDQVKRFFVRNIVMIIALILAVVVIIVATSTSADRHAVLKRQTGEIMALQQERDALNSKLEGQLEQVVRDATGGMDIEHKAADDAVVREFLSMALTWDSVRDYLDVREQVMRVYDLDEESQFMSVFMPGEMAGIARTDPTGEVHYAYDADLSNRFSSLESVVTRINGTEYSYVSTVTMKSKRSGGEAETTSTSRLAYDVIDGKIRNLEARTVPGGVKYSG

SEQ ID NO: 2305 - DNA, 1131 bp, Corynebacterium glutamicum
  CDS (101)..(1108): RXA01548
ggcgtgcgagctgctggttggcgcttgtgcaccccgtttttgtgtaataacttatattctagaaacttcaataacttagtaactttaaaaggggtttaatatggctgagaataatggcgggtcggatgaccttaagcccatctctgtcgatggggtcgtcaatggggaagtgcgcagcgacaaagaaaagcaggcgttcgagaagattaccggtgatgatctgcgtcgtcgtgcagaacaaatccgtaaacgtcgtttagcaaaagcgcaagaagatgcacgtaagcgtaagccattgtttggtttgggtcgtatcgctgtcacagtactggctggcgccgtatttattggtacaacgttgtggatcagtaccacctcgggcggctttgacgacaaggtgagtgcaaacaatgagcagattgtcactctgcgtaatgaagtcaacgacttaaaaaacactgcagagacaatgcccaaaaaagagactcttgctagtcaatttgacgcagcaacctcacgtgcacagaatgtggctgacttacagaatcagttagccggcattattaccagtgttgatgatgatgccgcgaccgagcagttcaagacaattgttgatgagctgaaaccgaaattcacggtctctgctggtacgacaggtgaatttcctgcggcgggtcgttggtaccagccacaagaagttgttgtcggagataacaaccgacccacctgggcgccgatgggggctgagtcctggggatggactgtgacccctacactgtcgatgtcagataccgagcacgttgtggtgatgtgggaggcccgcttgaccggaggtgagcgttacggtgcgctgttggcgtgggtgacagccgattacaacatcaacaccggcgtgtttagctcgctggcgttggcgcatacctatgaaggacaccagcgtattggtgcaaccacctcaccaagtgaatttggtgcccacggcacaaatgcagaggcgagcgctgcacgtgctggcagtgaaggcggggggcttgagggcgaggctattttcgttgatgagctgcagcgggcactagagatcgctcagctgaacaaacaggagaacagataatgacgacacgaaatgtagat

SEQ ID NO: 2306 - protein, 336 aa, Corynebacterium glutamicum
MAENNGGSDDLKPISVDGVVNGEVRSDKEKQAFEKITGDDLRRRAEQIRKRRLAKAQEDARKRKPLFGLGRIAVTVLAGAVFIGTTLWISTTSGGFDDKVSANNEQIVTLRNEVNDLKNTAETMPKKETLASQFDAATSRAQNVADLQNQLAGIITSVDDDAATEQFKTIVDELKPKFTVSAGTTGEFPAAGRWYQPQEVVVGDNNRPTWAPMGAESWGWTVTPTLSMSDTEHVVVMWEARLTGGERYGALLAWVTADYNINTGVFSSLALAHTYEGHQRIGATTSPSEFGAHGTNAEASAARAGSEGGGLEGEAIFVDELQRALEIAQLNKQENR

SEQ ID NO: 2307 - DNA, 1101 bp, Corynebacterium glutamicum
  CDS (101)..(1078): RXA01552
actttgctctttttatggcgctgcacgagattcaactcaaagtgaaggtcagctatttgaactcagtgcaaaagatgatcggcataccaaactaatgaagatgtatctgggaatgaaagaagattccctagcgccaccccaaaatagattcgagtctcataagactgtcttttccctaaaacagaaaaacatcccaattaaggatgctgctaaatctgatcaggtgaatctcacttggcatgattatccaggtgaatggtttgagggtggagctgtaacggactcggaaaagcaggataaagttgaaacgtttagaaacctgctgggctcagatgtagcgctatttttagttgacggtcaaaagctgcatgattacgccaatgaagaggagcgctatcttagctatttatttgatggattcattgaaaacctaaatcagatcaaagatgcaatcctggagggtgggaaacagctccaacagttcccacgaatttgggtaattgctttatccaaagctgatctatggccagatctccaagtaaaagattttgagaatctacttaataagaaagctggcaatgaaattattgcgctgcgttcaaagcttttggagtttatcgataacgacgaagctttctccttcggtaaagatttccttttgctctcttcggcgaagttcactccaggccatattgatataagccagcgcaagggtgttgatgtcctcctcccgttggcttgtgtattgcccatgcaacgccatttgtggtggcaggagctgaaagttttgccaattaacctggctgatatacttttgggaaatgaaattgcccaaatgggtttcaagatcgtttccaaagttttgaaaaacaaagtatctggaacaaataacaaggcgatggcggcattggttttcgctgaacttgtgagggatatggttgatcagccaactgaattgcttcagaaggctcgtgaggaagccgtcggaaggcgtgaattccttaaagcgattactgcagaattcaccaggaagctgaatcaagccgaagctgatcaggttttagttcgggactttgcatgacactcatgtgggcaacccgt

SEQ ID NO: 2308 - protein, 326 aa, Corynebacterium glutamicum
MYLGMKEDSLAPPQNRFESHKTVFSLKQKNIPIKDAAKSDQVNLTWHDYPGEWFEGGAVTDSEKQDKVETFRNLLGSDVALFLVDGQKLHDYANEEERYLSYLFDGFIENLNQIKDAILEGGKQLQQFPRIWVIALSKADLWPDLQVKDFENLLNKKAGNEIIALRSKLLEFIDNDEAFSFGKDFLLLSSAKFTPGHIDISQRKGVDVLLPLACVLPMQRHLWWQELKVLPINLADILLGNEIAQMGFKIVSKVLKNKVSGTNNKAMAALVFAELVRDMVDQPTELLQKAREEAVGRREFLKAITAEFTRKLNQAEADQVLVRDFA

SEQ ID NO: 2309 - DNA, 2265 bp, Corynebacterium glutamicum
  CDS (101)..(2242): RXA01554
tggcttaaaccttatttgtagttgtcaataaatatgaaattccttagcaacttgtttaaatagacgtataaacaagtttgaaaaaggaaggttatccatcttgaaaaagcatgtgacctcagccgttaccgccgtggtgacggctttttcaacggctgcgcttggtttaagtattgccgtttctcctgctgttgcccaagtggctaatccagctccagatctttctgcgccgtatacatgggtggaagagtttgattccgaggatgctctcaaagggtggaacattttccgccagccagattatggcagcgacaaagttctctataccgaagatgctttaagtatcgaagatggcaagctcaccatcaccactcagcgccactgcgttgacgaagacttcgcgatcagtgatcctgtcaaccgcggaaagctcaatgacagcaccgcgcaagttgaaccttgtgctccaggtcagtttgaaaagttcaccagtgcgcgcatcgtcactccgaaaattgctcgtggagagttcgacctttctgtcactgcaactcttaacaccggtggcgtcgaaggtgtccgaagtgccatttggatgcaaaacggtgaacaggcgtgttcctcagcaaccaacaatggcctctacggagaactagacctggtagagcacttttcttacgatcttcgctcgccatggtctccatcaaacacccacttgggttgtgatcctgaaagtgtcaacggcaccaaccgtgcacctcgtgaacttaaactagatgagtcactcgatggcgtggagcacacctggactgtgagcaccacccgcgacggcgttgagtacttcattgatgatgaggcgattaaccgccagtcatggcgcaacgatgtcactttggggcatgccgaaattgatgatttcgggatctccgcgcagacgtttgatgagatcgtcgaccgcgaatggactctcactcttaatcaaaaggtagaaagcgccgactgggcaaaaccacgttcctctgaggaagatttcccagtccggtccatggtgattgaccgcatcgaggtcaccggatctcccgcagtatctgaagacacccccatgccagataccacccagcttttgacccaagacactctggaatacctcggtcgcatgccagtgctggaacgctacgagccagcaagtgctgattttgccgatggccgcaggccttcctggaactacttcaatttgaaggaatcgtggcagaatccagaactcgagcaacgcccagaagctgtcgaattcgttgatggacgcatggatatcgtgacccgtcgccactgtctggccaccactgatgacatcgccactccggaaaacgcacaggaggaaccgtgcgcgccgggtgaggtgacacgctacagctcagcgcgtgtccaccttccagagatccccgccggcaacttccggctcaccgtgcgcgcacgggcgcagtccgaagagcttgtcgacggcgtccgccccgctatctggatgcagaacaataccaacttctgtgctgacaacgatggacgcccttatggtgaactggatattactgagttctacagctctcgtgtgaacacccagtactcggcagtacaccttggatgtgctggcaaccgcccagagatgaagcttcgccaaatggaaatggaagagtccatgtttggggattggcatgactggggcgtcgaagtcttcgacggccagatcgtattcaccattgacggcaaggcagtaacttcctctggcaaagatgtctttggcaactctgttaccccagccgctgcacctcttcgccccgcgcacttcaagttgtcggaagaggaataccgtgaagtcatcgggcagccttggcaccttattttgaacaccatggtggagcagtctggcaaagacagctggattacagcggtcgacaataacgaggcgttcccagaacaccgcttccaaattgaccatgtggcagtagatatcgagtctgactctgtggacaatgtatggcctgacgctgcgaatgaaatcccagacaatgttggtattgaagactctgatgatggcagcgacctggaggttggttcgaccggaagctctacagctgagaccgtgagctggatctcgttgttcaccgcgttgagctcgctggtcttcacactggctctcaatcaagaagcattgcagaatttgattaatcagttcatgagacagttcaagtaatccttgtgggcgctttgtct

SEQ ID NO: 2310 - protein, 714 aa, Corynebacterium glutamicum
LKKHVTSAVTAVVTAFSTAALGLSIAVSPAVAQVANPAPDLSAPYTWVEEFDSEDALKGWNIFRQPDYGSDKVLYTEDALSIEDGKLTITTQRHCVDEDFAISDPVNRGKLNDSTAQVEPCAPGQFEKFTSARIVTPKIARGEFDLSVTATLNTGGVEGVRSAIWMQNGEQACSSATNNGLYGELDLVEHFSYDLRSPWSPSNTHLGCDPESVNGTNRAPRELKLDESLDGVEHTWTVSTTRDGVEYFIDDEAINRQSWRNDVTLGHAEIDDFGISAQTFDEIVDREWTLTLNQKVESADWAKPRSSEEDFPVRSMVIDRIEVTGSPAVSEDTPMPDTTQLLTQDTLEYLGRMPVLERYEPASADFADGRRPSWNYFNLKESWQNPELEQRPEAVEFVDGRMDIVTRRHCLATTDDIATPENAQEEPCAPGEVTRYSSARVHLPEIPAGNFRLTVRARAQSEELVDGVRPAIWMQNNTNFCADNDGRPYGELDITEFYSSRVNTQYSAVHLGCAGNRPEMKLRQMEMEESMFGDWHDWGVEVFDGQIVFTIDGKAVTSSGKDVFGNSVTPAAAPLRPAHFKLSEEEYREVIGQPWHLILNTMVEQSGKDSWITAVDNNEAFPEHRFQIDHVAVDIESDSVDNVWPDAANEIPDNVGIEDSDDGSDLEVGSTGSSTAETVSWISLFTALSSLVFTLALNQEALQNLINQFMRQFK

SEQ ID NO: 2311 - DNA, 453 bp, Corynebacterium glutamicum
  CDS (101)..(430): RXA01560
atgggagcaaggctcatttagctacttcgacgtggaagcgcacatcgttgagttgattcctgcatcagtaagcgatgcgttttaggcacatctgcgatccgtgggcgtgtcctacatcatcgccggcgatgagcagctggatatggcagaagccgttcgcaaaattggggagacctttaaaactgaggaaattatccttggtggcggaggaaccctgaactggtccatgctccgcgacggtttgtgcgacgaggttagcatcgtgatgatgccaatcgccgatggtgaaaagcacacccactctttgttcgaagccgatgaaaaatactcagcaccgttgccgatcggtttttcactcgccagcgttgaaccactagaagatggaagcgtttggatgcgttacggggtcaatggcccagtggacgcgaactaggtagcaaatactcgctcttt

SEQ ID NO: 2312 - protein, 110 aa, Corynebacterium glutamicum
VGVSYIIAGDEQLDMAEAVRKIGETFKTEEIILGGGGTLNWSMLRDGLCDEVSIVMMPIADGEKHTHSLFEADEKYSAPLPIGFSLASVEPLEDGSVWMRYGVNGPVDAN

SEQ ID NO: 2313 - DNA, 1143 bp, Corynebacterium glutamicum
  CDS (101)..(1120): RXA01575
gctgttttttgatgcatccatgataggaatagagcctagtgcatgatggctgattttcctgttaggtgccaccgaccccagtgatgataacttgattgtcatgaaatccattgatcttgagcagctggcgggcacgcaatcgcgcacgtatcaatcgcgaaagatcaccgatgagatggtcgcccggccggtgcatgtggcgatcgcgctgtgggaagtgccgtgggagtcggcaaaatccggcaagattgagggttgggtcattgccgtggattcgccgcgtgggcggtttgtgcgcagcgggcagaccaaaaatggcgacgccgtcaaccggactgtgtcgatgctgaaatcagcgttgaaaggggtccgcgggaaggcgtggattgtaactgggcgtcgacaagcagctttacgcgcagccctggtgcgcgaaaactacctggtcaccggaagcttcgccgagcaaaatagggccggcgtgaaggcgtcggcgatctcgcgccgcgccgaacaatccgcgctctacaaggcgaaaaaaatcggcgaattcgccgagcgcgccccacgcgtcaaagagcggcaagaggcacattggtggccacggttgtcacgcacgcaaggcaccgcaggcgttttacgcttagcgacggacgcctctaccgatggggtcttccgcggcgccatgtgcttcgtagcctcaaacggcgactacctcctggagacccaagacaccaccgcaagctccgacgaattagaactcgaaagcatcacccacgccctgatctacctcaaaaccatcggcgcgacccaagccatcatcgaatccgacagcaaagccgcacttgaagccatcgacttcatcctcaacaaccgaccgcgccggggcaggtggcgcggcatcaccgcatgcgcccgcaaccggttccgggatgcctgggaagcgcttatcgacgactgcgttgtggaattatcccgcgtactagggcacgccggggatccactgaaccaagcagccgaccaaatcgcatacatgggcatgcgcgccgtaatttttgaacaaaaatccgcacaccccacattgctcaaaggaattgacaaggcgcttcgcaaggccgagtaaggtgggcaacgagtcggtga

SEQ ID NO: 2314 - protein, 340 aa, Corynebacterium glutamicum
MKSIDLEQLAGTQSRTYQSRKITDEMVARPVHVAIALWEVPWESAKSGKIEGWVIAVDSPRGRFVRSGQTKNGDAVNRTVSMLKSALKGVRGKAWIVTGRRQAALRAALVRENYLVTGSFAEQNRAGVKASAISRRAEQSALYKAKKIGEFAERAPRVKERQEAHWWPRLSRTQGTAGVLRLATDASTDGVFRGAMCFVASNGDYLLETQDTTASSDELELESITHALIYLKTIGATQAIIESDSKAALEAIDFILNNRPRRGRWRGITACARNRFRDAWEALIDDCVVELSRVLGHAGDPLNQAADQIAYMGMRAVIFEQKSAHPTLLKGIDKALRKAE

SEQ ID NO: 2315 - DNA, 498 bp, Corynebacterium glutamicum
  CDS (101)..(475): RXA01577
ccgtagacatcctctacaccgaatactccatgagcaaggggcaatccctgctcaacggcgtaaacatcctggccgacggcttcctagcgaggagactcccatgacgcagaccaccacccaaatcatcatccagatactgcttctcctggcaaccgcagcactggcactatatttcctccgaaaccgccgcaaagcccgcgccaaagcatgggtgaaaatcggcttcgtagtattcattttcgccgcagtatgggcagtgctccgccccgatgacctcacccaactagccaactttgtgggcgtggaccgcggcaccgacctaatgctttacgccctggttgtggcatttatgttcaccacgctgtccagttatgtgcgtttccgtgaacaagagctgcgttattccaagctggcccgcgctgtcgctttgcaaaatgtggtgctgccggaggattcccagggttctgaccccgcttaggaaagcgcttggcctctgga

SEQ ID NO: 2316 - protein, 125 aa, Corynebacterium glutamicum
MTQTTTQIIIQILLLLATAALALYFLRNRRKARAKAWVKIGFVVFIFAAVWAVLRPDDLTQLANFVGVDRGTDLMLYALVVAFMFTTLSSYVRFREQELRYSKLARAVALQNVVLPEDSQGSDPA

SEQ ID NO: 2317 - DNA, 507 bp, Corynebacterium glutamicum
  CDS (101)..(484): RXA01579
tggcagcatcctgcgcaaggttgggcagcagaccattcattacggcgaatacaccggtcattgtgagaagggtgctcagcagcaatgcccaggtgcgtcgttgaccgaggtattcaacactgaccagcgggtgcttaacgcgcttttcaatgttgtagaagaagatgactccggcgataccgatgatgaacagcacaaccaccagaatccagttcgcggcaccgagtttgccggcctcgttgaaagccatgagcaaagatccaatggacaccgccagtggcagcacaccaagccagtccatcttcggggtttcttcagcggtggattccttcacgctgaaaggcagtgcgagggcagcgacagcgcagaaagcagccatgacccagaagatggaacggaaaccaagtgtttcagccaaccagccaccagcaagcgcgtccacgccgccgataccaccgttgacagaggtaacaattccgagaagtagcgcatattgcttttcattgg

SEQ ID NO: 2318 - protein, 128 aa, Corynebacterium glutamicum
LTEVFNTDQRVLNALFNVVEEDDSGDTDDEQHNHQNPVRGTEFAGLVESHEQRSNGHRQWQHTKPVHLRGFFSGGFLHAERQCEGSDSAESSHDPEDGTETKCFSQPATSKRVHAADTTVDRGNNSEK

SEQ ID NO: 2319 - DNA, 750 bp, Corynebacterium glutamicum
  CDS (101)..(727): RXA01585
tgcagactgctgcgccccgttccatcagcaaggtggagcgcaaggtgctgaccgctgtcgctactgatgaggtgcagtcgcaggaagctctagaaaagtagtggttgagactctttctatcacctcaggtgcggctggcctgcaggcgcttgttgcgcgtgcggttggtttgaatgagttggcgagcgcgcgtttccgccagctcacgccagaggtcgttgatgtttttgtcaccactccgttcaacgtgacggcgtcgcgccgggtatttggtgtggcgggtcgcgatggcgctgcagttggcgcgaaggatttgctgcaggcactcagcgagggccgggaagacgtaggcacctcccgcgacgccagctggccgggctcattgccgccagccacgggctttacgcttgtcgacgaactccccacccacgtggtgcgcactttggctgatcagggtcaggcattggctcgccagttctccggcccgcttggccctccggcttcgttgatggatcaggaagttatttcagcagaaggcaatggcaagaaggccggaatcccgatgcgcacggtatttacctgcacttcgcttggtttgatcccaggttttgaggcagccaatgatgtgccgaggcacctgcgggtatcggtgaatggtcgttggacccgcgttgatgctccctatggcagtgtttatcactcgtcaggtttgggtctgagcgttttctaaagcaagacccagcctgcaag

SEQ ID NO: 2320 - protein, 209 aa, Corynebacterium glutamicum
VVETLSITSGAAGLQALVARAVGLNELASARFRQLTPEVVDVFVTTPFNVTASRRVFGVAGRDGAAVGAKDLLQALSEGREDVGTSRDASWPGSLPPATGFTLVDELPTHVVRTLADQGQALARQFSGPLGPPASLMDQEVISAEGNGKKAGIPMRTVFTCTSLGLIPGFEAANDVPRHLRVSVNGRWTRVDAPYGSVYHSSGLGLSVF

SEQ ID NO: 2321 - DNA, 392 bp, Corynebacterium glutamicum
  CDS (1)..(369): RXA01586
aacaacgcggcgttcattgagatcgcgcaggaagctcgattggcgtttgcggaggatcagttccgtgagcgtggctatgagatccctgctgtgtttgtgcgccacttggaagttgattatttgcgtgcgatcttgccggataccacccaggctgtcgtggagacacaggtgaccaagatcggtaatacttccttcagcactcgtcaagaggtcaaggatcgtaacggtcgtgtgtgctgcgtggttgagtgcgtgcaggtggctgtcaatgtgcagactgctgcgccccgttccatcagcaaggtggagcgcaaggtgctgaccgctgtcgctactgatgaggtgcagtcgcaggaagctctagaaaagtagtggttgagactctttctatc

SEQ ID NO: 2322 - protein, 123 aa, Corynebacterium glutamicum
NNAAFIEIAQEARLAFAEDQFRERGYEIPAVFVRHLEVDYLRAILPDTTQAVVETQVTKIGNTSFSTRQEVKDRNGRVCCVVECVQVAVNVQTAAPRSISKVERKVLTAVATDEVQSQEALEK

SEQ ID NO: 2323 - DNA, 1083 bp, Corynebacterium glutamicum
  CDS (101)..(1060): RXA01595
aatacttcctgtggctggttaaagatggtggcgcttcaatgccggatgaccagcaattgtcggcaatgattgacacggctgtaaaggaaggtccgcaataatgactgcacccacgaacgctggggaactcaggcgagttttgctggttccacacaccgggcgttcttccaatattgaatccgccatcttggcagccaagctgctcgacgatgctggaatcgatgtgagggtgctgatcaatgatgcagatgatccaattgcagagcactccgttttaggccgtttcacccatgtcaggcacgctgcagacgccgctgacggcgcagaactagttctggtgctgggtggagatggcaccttcctccgcgcagcagatatggcccacgctgttgatttgcctgttctgggcatcaacctaggccatgtgggattcttggctgaatgggagtctgactcacttgaagaggcactcaaacgtgtgatcgaccgcgattaccgtattgaagatcgcatgaccttaactgtcgttgtcctagacggcggtggagaagaaatcggccgaggctgggctctcaatgaggtcagtattgaaaacttaaaccgcaggggagtgctcgatgcaaccctcgaggtagatgcacgaccagttgcttcctttggttgcgatggcgtgctgatttccaccccaaccggctccaccgcttatgcattttccgccggtggtcctgtactgtggccagaactcgatgccatcttggtggttcctaataacgcccacgcgctgtttaccaaaccgctggttgtgagcccaaaatccaccgtagctgtggaatccaattcagatacttcagcagcgatggccgtcatggatggtttccgtcccattcctatgcctccaggatcccgtgttgaggtcaccaggggtgagcgtcccgtgcgttgggtgaggcttgattcttcaccgtttaccgaccgacttgtgagcaaattaaggctccccgttaccggttggcggggtccgcaaaaacaggcggaaaataaagatcccaggtcagcggggtaattcgaaaaccattcgaacaa

SEQ ID NO: 2324 - protein, 320 aa, Corynebacterium glutamicum
MTAPTNAGELRRVLLVPHTGRSSNIESAILAAKLLDDAGIDVRVLINDADDPIAEHSVLGRFTHVRHAADAADGAELVLVLGGDGTFLRAADMAHAVDLPVLGINLGHVGFLAEWESDSLEEALKRVIDRDYRIEDRMTLTVVVLDGGGEEIGRGWALNEVSIENLNRRGVLDATLEVDARPVASFGCDGVLISTPTGSTAYAFSAGGPVLWPELDAILVVPNNAHALFTKPLVVSPKSTVAVESNSDTSAAMAVMDGFRPIPMPPGSRVEVTRGERPVRWVRLDSSPFTDRLVSKLRLPVTGWRGPQKQAENKDPRSAG

SEQ ID NO: 2325 - DNA, 792 bp, Corynebacterium glutamicum
  CDS (101)..(769): RXA01600
tgagtacaaatctcgtccaacccatgctcatccactgttttacggcctggtgaagaccgctttggagctgcgtgtccacccttagatctacaatgtgatcatggtttcgaagatgcacattcccggtacccatgagttcacggtgacagatactgaactgttgttagagtccccaattttgggcgttcgtcgagattcattgatcatgccgggtggttccactgcccgccgtgaagtggttgaacactttggggcggtcgcagtggttgcctttgatggtgaaaacattgcgatggtcaagcagtaccgtcgcagcgtgggggattccttgtgggagctgcctgcaggtttgttggatattgctgatgaggatgaactcacgggcgcgcagcgcgagctcatggaggaggctggtttggaggccagtgagtggtccgtgctcactgatttgattacctcgcctggtttctgcgatgaagcggtgcgtgtctttctagcccgaggcctcacaaaggttgagcgcccgaaggttatgggcgatgaagaagcggacatgattaaccagtgggttccgctacatgaggcagtgggaatggtgtttagtggccagttggttaactccattgccattgcgggtgtcatggctgctgatgctgtgattgcgggtcgtgcgtctgcgcgtgccgtcaccgcgccgtttacctatcgccctacggcgttggcgcagcgtcgaaaagcgcacggcattgttcctgacatgaaaaaactatgaaggctcgcgttttagcgaaa

SEQ ID NO: 2326 - protein, 223 aa, Corynebacterium glutamicum
MVSKMHIPGTHEFTVTDTELLLESPILGVRRDSLIMPGGSTARREVVEHFGAVAVVAFDGENIAMVKQYRRSVGDSLWELPAGLLDIADEDELTGAQRELMEEAGLEASEWSVLTDLITSPGFCDEAVRVFLARGLTKVERPKVMGDEEADMINQWVPLHEAVGMVFSGQLVNSIAIAGVMAADAVIAGRASARAVTAPFTYRPTALAQRRKAHGIVPDMKKL

SEQ ID NO: 2327 - DNA, 1653 bp, Corynebacterium glutamicum
  CDS (101)..(1630): RXA01602
tgcaggccacatgcctcccagtgccgtctctgcacgttgattttcccctgccacgactggtcgcagggcgactttctagcacttttaaaggaattttttaatggctaaaacccatattcggttacaggacctttccctgtcatacacctcaaccccgttaattacgaagctcaatatcactgtttcttctggacagtgcgcagtgattgttggtgagaatggtcgaggtaaaaccacacttctgcgagcactggctcgagaattcccgccatctgcaggtgagattctcactcatggcacggtagcaattgctcatcaacacatgcctgcaggtgatctgtccgtcggagagatctgtgatgaggcaattcgtgattcaaagaatgctctcgaagagcttgagagagctggagctctacttgagacaaacactgcgcacgcacttgatggatatcaacaagcccttgatgccgctgaagtgcttgacgcatggaacgctgaacatcgattagaaaaagctctgcgcagctttggcgcgatcaccgatagatcccgtgcactcagtgagctatcgatcgggcaaaggtatcgggtacggctggcctgcctcatcggtggcgatgctgatattttgcttctcgatgaacccaccaatcatcttgaccggggcgcgcttaactatctcaccgaagccataacctcccacaaaggtgtggtacttgttgtttctcatgatcaagcactgatcaaagatgtcgcggatttcatcatcgatattgattcaaccccagacggcctaccacggatctatcatgagggttttgattcttatcgacgccaaaggagtgcgcttcttgaaacttggaggcaggattatgccgctgcacaaactgtgcaacagcaattgcaggaggatctagagcacgcacgccagcgggtgaattcttcgtggaaacctccaaaaggaacgggaaaacacactcgcgcatctcgggctcccggagtggtgcaggccttaaagcgagcacaggatgcgttggatagcaaagcgttggacgttcccccggctccggccccattgcttctgcctaccttgaaagtgcgaccagataaacccatggtggacttttcggacctttttgtaccccaccgcttgcgtctgccaggctcacattcagtggtatcaggtgacaaaatagtgatcactggtgacaacggcgctggcaaatcaacgctcatcgaagtcttgtctggggttttgactccggcaagtggttcggttgcaaaccatgcccgaactggggttctcggccaagaatcacttgtcggcgaggtgccatcaatagcacgagatcacgcagttaagtggggacttttaagtgttgaggagagccgatttgccctacaggaattctcaattggtcaacgcagaagactagatttggccatgtcgttagctggcaatcctgaactgttgcttctcgatgaaccttcgaaccatctgtctatgcacttggtttccgcacttacagagtggctggacacgaccgcggctgcagtgatcatggtaacgcatgatcgacagctactccgcgatacggctcattggaggcacatcgagttgaaatcttaagaattcgcaagggctttcac

SEQ ID NO: 2328 - protein, 510 aa, Corynebacterium glutamicum
MAKTHIRLQDLSLSYTSTPLITKLNITVSSGQCAVIVGENGRGKTTLLRALAREFPPSAGEILTHGTVAIAHQHMPAGDLSVGEICDEAIRDSKNALEELERAGALLETNTAHALDGYQQALDAAEVLDAWNAEHRLEKALRSFGAITDRSRALSELSIGQRYRVRLACLIGGDADILLLDEPTNHLDRGALNYLTEAITSHKGVVLVVSHDQALIKDVADFIIDIDSTPDGLPRIYHEGFDSYRRQRSALLETWRQDYAAAQTVQQQLQEDLEHARQRVNSSWKPPKGTGKHTRASRAPGVVQALKRAQDALDSKALDVPPAPAPLLLPTLKVRPDKPMVDFSDLFVPHRLRLPGSHSVVSGDKIVITGDNGAGKSTLIEVLSGVLTPASGSVANHARTGVLGQESLVGEVPSIARDHAVKWGLLSVEESRFALQEFSIGQRRRLDLAMSLAGNPELLLLDEPSNHLSMHLVSALTEWLDTTAAAVIMVTHDRQLLRDTAHWRHIELKS

SEQ ID NO: 2329 - DNA, 1638 bp, Corynebacterium glutamicum
  CDS (101)..(1615): RXA01605
  misc_feature (25, 31): n = a, t, c, or g
agtcaagcgccgaagaaaggcccgngaaggnaatcagacgacgggcacctactacttcggcattgaaattccgaagaacttcagcgattctattgccagcgtgaccagcgattcacccgcgccagcaaccgtcaacgcggtattcaacaacagcaacggcttcattgcctccatgctgggcaaccaggtggtcaacactgttgtggagaccatggacacggaattcggcgtccgcattgtggataacatgctcgtcggtttctccaccttgggcgacggcatgaaccaagccgccgaaggtgccactacgctcagcgatggcgtcggttccgccaacgacggtgcagttcagcttgccgacggcgcggtcaccctgcgcgacggcatcgcaagtgccaatgagggtgcgcaatcgcttgccgacggcgccagccagctcgacaccggcctcggctccgcggctacaggcagccaaacgctcgccgacggtctatccagcctgtctgcgggcaccgcccaactaggccaaggcgcaacccaggtttcagatggcgtgggccaacttgtcgaccaagtagcaccactgaccgcctatgttccagacatcaactctcagttgatcaccctgcgcgacggcgcagccaccattgcctctgaactatctgatccctccagcacctaccgctccggcgtggactccgctgtgagcgcatcccagcaactagcagccggcctgcaaaccctgaaagacggatccagccaactcagcatcggtgcacgcaccctcgctgatggcaccagccaattggccgcaggttccgaacagctagttgttggcgcacaagcactgcgcgacggcaccgtccagcttgatgaaggctccagcgaactcgccctcaaactcaccgacggcgcaagccaagtaccaaccttcgctgacggcgcagacaccaccatcgcaaccccagttgaaacagaacaagcaggagacaccacaccgctcttcggtattggtctcgcaccattcttcatggctgtcggcctgttcatgggagcaaccgttgcctggatgatcctgcacccaatcagtcgccgcgcactcgactcccgcatgggaggcttccgaggcaccctggcaagctaccttccatcaacagtcttaggccttggccaagcaaccatcatgtgggcagtactgtacttcctgctcgacctcaatccagctcacccagctggactgtggatggcgatggtcgccatctcatgggtattcatctccattacccatatgttcaacaacgtggcaggaccctccgcaggccgtgtgctgtccatcgtgatgatgtccttccagctagtctcctccggtggcctatacccaccagaaacccagccagcattcttccactggttccacacctacgacccgatcacctacgcagtcaacctcgtgcgccaaatgatcttcaacgaaaccccatccaacgacccacgcttcatacaagcaatctgggtactgctcttcatctgggcactgatgctcgccatctccaccctggcgaatagaacaaacaaggttcttcgcatgaaggactaccacccagaactgaaggtctaaaagcttttcccgcccggttc

SEQ ID NO: 2330 - protein, 505 aa, Corynebacterium glutamicum
VTSDSPAPATVNAVFNNSNGFIASMLGNQVVNTVVETMDTEFGVRIVDNMLVGFSTLGDGMNQAAEGATTLSDGVGSANDGAVQLADGAVTLRDGIASANEGAQSLADGASQLDTGLGSAATGSQTLADGLSSLSAGTAQLGQGATQVSDGVGQLVDQVAPLTAYVPDINSQLITLRDGAATIASELSDPSSTYRSGVDSAVSASQQLAAGLQTLKDGSSQLSIGARTLADGTSQLAAGSEQLVVGAQALRDGTVQLDEGSSELALKLTDGASQVPTFADGADTTIATPVETEQAGDTTPLFGIGLAPFFMAVGLFMGATVAWMILHPISRRALDSRMGGFRGTLASYLPSTVLGLGQATIMWAVLYFLLDLNPAHPAGLWMAMVAISWVFISITHMFNNVAGPSAGRVLSIVMMSFQLVSSGGLYPPETQPAFFHWFHTYDPITYAVNLVRQMIFNETPSNDPRFIQAIWVLLFIWALMLAISTLANRTNKVLRMKDYHPELKV

SEQ ID NO: 2331 - DNA, 852 bp, Corynebacterium glutamicum
  CDS (101)..(829): RXA01610
cattaatcacatgtggttaatgccttttttgattgcgtagactaggaaggtacgtcaacttccatatctttagtttgcgaaagcgatcaacttaaaacacgtgtccggttttcttactcccccagctacaccccatattcggacggcaactgccagtattgctaccgcagttgccgtagcactgtcagtgttcgctgctgcactcattccaggaagcgctctgtattctgtgctgaccgctggaggggtggcacttggagcagcatcaggcgttgccgcgttacgccatcgcggagggcttcgcatttttcaatggctgtctgcgcttggtggaatcgtcattttgctgatcggtatcgtagtggcagttgcaaagtttggggcctcggcaaaacttgccacgttaggcctggtgacctcgtattatctcatgccgtctgcggcattggcctgttatatcggagggcttggccagctaccagccaaatggattgcgccagcgtttatggctacggctggtgcaggtgctgcgggatggttttcattgggggcaggcaccggttttgaacggttcctcattgctgttgcagcggtgttttcactgatgggatgtgtatacccagtgtggggatgcgtcgtaaagcgtccacgtcaagtggctgcatggctggtcgcgctggcggccctggtgcttggggcgctcatgctttttatggtgagcatggtggtggcgccgggtttgctgtggctgcagcccacgacggtcgcatggggttttatgattgccggggttcttgcgacggtcgcaggcttgtggcctaggcgtttttagacggaatcgtctgggagggt

SEQ ID NO: 2332 - protein, 243 aa, Corynebacterium glutamicum
VSGFLTPPATPHIRTATASIATAVAVALSVFAAALIPGSALYSVLTAGGVALGAASGVAALRHRGGLRIFQWLSALGGIVILLIGIVVAVAKFGASAKLATLGLVTSYYLMPSAALACYIGGLGQLPAKWIAPAFMATAGAGAAGWFSLGAGTGFERFLIAVAAVFSLMGCVYPVWGCVVKRPRQVAAWLVALAALVLGALMLFMVSMVVAPGLLWLQPTTVAWGFMIAGVLATVAGLWPRRF

SEQ ID NO: 2333 - DNA, 480 bp, Corynebacterium glutamicum
  CDS (101)..(457): RXA01611
cccgcttacaactacttggtttacaccggtgttatcaagggctaaatcgcctaacctctatcttcatctatagcttagctttactgaaaggcttttcatcatgcgtaaattccgcaacactgcaattgcactagtttctgcagctgcaatcaccttgggtggcgttaccgctgctaccgctcaggaagacgaaactcctcctgcagcagagaccgagaccacttctccttccggttcctcaggctcttcctggaacgactacaacgaagagtacgaaggcgaccaagagggctacggaatcgacggctttggttcttcccgcgatgactccggagaagaagttccacgttggttggagacctggggcaaggtatttgacgctttgaccattacctccgttcttggtcttgttgtcttccctgttgttaacttcctgaagtacaacggcctcattaagtaatctgcaatttcctgtcaaat

SEQ ID NO: 2334 - protein, 119 aa, Corynebacterium glutamicum
MRKFRNTAIALVSAAAITLGGVTAATAQEDETPPAAETETTSPSGSSGSSWNDYNEEYEGDQEGYGIDGFGSSRDDSGEEVPRWLETWGKVFDALTITSVLGLVVFPVVNFLKYNGLIK

SEQ ID NO: 2335 - DNA, 468 bp, Corynebacterium glutamicum
  CDS (101)..(445): RXA01612
gaaaaaacgacgttggttcgtagtcgctggaaatttaataattcctccgtccccttcaactagggggtggaaacccgactatttccgaaggactattctcatgcgttctttccgtaccgcggcagttgcaggccttactgcagttgcactttccgtaggttccgccaccgtggcaactgcggaagaatctgatcaaaacctctcatccggcttctcagcactttcttccggtggcgcagcggccgtaggtgaggactgggatgcagaccagcccgtcacaggtgaagacatctttggtgaagagcacgagcgcgataacgaaaacaccccagcgtgggctaagaacatgtacgatctaaccgtcttgggtggcattgcttcccttctcggtgtcatcgtattccccgcttacaactacttggtttacaccggtgttatcaagggctaaatcgcctaacctctatcttc

SEQ ID NO: 2336 - protein, 115 aa, Corynebacterium glutamicum
MRSFRTAAVAGLTAVALSVGSATVATAEESDQNLSSGFSALSSGGAAAVGEDWDADQPVTGEDIFGEEHERDNENTPAWAKNMYDLTVLGGIASLLGVIVFPAYNYLVYTGVIKG

SEQ ID NO: 2337 - DNA, 1098 bp, Corynebacterium glutamicum
  CDS (101)..(1075): RXA01619
cctgcaagtttactgctcggccgtcacgggggaatggaaaaagtacgcttggtgttcatatagcgaacccattttctattgcgatgagaggaacaccaccatgcgcgcaatcactcacaacactttcggcgaccccgccgacgtcctacagattaccgagaaggaaattcccactcccggcccaggtcaggttcgtattcaagtgacgctggcaaccatccacaaccatgatttgtggaccgtgaagggctcttacggcttcgtcccagatctgccggccgccgcaggcaccgaggcagtcggcatcgtcgacgccctgggcgagggcgtcgaaggtttgcaggtcggtcagcgtgttgcgtccggcaccagctttggcatctgggcggagtacgcgcttgtcgacgcctccggcctcattcccgtaccagaacagctctccgacgaaagcgcagctcagctcgtcgcaatgcctttcagcgccatcagccttcttgatttcctggatatgaaaccaggggagtggctgatccaaaactccgcaaacggtgccgtcggccgcatgctcgcacagctggcagaatcccgcggcatccatgtcgttggtctcgtccgccgtgacgccggtgtccaagaactcgctgctcaaaacatcagcggcgtcgtttccactgagaccccaggctgggaaaagcaggtcgaagacatcaccggtggcgcaagcatcgccgtcgcacttgattccgtcggtggatcctccgcagctgacctggtgaaactgcttggcgaaggcggcaccctcgtctccttcggcgccatgggcaacccaatcatggaaatcccatccggccccgtcatcttcaagcacatcaccgtcaagggcttctggggaagcaaagtcagccgcgaaatgccagcagagaagaaaacccagttgttcggcgagctcattgcgcgcatacttgatggaacattgacccttccagttgattccacctttgatgccgctgacatcgtctcggccgtgcgcgcctccagcgagcctggccgtgccggaaaagtgctcattcgtttctaaacgtttaaggcccattagac

SEQ ID NO: 2338 - protein, 325 aa, Corynebacterium glutamicum
MRAITHNTFGDPADVLQITEKEIPTPGPGQVRIQVTLATIHNHDLWTVKGSYGFVPDLPAAAGTEAVGIVDALGEGVEGLQVGQRVASGTSFGIWAEYALVDASGLIPVPEQLSDESAAQLVAMPFSAISLLDFLDMKPGEWLIQNSANGAVGRMLAQLAESRGIHVVGLVRRDAGVQELAAQNISGVVSTETPGWEKQVEDITGGASIAVALDSVGGSSAADLVKLLGEGGTLVSFGAMGNPIMEIPSGPVIFKHITVKGFWGSKVSREMPAEKKTQLFGELIARILDGTLTLPVDSTFDAADIVSAVRASSEPGRAGKVLIRF

SEQ ID NO: 2339 - DNA, 726 bp, Corynebacterium glutamicum
  CDS (101)..(703): RXA01622
aaggcgtgggcgtttttgaaggagcttcgtttggagcgcggtcctttggatcgtgaagttgccatcgcagagctgaagagctggtgggaaggagaaaacaatgagtgatttttatgccgacaggttgtttaacgcgatggagcgcaatgaggtagctccaggcatgttgttggtggctgcgcccgatatggcgtcggaggattttgagcgcagcatcgtgttgatcatcgagcattctcctgccaccacttttggtgtgaacatttcttcacgttccgatgttgctgtggccaatgtgttgcccgagtgggtggacctcacctcgaagccacaggcactgtacatcggtgggccgttgagccagcaggctgtggttggtttgggcgtgaccaagccgggcgtggatattgaaaattccaccagcttcaacaagctcgccaaccgcctggtgcacgtggatctgcgttctgcacctgaagatgtggctgatgatcttgagggcatgcgcttttttgcgggctacgcggagtgggctccgggccagctcaacgaggaaattgagcagggtgattggttcgtcacacctgcgttgccgtcggacattatcgcgccgggccgcgtcgatatttggggcgacgtgatgcgtcgacaagcaatgcctttgccgttgtattccacgtttccgtcggacccttcagataattagatgagttccgaaaatttaaa

SEQ ID NO: 2340 - protein, 201 aa, Corynebacterium glutamicum
MSDFYADRLFNAMERNEVAPGMLLVAAPDMASEDFERSIVLIIEHSPATTFGVNISSRSDVAVANVLPEWVDLTSKPQALYIGGPLSQQAVVGLGVTKPGVDIENSTSFNKLANRLVHVDLRSAPEDVADDLEGMRFFAGYAEWAPGQLNEEIEQGDWFVTPALPSDIIAPGRVDIWGDVMRRQAMPLPLYSTFPSDPSDN

SEQ ID NO: 2341 - DNA, 834 bp, Corynebacterium glutamicum
  CDS (101)..(811): RXA01623
cgcgccgggccgcgtcgatatttggggcgacgtgatgcgtcgacaagcaatgcctttgccgttgtattccacgtttccgtcggacccttcagataattagatgagttccgaaaatttaaaagaaattcgcggcggaatcggtgagactttaacggtcggtttggggctgattccgctgggtttggcctttgggctgttgatggtccagacaggtttcgcctggtggtggacgccgattttctccttcgtgatctatgccggttcgatggaatttctggcaatcggcatggtcaccgcaggtatcggcccgttttcggcggcggtcgctggtttcatggtgaatttccgccacattttctacggtctcaccttcccacgccaccgcatcaagtccggcgccggccgcgcctattccacctacgcgcttaccgacgagtcctacgccatcgtgtcagcccgcccacctggcgatatcagtggcacgcgggtgcttaccgttcaaattttgtgccaagctctgtgggttatcccaggaattattggcgccttggttggtcaagtgctgcccgatgatctaaaaggcatggattttgccctgaccgcgctgtttgtggtgctggcgtgggaggcattcaaaaataacaaggattattcgctgccattattcgcggtggtattggctctggtttccggttttgtggcgcccgagcagatgctggttatcgctttgaccacgtactttttgatccttcttctccgcgtccgcttccccaacctggacaagaaactggagatcaggacttcccatgagtgagtttggcctgccagaaggcg

SEQ ID NO: 2342 - protein, 237 aa, Corynebacterium glutamicum
MSSENLKEIRGGIGETLTVGLGLIPLGLAFGLLMVQTGFAWWWTPIFSFVIYAGSMEFLAIGMVTAGIGPFSAAVAGFMVNFRHIFYGLTFPRHRIKSGAGRAYSTYALTDESYAIVSARPPGDISGTRVLTVQILCQALWVIPGIIGALVGQVLPDDLKGMDFALTALFVVLAWEAFKNNKDYSLPLFAVVLALVSGFVAPEQMLVIALTTYFLILLLRVRFPNLDKKLEIRTSHE

SEQ ID NO: 2343 - DNA, 468 bp, Corynebacterium glutamicum
  CDS (101)..(445): RXA01624
gagcagatgctggttatcgctttgaccacgtactttttgatccttcttctccgcgtccgcttccccaacctggacaagaaactggagatcaggacttcccatgagtgagtttggcctgccagaaggcgtcacgctgctcaacgtcgccgccgtgttgatccccatcgcgatcatcaccttgctgctgcgcatcttccccttcgccgcgatgaaacgcgtcaacagcaaccaactcatgggagttttggggcgcacaatgccagtcggagtgatggtcgtattggtcatttacacgctctttggccaggtcagtgcgccaggtggtgtgggtgcttcactgatcgcggtggcattcaccgcgctgctgcactggttgaaaggctccgccgggctgtccatcgtcggtggcaccttggcctacatgtttctggtcaacgtcgttttttaaaagatgcttctcgacgcaaa

SEQ ID NO: 2344 - protein, 115 aa, Corynebacterium glutamicum
MSEFGLPEGVTLLNVAAVLIPIAIITLLLRIFPFAAMKRVNSNQLMGVLGRTMPVGVMVVLVIYTLFGQVSAPGGVGASLIAVAFTALLHWLKGSAGLSIVGGTLAYMFLVNVVF

SEQ ID NO: 2345 - DNA, 1137 bp, Corynebacterium glutamicum
  CDS (101)..(1114): RXA01628
cttcccctttcagcccgttgaagaaccaatgagccctgcccgcacccagccccgagcggctttcctaaggaagctccgacccatcacatgtagcctttccttggttctcgtagggtgcagcaacacggcagagtccacgaccaccgatacggcaggctccactgaaacttcatcacagatttcacccaccactccagtcagcaccaccgaagcagcgccgcctgaagatccaagcgcaaacgctttggaagagtatgctcagatccttgccaatccaagcatctaccccttaaccgaaatttcacaattcgtccccacaggcacatatgcctacacacttgttgaagcaacttccgattccatcccagaactactactccgcgccgatagtcacgaattcgcgccaattttggttttcacctatgacgaaaacacacaatccgcaacccaagctggaggagtcctaattgacggtgtcgccagcgccggcggttcacgagtcaaggtcagagcttcaaattcaggagcaggaatctaccaattgaattggtactcgatacaaccagttggcgaaagctctttgtacggaatccaaggaaactccctgacacaaatcgcagaccccgaggatttcatggtccgtgaactattacctgaccaccacgaaattacctgggttgattccaacgacccctccggcctatcaaccgttcagactggtggagccaacattcaacaagcagccccaactcccgttcaacagcctgcgtcaaacctgcactacttctctggtgtagtaacgatgcagaccgccggcgaactcatgcgaggtgaacgaactcccaatggtgagcctgccactgatctctatctcgtactggtccttgattccccaattgaaatcacagcacgaaacgcagctacagaccctcagactcgtaccatttccgaagtcagcctcggccgatacatccccgctgatggtgacaatgattggataggctacctcgacacccacgtggaaatcactgcaacaacggatcaggtctggttcccaaccgacaccggtctacctcttggaatgcttcgtctagcggactacaaaagcatctcataaaccgacgcagcactcgtcga

SEQ ID NO: 2346 - protein, 338 aa, Corynebacterium glutamicum
LVLVGCSNTAESTTTDTAGSTETSSQISPTTPVSTTEAAPPEDPSANALEEYAQILANPSIYPLTEISQFVPTGTYAYTLVEATSDSIPELLLRADSHEFAPILVFTYDENTQSATQAGGVLIDGVASAGGSRVKVRASNSGAGIYQLNWYSIQPVGESSLYGIQGNSLTQIADPEDFMVRELLPDHHEITWVDSNDPSGLSTVQTGGANIQQAAPTPVQQPASNLHYFSGVVTMQTAGELMRGERTPNGEPATDLYLVLVLDSPIEITARNAATDPQTRTISEVSLGRYIPADGDNDWIGYLDTHVEITATTDQVWFPTDTGLPLGMLRLADYKSIS

SEQ ID NO: 2347 - DNA, 1200 bp, Corynebacterium glutamicum
  CDS (101)..(1177): RXA01630
gtaggtgagtcttcgtgagatacccccggccagtcatacagttcaaccaagctccaccacccagataaaaacctgcgggttgcgttttaggagaattcccatgagtgatcaaaaaattgttgttggcctgctaggcatcacccacccgcatgcgtcggcgcgggtgcgtgccctccgtgaaattgatggggtagaggtcgtcgccgccgcggatactgattcccgcctccagtacttcaccgacaaatatgatgttgaaccccgcgagatcgatgacgtcttgaacgacgatcgcatcaacgccatcatggttcactccaagagcaaggacatggtccctcacgccaagcgcgcgctcgcggccggaaaatccgtcgtcgtggagaagcccggcgggggaacagtggcggatcttgaggagctcctggccctcaaagaagctgccgatcctcagcgaatcgtgcaggtcgggtacaacgtccgcctgtctgaatcggttcagagattaaaagagcttctcgacgccggcctcatcggcgaagtcgtcagcgtgcaagcacgcggcgccgcaaaagtaggtgagcatatcaccgagcacctcaaccaacccgcagacatgggcggtgtgttgtggattcttggctgccacatgctcgatgcattggtggaagtcttcggagctccagaatccgtgaacgcccgagtgcataagaccgcaaaactctctgacgacaccagccgcgaagactcagcctccgcactgctgtactacccagatttctccgtcagcttcagcttcgacggccacgatgatctggaatggttcgaaagctcccgactcacggtctatggaaccaagggcatgatcgaagccggaatcctccctcagacactgcgcgtatacctcaatgagtcacgccagggctggccacagggttggaccgagtggacccagagctacttcaccccaccgtttgctcgcacagaatccaacaaattctcagagcttccagagctagaaaacatcagcaacttccgcacagaaatgcaggggtgggtgaattccattcgcactggatcccgcaatgtggcgccagttgaggatgctctcacagtcgctcgcattgtcagtgcatgctacgaatccgacaacaaccagggcatttccgtaaacatctaagaggagcactccatgaaacc

SEQ ID NO: 2348 - protein, 359 aa, Corynebacterium glutamicum
MSDQKIVVGLLGITHPHASARVRALREIDGVEVVAAADTDSRLQYFTDKYDVEPREIDDVLNDDRINAIMVHSKSKDMVPHAKRALAAGKSVVVEKPGGGTVADLEELLALKEAADPQRIVQVGYNVRLSESVQRLKELLDAGLIGEVVSVQARGAAKVGEHITEHLNQPADMGGVLWILGCHMLDALVEVFGAPESVNARVHKTAKLSDDTSREDSASALLYYPDFSVSFSFDGHDDLEWFESSRLTVYGTKGMIEAGILPQTLRVYLNESRQGWPQGWTEWTQSYFTPPFARTESNKFSELPELENISNFRTEMQGWVNSIRTGSRNVAPVEDALTVARIVSACYESDNNQGISVNI

SEQ ID NO: 2349 - DNA, 1494 bp, Corynebacterium glutamicum
  CDS (101)..(1471): RXA01641
gtgaaattaggggaattctcaccaacgctgctccccgtccccttttgctggcatactcaaagacacatttgttgggggacaattttgggggttggttattttggcaatcgataatgcgctgcgcgtgagcatccgcatagatctcaccgttggcgatgcgcccgctgctgtggctgatgtggcgctacctgcaggttcgagtctggcggacattttggatgaaattttagaactcaccgatgcaccccggatttccaggccgtgggtggctcacactgctgcgggaagtcccattgattgcgggattccgcttgcagaaacacaagtggaacaaggcagcgtggtggtcctttcacccgaaagggacttggaagcccccgtgttgcgtgatgtcgccgaagcgttggtggagttttcttccacgaaccgcgccgggcacctcgtggaattgatgactttcgcggggctcatcggggctgccgtgttaatgacaagtcctgctgcctccggaattattgtgcccggccgcatgggaatcttcgtcgcaatctgcgctctactgcttctgtggctcccacccgcgcacaccccgatccttcgaaacgtcctgccgattaccctgatcttgggcgcaggcggagcggtatcagtgctggttgcaggcacttctgggacttctcccggcgcgcttacctggacgattttcgctggcgcgtgcactattcttgccagttcgctgctggttcatgtggtgtatcgtccagcaattcttctggtggcaacactgtccacattggggctcggtctcttagtccttgcagcaaccaccactctgtggaagctcaaagctaccgaagatttcagcggtccagcagcgatcacggtcaccgcttccaccatcaccatgtgcttcgccccgaaaatcgcagcatcgctagcaggcctgcgcgtcccatcgcttcccaccgccggcgaagatctctccgtcagcgacctcaccatgactgatcccgagaaaagaataaaaacaacaaagacgcttttcgacgcccagatccttggccttggcgttttgagcgggcctttggcgttgttgtcggttaccccgggcacctggacaaccaccgtttttagtttatgcatcgcggtggcttcgctgcttcacgctaatcgtcatcaagcaccaattcccacgtggacattgatggggttatctgcccttggtttcatttccatggcgttatccgcaagccgatcaggttcactaattgcactgatcggttctgtggttatcatcgctgtgctggtcagcgtggcattgtggatcagtacagtccccacgctggaacccaccaccattgtgtggcttgaaaggttggaatcactgtgtcttgcagctagtctgccactcgcactgcatttgctggatgtatttggaatgctgcgcggtcttgatattggattcggtggataagatgcgcagactcatcgcgg

SEQ ID NO: 2350 - protein, 457 aa, Corynebacterium glutamicum
LAIDNALRVSIRIDLTVGDAPAAVADVALPAGSSLADILDEILELTDAPRISRPWVAHTAAGSPIDCGIPLAETQVEQGSVVVLSPERDLEAPVLRDVAEALVEFSSTNRAGHLVELMTFAGLIGAAVLMTSPAASGIIVPGRMGIFVAICALLLLWLPPAHTPILRNVLPITLILGAGGAVSVLVAGTSGTSPGALTWTIFAGACTILASSLLVHVVYRPAILLVATLSTLGLGLLVLAATTTLWKLKATEDFSGPAAITVTASTITMCFAPKIAASLAGLRVPSLPTAGEDLSVSDLTMTDPEKRIKTTKTLFDAQILGLGVLSGPLALLSVTPGTWTTTVFSLCIAVASLLHANRHQAPIPTWTLMGLSALGFISMALSASRSGSLIALIGSVVIIAVLVSVALWISTVPTLEPTTIVWLERLESLCLAASLPLALHLLDVFGMLRGLDIGFGG

SEQ ID NO: 2351 - DNA, 1365 bp, Corynebacterium glutamicum
  CDS (101)..(1342): RXA01642
ttggaatcactgtgtcttgcagctagtctgccactcgcactgcatttgctggatgtatttggaatgctgcgcggtcttgatattggattcggtggataagatgcgcagactcatcgcggttagcttggccgctctgtttatgttggcttccactccagcgacgagggcacaggaagtagaagctctcgcttgccccgaggtagcgatcgccgatccttcctccgcagttttagatgaacacctttcgcagtcattatcccaagctcaccaactagcaactggcgccggtgtgatggtggcagtcatcgacaccggagtatccctgcatccacgtctgccccacttaattcccggcggtgatttcgtgggcgcccaccaaagccccgatgtgccaggtgaacttatcgattgcgacggccacggcaccatcgtcgccggaatcatcgcctcccaaggaaaccccggcaccggctggccatatgacggcagctccgatccttatatcggtgtcgccccagattccggaatcatctccattaaacaaaccagctcatatgtgcgtactcgtgaagattccaacgtcggaacgctgagcaccctggcggaatccatccaccgagctctcgattccggtgcccacgtgatcaatatttccgtggtgtcctgtttgccccaatcacccgacgaggccgcatcgttccagcctctgacggatgctcttaacagagcagaacttcaaggggtgatagtggtggcagcagcaggaaacctcgggcaggattgtccagttggatctaccgtttatcctgcacattcagacactgtgctctctgtgtcggcacgttttgattctcacacgcttgcagaatattccatgcctggcaaccaacaaatcctctctgcaccaagccacattcaggctggtctatcaccgcgtggcgacggcttcgccagccacatgatcaccaccgctggcgaaagccccttcgagggcaccagttttgccgctccagttgtcagcgccacagctgcactgcttcgccagcattttccctttgccacaccctatgaaattcgtgcacgaatcttcaacagcatcgaccctgcaagaggcgctattgatccctacctggcacttactcaagaaatctatcccaccactcccctggttcatgagatcgcactaagtgttcccacgccgccggatgattctccacgggagcggggcatcctagttaccgcaatcattgttgggttgctcgcagtgttagctgtgctgatgggactacgccgaattcatcatcactcggcctttcaaaaagctagctcaagtgttatcacttaatctatgaggcaccgttcaga

SEQ ID NO: 2352 - protein, 414 aa, Corynebacterium glutamicum
MRRLIAVSLAALFMLASTPATRAQEVEALACPEVAIADPSSAVLDEHLSQSLSQAHQLATGAGVMVAVIDTGVSLHPRLPHLIPGGDFVGAHQSPDVPGELIDCDGHGTIVAGIIASQGNPGTGWPYDGSSDPYIGVAPDSGIISIKQTSSYVRTREDSNVGTLSTLAESIHRALDSGAHVINISVVSCLPQSPDEAASFQPLTDALNRAELQGVIVVAAAGNLGQDCPVGSTVYPAHSDTVLSVSARFDSHTLAEYSMPGNQQILSAPSHIQAGLSPRGDGFASHMITTAGESPFEGTSFAAPVVSATAALLRQHFPFATPYEIRARIFNSIDPARGAIDPYLALTQEIYPTTPLVHEIALSVPTPPDDSPRERGILVTAIIVGLLAVLAVLMGLRRIHHHSAFQKASSSVIT

SEQ ID NO: 2353 - DNA, 549 bp, Corynebacterium glutamicum
  CDS (101)..(526): RXA01643
cggatttcaacactttcaggatgcatctgtaactatgcccatgccacaccccatgtttatcgatgtctccttcccacccgcggagacctgtagttaacccatgggcacgatgcgagaaatggtcagtgaccgcattgaccgactacaagaagcacacgcgcgatcaaagcagaagaagttcggcttcttagttcggccaggcaccctgatccttggatggttggtcacgatcatcggtctgatcaccattccacttcccggccaaggctggctgaccaccttcattggtgtgggcattttgtctctggagcttaaatgggcgaagaacctcctggcctggggagtgcatcagtatgatcgcttcttcacctggtacggcaagaaatcattccgcttccgcatggcgatgttggcactgatgattctgctgatttgggtggtgttcatcgtgacattttggttgatgtggcacgccggaactatcccgtgggcagatgagttcttcacctggcttgggttgagccgctagcaactattcgctttgaaggc

SEQ ID NO: 2354 - protein, 142 aa, Corynebacterium glutamicum
MGTMREMVSDRIDRLQEAHARSKQKKFGFLVRPGTLILGWLVTIIGLITIPLPGQGWLTTFIGVGILSLELKWAKNLLAWGVHQYDRFFTWYGKKSFRFRMAMLALMILLIWVVFIVTFWLMWHAGTIPWADEFFTWLGLSR

SEQ ID NO: 2355 - DNA, 729 bp, Corynebacterium glutamicum
  CDS (101)..(706): RXA01645
agagggcatcacctatgaccgcctgacaatccgcgattacatctggcgctgggacaccgactggttctggtgttcacgcgcattcggcacccaaaaccccgtggtgcgcaaactctggcccagggatctgctgcgctcgagtttctattggaagatcatcggctgggatcgaaaatactccatcgctgatcgcctggaagagcgcaaaggccgcccggctagggaacgggtggtccaagacgtggaagttacgattgataaactgccagaatttttgaaatggttctttgaaagcagcgacatcgagccgctgtggctgtgcccgatcaagcttcgggaggtaccaggtagttcggttggtgctggagaaattttgagctccgctgaagcaatcgactccggtgctgctgaacacccttggccgctgtatcccttgaagaaggacgtgctgtgggtcaacatcggattctggtcctcagtgccggttgatctgatgggctccgatgcaccagagggagcatttaacagagaaatcgaacgcgtcatggcagagctaggcggacataaatcgctgtactccgaagcgttctacaccagggaagactttgaaaaactttatggcggaaccatcccggcgctgctaaaaaagcagtgggatccccacagccgattccccggtttgtatgaaaagacagtaaaaggcgcctaggatcgctcactgtaggtaga

SEQ ID NO: 2356 - protein, 202 aa, Corynebacterium glutamicum
VVRKLWPRDLLRSSFYWKIIGWDRKYSIADRLEERKGRPARERVVQDVEVTIDKLPEFLKWFFESSDIEPLWLCPIKLREVPGSSVGAGEILSSAEAIDSGAAEHPWPLYPLKKDVLWVNIGFWSSVPVDLMGSDAPEGAFNREIERVMAELGGHKSLYSEAFYTREDFEKLYGGTIPALLKKQWDPHSRFPGLYEKTVKGA

SEQ ID NO: 2357 - DNA, 942 bp, Corynebacterium glutamicum
  CDS (101)..(919): RXA01646
ggtcgtgccgtggagcgtgctgcgattgttgccgcagggaagtgaattagcaaaagagacagcgctcgcgcccacctattaaggagtatggtggccttacatgagcggattagttgacccggatagtacttttttaaagaccatcggaaaactgagcaacagcttgtccattggtcgtggagtagatcaaaaagaggtaatccccaaaggctggaacgcccattgggaggcaattacaaagcttaagagaagctttgacgcgattcctgctggggagcgggtgcgtttagctaagaaaacctccaacctgttccgtggacgctccgatgcaggtcacggcctagatgtggcagcgcttgggggagtgattgccattgatccggtcaatgccaccgccgatgtacagggcatgtgcacgtatgaagacctggtagatgccactttaagttatggtctgatgccgttggttgtgcctcaactgaaaaccatcacgcttggtggcgcagtgaccggaatgggcgtggaatccacatccttccgcaacggtttgccacacgaatcagtgctggagatggatatttttaccggcactggtgagatcgtgacttgctcgcccacagaaaatgtcgacctttacagaggttttcccaactcttatggttcgctgggatacgcggtgcggctaaaaattgagctggaaccagtgcaagattacgtccagctgcgccacgtgcgcttcaacgatttagagtctttgaccaaagcgattgaggaagtcgcgtcttctctggagtttgataaccaacccgtcgattaccttgacggcgtggtgttttcacccacggaagcctacttagttcttggcacgcaaacctcacaacctggccccaccagcgattacaccagggatttaagctactaacgctccctgcaacacccaga

SEQ ID NO: 2358 - protein, 273 aa, Corynebacterium glutamicum
MSGLVDPDSTFLKTIGKLSNSLSIGRGVDQKEVIPKGWNAHWEAITKLKRSFDAIPAGERVRLAKKTSNLFRGRSDAGHGLDVAALGGVIAIDPVNATADVQGMCTYEDLVDATLSYGLMPLVVPQLKTITLGGAVTGMGVESTSFRNGLPHESVLEMDIFTGTGEIVTCSPTENVDLYRGFPNSYGSLGYAVRLKIELEPVQDYVQLRHVRFNDLESLTKAIEEVASSLEFDNQPVDYLDGVVFSPTEAYLVLGTQTSQPGPTSDYTRDLSY

SEQ ID NO: 2359 - DNA, 1020 bp, Corynebacterium glutamicum
  CDS (101)..(997): RXA01656
tcggcaagcatggcttcatcgtcctcaaaaaagtggtctaatgcaagtgactgaaagtggatctaccgctagtccactttgtggcgttggatcatctgtcatgaccgaaactcaagaaacttaccaagcaaccactcgtgtgaagcgcggccttgccgacatgctcaagggtggtgtgatcatggatgtggtcacccctgaacaagcgcgcatcgccgaagatgcaggtgccagcgcagttatggcactcgagcgcgttcccgccgatatccgttctcagggcggcgttgctcgcatgagtgatcctgacctgatcgaaggaatcgtcaatgcggtctccatcccggtcatggcgaaagctcgcatcggtcacttcgtggaagctcaggttctggaagctctcggtgttgatttcatcgacgagtccgaagttctcagccctgccgactacacgcaccacatcaacaagtggaagttcgacgttcctttcgtctgtggcgcgaccaacctcggcgaagctttgcgacgcatcaccgaaggcgctgcaatgatccgttccaagggcgaagccggcaccggcgatgtctctgaagctgtccgtcacctgcgcaccatccgcggcgacatcaatcgcctgcgctccctggatgaggatgaactcttcgtcgccgccaaggaattccaggcaccatacgacctggtccgcgaagtcgcctccaccggcaagctccctgtggtcaccttcgttgcaggtggcgtcgcaaccccagccgacgctgcactcgtgcgccaaatgggcgccgaaggcgtctttgtcggctccggcatcttcaaatccggcaatccagccgcccgcgccgcagcgatcgtcaaggctgcaacgcttttcgacgacccctccgtcattgccgacgtatcccgcggcctgggtgaagccatggtgggcatcaacgtatccgacgttccagcaccacaccgactcgccgagcgcggctggtgatcgttggagttttagctctc

SEQ ID NO: 2360 - protein, 299 aa, Corynebacterium glutamicum
MTETQETYQATTRVKRGLADMLKGGVIMDVVTPEQARIAEDAGASAVMALERVPADIRSQGGVARMSDPDLIEGIVNAVSIPVMAKARIGHFVEAQVLEALGVDFIDESEVLSPADYTHHINKWKFDVPFVCGATNLGEALRRITEGAAMIRSKGEAGTGDVSEAVRHLRTIRGDINRLRSLDEDELFVAAKEFQAPYDLVREVASTGKLPVVTFVAGGVATPADAALVRQMGAEGVFVGSGIFKSGNPAARAAAIVKAATLFDDPSVIADVSRGLGEAMVGINVSDVPAPHRLAERGW

SEQ ID NO: 2361 - DNA, 843 bp, Corynebacterium glutamicum
  CDS (101)..(820): RXA01665
aggattggcgcccgtgacgctactgaaaaggtggaggggcgcgtcgaaaagcgttggccggtgcttgagcgaaaacccgtgatgattagcatggtttgttgtgaagatcgatgaattgattgctctcgccgcggagcaacccactcgcatctccaggcgttccggtgtctcgcgctcgaccctgaagcgggtcggcgatggcaccagcgagcccaccctgtcgacgctgcgtgaggtcgcgttggcgctcgggcttgatattaaggtcgccgcgcaccacgcctgcgatccctttgcggccgctgcagcgcgcacgcttatcgacgcctccgtccccgaaaatccccacaaccaggaaattctcgcttggttgcaccgttttgagcggtggaatatcaacgatccgctcacccttgtctctgaagccggaacgcttcagggcatcacacatcgccaggatgcgcagtttgtgaaactcaatccacgcggcatcgctgagctaccggagcttttccaacagcacaaaaccaaatgggcgctgtcgggcgctgcggctgccacggtgatcatgggacaaattgtgctggggaattcgattgtgtggcacgaacctgcccacgatctcgatgtctcagcgctgggcaccattgttgatgtggcagaagacgccgatctaattctcctgcccgcaacggtcacggaactggtgggaagttacacccaggacaggctaaattttgtggcacctgtgcaattagttattgatctacacagcctccacatgttcgaggaagccgattacctcacgagcggttggcgctaaaatacttagcgtacgcaccc

SEQ ID NO: 2362 - protein, 240 aa, Corynebacterium glutamicum
VKIDELIALAAEQPTRISRRSGVSRSTLKRVGDGTSEPTLSTLREVALALGLDIKVAAHHACDPFAAAAARTLIDASVPENPHNQEILAWLHRFERWNINDPLTLVSEAGTLQGITHRQDAQFVKLNPRGIAELPELFQQHKTKWALSGAAAATVIMGQIVLGNSIVWHEPAHDLDVSALGTIVDVAEDADLILLPATVTELVGSYTQDRLNFVAPVQLVIDLHSLHMFEEADYLTSGWR

SEQ ID NO: 2363 - DNA, 738 bp, Corynebacterium glutamicum
  CDS (101)..(715): RXA01671
tctaaaaacacatttttaagccctcccggcgcagctgaaaactcagtcgccgggagggcttttttgtacccgaatttgtacccgaatttaaggaatcgctatgaatcatgttgttaattttgcttcacatttggaagacgcagccctgaagcaagccgaagctactgccaccatgccgtttatttacccgcatgtggcgttgatgcctgatgctcactttgggctgggttcgtcggtgggaacggtgttcggcaccaagggtgcgatcattccggcggctgtgggtgtggatataggttgcggaatgataggagtgtgtaccaattacacggcctctgacctggagggacgtgatttggtgacgcttcgggattacatcgagcgggtgattccgttgtctcctggaaattacaattccaccaccttgaaggaaaccgcgaaggtgaaggtcgcggagttggaggaactcgcggagcgcgatggtgtagatttgtcgcactctccgacgtggaagcgccagttgggttcgcttggtggaggtaatcacttcattgagttgtgtcttgatgagttggatcgggtgtggatgtttttgcactctggttcccgcggtgtgggtaacaagattgcccataagcacatcaagaacgcgcaggcccagtgtaagaatgaggagcttcccgataaggatcttgcgtaccttgaccgaggggactgaggagtttgagtcttacatca

SEQ ID NO: 2364 - protein, 205 aa, Corynebacterium glutamicum
MNHVVNFASHLEDAALKQAEATATMPFIYPHVALMPDAHFGLGSSVGTVFGTKGAIIPAAVGVDIGCGMIGVCTNYTASDLEGRDLVTLRDYIERVIPLSPGNYNSTTLKETAKVKVAELEELAERDGVDLSHSPTWKRQLGSLGGGNHFIELCLDELDRVWMFLHSGSRGVGNKIAHKHIKNAQAQCKNEELPDKDLAYLDRGD

SEQ ID NO: 2365 - DNA, 1158 bp, Corynebacterium glutamicum
  CDS (101)..(1135): RXA01673
agtttgcaggttcggccacccattatccatatcaacattatatgggtggatatgaaagtaccgtctaccgcgttcttttcaattagcgcaaccttgaagcatgtctacaaaccttctggaatcgacgccgccctttacccaacttcgcaccggagtcctccagaagtacaccccgggcctgctcttatgctccattgcggtactcatcgctatgatcgtgaatcactttttctctggtgtgagtccgcttatcgtcgcgatcattcttggcatcatcctgaccaacctgattcagctcccagcatcgacctcacccggcatcacgttggcgtcgaaaaagcttttgcggctgggaatcgtcttccttggtctgcagttagttttctcagatattttgtcacttggtttccccatgctggcggtgattgtgtgcatcgttgccggtggtatttttgggaccatcctcatgggacacctgctcagaatgaaaccaacccaagttctgttgattgcttgtggcttttctatttgtggcgctgcggccgtggcaggtgttgaaggagtaactgattccgaagaagaagaggtcgttactgcggttgcacttgttgttattttcggaacgctgatgattccttttatcccattcgcaaccaaagtcttggggttatcccctgaaatcggtgggatgtgggcaggcggatccatccatgaaatcgcccaagtagtagcagctggaggagtcattggtggtggagcattaggtgttgcagttgtggtgaaactcgcccgagtactcctacttgcacccattgctgccattttaagttttcgccagcgccgccagggttacacgtcccccgatggaaagagaccaccggtcgttcccctatttatccttggattcttggcgatggtagttttgcgctccactgttgcgctcccagacgaggtaattgcggctggaggtttcctacagacagccttgctctctgcagcaatgtttggtctcgggtgtggcgtaaaaatccagaacctgatccatgttggggtcaagcctttcattctggctttcggatccacgacacttgtcaccagtatcgcacttgcaggcaccctactcacccacctcggatagaaccgaagacccagttgtac

SEQ ID NO: 2366 - protein, 345 aa, Corynebacterium glutamicum
MSTNLLESTPPFTQLRTGVLQKYTPGLLLCSIAVLIAMIVNHFFSGVSPLIVAIILGIILTNLIQLPASTSPGITLASKKLLRLGIVFLGLQLVFSDILSLGFPMLAVIVCIVAGGIFGTILMGHLLRMKPTQVLLIACGFSICGAAAVAGVEGVTDSEEEEVVTAVALVVIFGTLMIPFIPFATKVLGLSPEIGGMWAGGSIHEIAQVVAAGGVIGGGALGVAVVVKLARVLLLAPIAAILSFRQRRQGYTSPDGKRPPVVPLFILGFLAMVVLRSTVALPDEVIAAGGFLQTALLSAAMFGLGCGVKIQNLIHVGVKPFILAFGSTTLVTSIALAGTLLTHLG

SEQ ID NO: 2367 - DNA, 534 bp, Corynebacterium glutamicum
  CDS (101)..(511): RXA01675
ttgccgattctagcgggagaattagtgtccatcgcatcgaaccacatctgattttgagccctggctaacggattgtttttgacagattggaatgacaataatgaacgagattccagaatggttgactcttgtatctgttgaagcaggaaagagacttgggcggcctgggccattggtgtttccgccggagttggtcactttggcagttgaagggattgagcttattgaacttgagccttcatggacttctgatttgcctctgccggaattcgggttcctagctgcggatatggttgatttctatgatgattatgagtttagtgaatggattccgggtgcgtggcctcttgctttagatggtggaggaggtttcttttgccttgatctccgtgctgccaacgctgatggagagattcctgttgtgtgggtgcatgccagcaacttgggttggggtgatgatgaggcagtacgcgtagctgcctcgttggcagatttgttgagtccgtcgaaatagaagaattagcatttaccgga

SEQ ID NO: 2368 - protein, 137 aa, Corynebacterium glutamicum
MNEIPEWLTLVSVEAGKRLGRPGPLVFPPELVTLAVEGIELIELEPSWTSDLPLPEFGFLAADMVDFYDDYEFSEWIPGAWPLALDGGGGFFCLDLRAANADGEIPVVWVHASNLGWGDDEAVRVAASLADLLSPSK

SEQ ID NO: 2369 - DNA, 879 bp, Corynebacterium glutamicum
  CDS (101)..(856): RXA01676
agttacagcttttctcggtggcacactcgcgctacttagcccttgtgccgcactccttttaccagcattttttgcatcctcagtgggtgctggcccgcgcatgatccttcacggtgttgtgttctacgcaggacttctagtacttctcgtgccacttggccttggtgcgggaatcctcggcgagctgtttatcacccaacgccagaccatcatcgtggtttcatcgatcgtgctgattatcctaggttttgtccagatcttcggcggcggattcgacttcggaaaagcactcccaggattagatcgtctgcaatctaaggccactgtgacctcaggtctaggaaagagctttttactaggaatgaccagtagtattgccggtttttgttccggaccaatcctcggcgccgttcttactttggctgccaccagtggaaactccatcacctcagcactcattttgagtgcttatggtgcgggaatggtgctgcccctgatggctattgcagcgctctgggccaaactcggacagcgtggacagcagatgctccgcggccgggaattcaccttcttgggcaggcagtggcacattgtttctgtcattagcggtgccctgatcatcgctgtcggaatcctcttttggtccacgaacggccttgtcagcatgccggagctcgttccaatggacacccagatctggctacaggaagccacattctcactcgggtcaccactctttgacatcgcattgatcattgtcgccgctggcttgttcttgtacttctggaacaaacgacaaaagcgaaaagaagaagctcagcgacccaaagaaagtggatgggttattaaccctcgctaattattagttttggagcgagg

SEQ ID NO: 2370 - protein, 252 aa, Corynebacterium glutamicum
MILHGVVFYAGLLVLLVPLGLGAGILGELFITQRQTIIVVSSIVLIILGFVQIFGGGFDFGKALPGLDRLQSKATVTSGLGKSFLLGMTSSIAGFCSGPILGAVLTLAATSGNSITSALILSAYGAGMVLPLMAIAALWAKLGQRGQQMLRGREFTFLGRQWHIVSVISGALIIAVGILFWSTNGLVSMPELVPMDTQIWLQEATFSLGSPLFDIALIIVAAGLFLYFWNKRQKRKEEAQRPKESGWVINPR

SEQ ID NO: 2371 - DNA, 867 bp, Corynebacterium glutamicum
  CDS (101)..(844): RXA01677
gtcgccatagttgagttttattcatggcttttagctaggcgactttagttgagggcttttagttgagggcttcccagcagggatggttaaggagaattcagtgaaccaacagagtaaaaagtggctcgtaccgacactggtcgtcatcattgcagtgctcctcatcgcagttgttctgttgatgtaccgaggaaatgcgagtgatacggccgagggcgtttcagccgctgcgacttcggactcggctgctgcttcgactgctgcttcgggttccgcttctggtgctgcggactccgatctgaccagcgtggaagcacgcgacccttccgaccctgttgcggtgggagacgttgatgcacctgttgggttagtggtgttttccgactaccaatgcccgttctgtgcaaagtggagcgatgaaaccctgccacagatgatgaagcatgtggaagatggaaacctccgcattgaatggcgtgaagtgaacatctttggagaaccatctgagcgtggagctcgcgcggcatacgctgcgggtttgcaggacgcatacttggaataccacaacgcactctttgccaacggtgaaaaacccagcgaagacctgctcagcgaagagggacttattaagcttgctggtgaccttggactagacgaatcgaaattcactgccgatttccaatcccctgaaactgcagtcgcaattgcgcaacatcaacagctgggaatcgatcttggcgcctactccaccccagctttcctcctaggtggccagccaatcatgggcgctcagcctgcttctgtatttgaagccgccttcgagcaagcactggcagcgaaagaataaaccgtggatgtcggcctagt

SEQ ID NO: 2372 - protein, 248 aa, Corynebacterium glutamicum
VNQQSKKWLVPTLVVIIAVLLIAVVLLMYRGNASDTAEGVSAAATSDSAAASTAASGSASGAADSDLTSVEARDPSDPVAVGDVDAPVGLVVFSDYQCPFCAKWSDETLPQMMKHVEDGNLRIEWREVNIFGEPSERGARAAYAAGLQDAYLEYHNALFANGEKPSEDLLSEEGLIKLAGDLGLDESKFTADFQSPETAVAIAQHQQLGIDLGAYSTPAFLLGGQPIMGAQPASVFEAAFEQALAAKE

SEQ ID NO: 2373 - DNA, 756 bp, Corynebacterium glutamicum
  CDS (101)..(733): RXA01681
ctttaacgaaagacttgtcgttactttagtaattagaccaacatggtggtgagtggttgaaatcttgccatcaaaattatcgagtgagttgaagcattccgtggaagtactactacttatcgcaatcgtcgttggtggtggcgtttttgtcgcctcaaagatgggatccaataacaataagaagcaagaagaagccaagtttgctgacgcacaggcagatgcgcgtcggtggattgagcgtcttggttcccaggttttgaccatcgcaggtacagatgctgcgtcgacccaggctattgctgacgcctcagagcgctataccgctgcgtcttctcagatttcttctgccactactcctcgtcaggcagagttggctcgagaatctgcactagagggtctgcattatatgaacgcggctcgtgagatcatgggtatgactgctggccctgagctgcctcctctggaaggtcagcgcaatgctggtcgcgttacagaaaagcgcaccattgagcaggagggtcgccagatcactgcttcccccgtcgcaacagatgaaactccgaactactaccctggcggtaacgttgcgggtcgcccagtccctgctggttggtactccgagccttggtgggcaagcgcattgcgttccggtctgtggactgcaggttcggtcatgatgttctcagcaatgtttaacggcatggctggtgtcggctactccgctgcagacctttgaaaaatggctatggcgagggc

SEQ ID NO: 2374 - protein, 211 aa, Corynebacterium glutamicum
VEVLLLIAIVVGGGVFVASKMGSNNNKKQEEAKFADAQADARRWIERLGSQVLTIAGTDAASTQAIADASERYTAASSQISSATTPRQAELARESALEGLHYMNAAREIMGMTAGPELPPLEGQRNAGRVTEKRTIEQEGRQITASPVATDETPNYYPGGNVAGRPVPAGWYSEPWWASALRSGLWTAGSVMMFSAMFNGMAGVGYSAADL

SEQ ID NO: 2375 - DNA, 702 bp, Corynebacterium glutamicum
  CDS (101)..(679): RXA01685
caataattaggtgagcaaccctaataagaaacctttagatcccgcacaaagattctccctccccaccagatgggcgatgttctttgtcgggatctttattatgtccttcgccatcggcatcaccgtccacgcaggactaggaaccaccacaatttcatcacttcccgtggtgtggactgctgccagcggattatccctgggctggaccacaatttacttcaatggcttcatgattctgtgccaaataattgtgctgcgttcccagttcaaaccacaaatgttagtccaaatcctgtgggcattcctctttgggtttctttgtgatttaagcctgcaactaaccacctgggcgcaaactgacaattattttgtggcctggatctgggttattgtgtccaccattttgatgtcgatcggagtttttattcaagtactccccaacatcactttcatcgctggtgaaggcattgtctctgcgctggtgaagaaatttcccaacgtggaatttggcaccatgaaacaaatcgtcgactggactttcgtctccgtcgctgccattttgtcctggatcaccatgggtggacttattggcgtgcgcgaaggaacagtgttcgcggcgtttttcatcggattcttcgtccgccagtggcgcaaactctacctccgctccatcggtcactaaagagcttgttccaggaagag

SEQ ID NO: 2376 - protein, 193 aa, Corynebacterium glutamicum
MSFAIGITVHAGLGTTTISSLPVVWTAASGLSLGWTTIYFNGFMILCQIIVLRSQFKPQMLVQILWAFLFGFLCDLSLQLTTWAQTDNYFVAWIWVIVSTILMSIGVFIQVLPNITFIAGEGIVSALVKKFPNVEFGTMKQIVDWTFVSVAAILSWITMGGLIGVREGTVFAAFFIGFFVRQWRKLYLRSIGH

SEQ ID NO: 2377 - DNA, 564 bp, Corynebacterium glutamicum
  CDS (101)..(541): RXA01686
ggaggaagggttgcaacgctttttcaagagaatgaccgtgcgtccgcttaaacgaagcgtcgaacgccggtcttttctcatttcacttaagatgtagaacatgacttcactcagggacttacttgtttccaccaatgccgacgcagcaattgcagatatgtcagcatttatcgaagaaaccgtgggcaagcaatccggcatcagcggcatcgcactcaaaggcgcaatgggtgctgcaaccaagatcgactccgacatcgtagccaaaggctccaggcgcctcctcccggaaatcgctgactccctcgacggactctggcaggaataccaaaatggtggcaccgccgcagatttcggcgcccacctcgaggccaacagctccaccgcactcgacgcgattctcagcgttgctgacaaaaacgcagagagcatcaacgttccaggacttggcaaggtctacaagggcgtgcgcggcaaggctgccaaagtaatcgagcaggaacttcctgcaattggccagttgatcgaaaagaacgcacaataattaggtgagcaaccctaata

SEQ ID NO: 2378 - protein, 147 aa, Corynebacterium glutamicum
MTSLRDLLVSTNADAAIADMSAFIEETVGKQSGISGIALKGAMGAATKIDSDIVAKGSRRLLPEIADSLDGLWQEYQNGGTAADFGAHLEANSSTALDAILSVADKNAESINVPGLGKVYKGVRGKAAKVIEQELPAIGQLIEKNAQ

SEQ ID NO: 2379 - DNA, 1545 bp, Corynebacterium glutamicum
  CDS (101)..(1522): RXA01693
aggagactggctggattattggctggttttcttgggaaatcgtcatgggcattaatcctagtcccaacaattgccagaacccgaacactaggcttgaaccatgaatactgcacctttcaaactcgaagctgacttcgcatcagccctgcccaccatggcagccccctggcaaggtgaggaagcccccaaccctgagctcgtgattttaaatgacgacctcgcctacagcctcgggcttgatccgacatggcttcgcacacctgagggcgttcaatttcttctcggactcaaccccgagcccttaacaaaagcagttgcgcaggcctattccggccaccaattcggacagtttgtggcaagccttggtgatggccgagcgcttcttctcggcgaagcccgctcagctgacggcgtactgcatgatatccacctcaaaggatctggacgaacccaattctcccgaggagccgatggacgcgccgtccttggccccgtcttacgcgaatacatcatctccgaagcgatgcatgcacttggtgttcccaccaccaggtcacttgcagtaattagcaccggtaggaaaatccaacgaggaagcgtagccccaggcgcagtccttgttcgagtagcaaccagcctcattcgagtcggatccttccaatactccaacatctctggtggcatcgaactatctcaacacctggcgaactatacgatcaccaggcatttcccttcgttggtagctgaactatccgcaccaacccccgcaacttatgtatcactgtttaaagcgattcttcagcgccaagcagacaccgttggaaaatggaccaggctgggtttcgttcacggagccctcaacacagacaacacgttgatatccggagaaactgttgactacggcccatgcgctttcatggagcgctaccgtggcgacgcgaaatttagctccatcgacacttatggtcgctacaaatttgaaaaccaacctatgatcctcggatggaacatggcccgcctcgtagaaaccctcctcccactcctgggcgccacaccagacgaaggcatgacagcagcccaagaagctctcgtagaattcgatgacctctgcgaacaagcaatccgaaaagaattcgccactgcactgggccttgacgagtcagacaccggcacggtagagcagttccgtgaactgctctacctccataaccccgacatcaccacgctgctgcgcgcactcaccgacaacaccgcaccaccgagtggctttgaagcattcgttcacgactggaaaacccaagacccagatatcgaagcaatgcgagcagtaaatccacttttcattccacgcaatcacctcgtggaagctgctctcgcagacgcagttgaagggaatctagaaaagttccacgaactcctcgctgctgtcaccaatccttttgatccaactgcgggccccgatgaactacgcctgccaagcgaagaaggatttgaagaagactacatgaccttctgcggtacctaggacagatggtggggcagacg

SEQ ID NO: 2380 - protein, 474 aa, Corynebacterium glutamicum
MNTAPFKLEADFASALPTMAAPWQGEEAPNPELVILNDDLAYSLGLDPTWLRTPEGVQFLLGLNPEPLTKAVAQAYSGHQFGQFVASLGDGRALLLGEARSADGVLHDIHLKGSGRTQFSRGADGRAVLGPVLREYIISEAMHALGVPTTRSLAVISTGRKIQRGSVAPGAVLVRVATSLIRVGSFQYSNISGGIELSQHLANYTITRHFPSLVAELSAPTPATYVSLFKAILQRQADTVGKWTRLGFVHGALNTDNTLISGETVDYGPCAFMERYRGDAKFSSIDTYGRYKFENQPMILGWNMARLVETLLPLLGATPDEGMTAAQEALVEFDDLCEQAIRKEFATALGLDESDTGTVEQFRELLYLHNPDITTLLRALTDNTAPPSGFEAFVHDWKTQDPDIEAMRAVNPLFIPRNHLVEAALADAVEGNLEKFHELLAAVTNPFDPTAGPDELRLPSEEGFEEDYMTFCGT

SEQ ID NO: 2381 - DNA, 738 bp, Corynebacterium glutamicum
  CDS (101)..(715): RXA01714
cattggataattagcaggagtgaagttgcatcaaaggacaaacataaaataaacggcgcgcctccccagagttaccccaataattagtaaattgcagattgtgatcgattccgaagcgacctctcagcacaagacctcagctaccccggcagagagcactcccgcggagttttccgaagcggttgagtctatgcacagagcgcgcctgcgcccagaacttactttgggcacgattaggccgcctcagcgcctggcgccgttttcgcacgccattggactcgaagtcggaaatcaagaagagtcagacgatgtctccaccaacagcgaaggtgattcctttggtcgtttgattctgctccacgatccgggtgccgaagaaacctgggaaggagcaatgcgccttgtcgcctatattcaagctgacatggatcacgctgttgcttccgacccgctattgccggaagtagcgtggcaatggcttaacgaaggtttggaacaagccggcgcaggatttaccaacctaggcggaaccgtaacctccacaacctcggtgcgctttggtgaaatcggtggaccgccaagtgcctaccaagtggaaatgcgtgcgtcctggaccgcgactggcaccgacctcaccgcgcatgttgaagcgttcgcagcagtgcttgcctctgttgctggacttcccccagagggcgtcaccgaactacgaaggtagattggacaccatggtttccg

SEQ ID NO: 2382 - protein, 205 aa, Corynebacterium glutamicum
VIDSEATSQHKTSATPAESTPAEFSEAVESMHRARLRPELTLGTIRPPQRLAPFSHAIGLEVGNQEESDDVSTNSEGDSFGRLILLHDPGAEETWEGAMRLVAYIQADMDHAVASDPLLPEVAWQWLNEGLEQAGAGFTNLGGTVTSTTSVRFGEIGGPPSAYQVEMRASWTATGTDLTAHVEAFAAVLASVAGLPPEGVTELRR

SEQ ID NO: 2383 - DNA, 819 bp, Corynebacterium glutamicum
  CDS (101)..(796): RXA01715
acatgttgttggaacatgccggcagagccgacactacgattcattcgctaaagggtctggccactgacactggcaaagatccacgaaaggaagttaccctgtgagcgagctcgatattaaacagctcaacaaactgcagcgctactctcagtgggcggtgttccgtgctattcctggagcgctcgatgatgatcgcacagaagtcactgaccaagcagccaagttctttgccgaccttgaagcagaaggcaaagtcactgtccgtggcatttacaacgcctccggcctgcgcgcagacgctgactacatgatctggtggcacgcagaagaattcgaagacattcagaaggccttcgctgatttccgccgcaccaccattttgggtcaggtttctgaggtcttctggatcggaaacgctctccaccgtccatctgagttcaacaaggctcacttgccttcattcatcatgggtgaagaagcaaaggactggatcactgtttacccgttcgtgcgcagctacgactggtacatcatggagcccttgaagcgttcccgcattctccgcgagcacggacaagctgctgtggaattcccagatgttcgtgccaacactgtgccggctttcgcactgggtgactacgaatgggtgctggctttcgaggctgatgagttgcaccgcattgtcgatttgatgcacaagatgcgttacaccgaggctcgcctccacgtccgtgaggagctgccatttatttctggacagcgcgtcgacattgcagatctgattaaggttcttccttaaaagctgcttttctaaacgat

SEQ ID NO: 2384 - protein, 232 aa, Corynebacterium glutamicum
VSELDIKQLNKLQRYSQWAVFRAIPGALDDDRTEVTDQAAKFFADLEAEGKVTVRGIYNASGLRADADYMIWWHAEEFEDIQKAFADFRRTTILGQVSEVFWIGNALHRPSEFNKAHLPSFIMGEEAKDWITVYPFVRSYDWYIMEPLKRSRILREHGQAAVEFPDVRANTVPAFALGDYEWVLAFEADELHRIVDLMHKMRYTEARLHVREELPFISGQRVDIADLIKVLP

SEQ ID NO: 2385 - DNA, 642 bp, Corynebacterium glutamicum
  CDS (101)..(619): RXA01729
tcaaggtccggcgattcttcaattcttcgagttcaggaaatcgcatactctctaggctagtaaacttttctacgaacctattactaagaaggagcccgaagtgaagttgaggacaatcccagccctgttagccgtcgcacttcttgcaggctgttcgggtgaaagtgctgatagccaagccgtttccgctgaggaaaccatggaagtaaccactacctcaaccccggtgttcgaagccaaagaggtaagcccaatcacagtcccaagcggcgatatcagggttgaagacccaggtctcaatgttgaatttatcttccgaggcacccgctacggcaccaacggtggctcaattattcacatcgcggtgaaaaacctaaacgacgtagccctgccagccgacgccatcgatccacccaccctggacatcgaagactacaacggcaacaaaaccaacatcgaaaccctctccggcgacgacaacatcccactcgacctaccactgggtgccggcgcgacaacgaacctgcaatacgcgttcaacacctcaaacggctcattgtcgaatgctaaattccagatcggaaacgtcatctactcaggcaatttgaacagcttggcgtaagttcaaaaaataatttgaat

SEQ ID NO: 2386 - protein, 173 aa, Corynebacterium glutamicum
VKLRTIPALLAVALLAGCSGESADSQAVSAEETMEVTTTSTPVFEAKEVSPITVPSGDIRVEDPGLNVEFIFRGTRYGTNGGSIIHIAVKNLNDVALPADAIDPPTLDIEDYNGNKTNIETLSGDDNIPLDLPLGAGATTNLQYAFNTSNGSLSNAKFQIGNVIYSGNLNSLA

SEQ ID NO: 2387 - DNA, 822 bp, Corynebacterium glutamicum
  CDS (101)..(799): RXA01731
gcttttgcagctgtggggttgggctgggggcaagtgttcatgtaggtgtcattgatcgttcactcaaggttggacgttgtgttcatgaataacttttatgatgaacgcatcgtccatttcttcccgattcaaggatctttttgtgacacccagtattgtttttgatttcgatggcacgcttgccattggccatggccctgtccttgcgtatgcattgtgtgttgcaccggagggttccaaggactttctggagcgtgtgcgcagggagcttcggcgctatgacgatggtcagagtatttaccgtgatgggtatgacattgtggctaagttggcgtcggaattggggattgatgatggcacgatgtctgtcgcttatggcgagagccggaagttgcttggttcggatttagcgcctgttgagcatgtgcggggtattaaggatattttgtcctcgttgaaaggtcatgctcggttggttttagctaccaatgccccggaaaatggcgtgcatgatttgctgcgtcagtggggtgttgctgatttgtttgatcagttgcattttgtggtgggtaagcctgcagggttgatttcgatcatttctgatttgcagcttgatggtccggtgcttgcggtgggcgatatttatgaattcgatctgagtcctgcagcgcagttaggtgcagatacggctctggttggagctacagcaaccatttctgaagcgaaggtctccatgcgtggagattctatcgctgatctccctctccttgcctgggtttgttcccgggtctcctcttcttaactttcttgtctcatgtcgct

SEQ ID NO: 2388 - protein, 233 aa, Corynebacterium glutamicum
MNASSISSRFKDLFVTPSIVFDFDGTLAIGHGPVLAYALCVAPEGSKDFLERVRRELRRYDDGQSIYRDGYDIVAKLASELGIDDGTMSVAYGESRKLLGSDLAPVEHVRGIKDILSSLKGHARLVLATNAPENGVHDLLRQWGVADLFDQLHFVVGKPAGLISIISDLQLDGPVLAVGDIYEFDLSPAAQLGADTALVGATATISEAKVSMRGDSIADLPLLAWVCSRVSSS

SEQ ID NO: 2389 - DNA, 837 bp, Corynebacterium glutamicum
  CDS (101)..(814): RXA01738
gtgagctctaccgcatcgactccccagaagcagaaactgtagagcccggcgatcgtctcctttacgttcgccgagtatttagcgaggaggtaaatgacaaatgagaattcttcccatcggcccccacgatgaaatcgccgtcaacggatcaatagtccttctatccgagcacgacggagacatcgtatcggtcggccccgacctcggcacggtgcgagttacccttgaagagatcgaaagtttaggtacaccgacggcaccccgcgatctgggttctcgggaagtcgacgcatgcgtatcgttgctccgcaaccgcgagttagtgcgattcgatccccacgatggcagtgaattaacctatcgggaacatagcgttgcttacggtgcgagtggcaagccattgtttccccgattggatccagcggtgatcggcattgtggagctgcgaggtgaggatcgtttgcttctgggcatgaatgcgcagaaacgccaacgctattcattaatcgcaggttatgtttcgcatggtgagtcgctggaagacgcattcaccagagaagtgttcgaggaagcggcgcgccgggtatctgagatttcctatgtgtcgtctcaaccatggccgatctctggttcgctgatgctgggtatgaagggcttcacggaagatgagttgcctcaaggcgaaactgatggtgaattagcggagacaatctgggcttcgccactagacattatcgatcgtaagattccgatcgccccacccggatcgattgcctacgacatgatcaacgcctgggcgcgagataaacaaaactaagggagctttttacagtgatc

SEQ ID NO: 2390 - protein, 238 aa, Corynebacterium glutamicum
MRILPIGPHDEIAVNGSIVLLSEHDGDIVSVGPDLGTVRVTLEEIESLGTPTAPRDLGSREVDACVSLLRNRELVRFDPHDGSELTYREHSVAYGASGKPLFPRLDPAVIGIVELRGEDRLLLGMNAQKRQRYSLIAGYVSHGESLEDAFTREVFEEAARRVSEISYVSSQPWPISGSLMLGMKGFTEDELPQGETDGELAETIWASPLDIIDRKIPIAPPGSIAYDMINAWARDKQN

SEQ ID NO: 2391 - DNA, 921 bp, Corynebacterium glutamicum
  CDS (101)..(898): RXA01741
gcatctctggcttttcctgcatgacagatgattgtaactgtgatgaaataaggccagatgaagtaactgtgtcgattaagttttgggggaaatttttcagatgacacacatcgctttagccaactctgcccaagttctgatccgcccggattctgcgattcaattcggcatcgacgccacccgcgctggcgtcttaaatatcgatccatcgctgtcgtcgcgagtcgtcccggtgctgcggaatctgcggaccgcccgaccgatcgttgatgtcatcgccgacctcacgactgcaggcctcgcacccaccgctgcgagcagtttgctcgaggaccttttagaattcggtgtggtccgcgaatcggcggcggcgcaggtgttgctgttcggggacggttcgcttgtcgacgtcacctccttccttttggaaacctccggctttgttcccagaccccagatcatcgatgagtcgcctcgagagtttttcgagcttccctccagccacattttggttctcaacaagctcgcacattcccaacgtctatccccgctgcttcacaaatatgcgccgacgtatctgtgcgccgcgatcgtcgataatcgtggcatcatcggcccgggccggagatcacgatcggggccgtgtttgatgtgtgtggatctgcatcgctgcgatatcgatccgcattggctctctattatcaatcagcaacccaacggtcccacctttcctgatcccgtcacggagatggcgacggctgcccgactcgtcgcctgggtcactgccgatacatggttgcccggcgttgtggaggaagtaaacccccacgatcgaacaaactcggtacgcaccctccctgtgcatccaaaatgtccgatgtgttggagtttaggttcctaaagtgctcccaaaatcgcgag

SEQ ID NO: 2392 - protein, 266 aa, Corynebacterium glutamicum
MTHIALANSAQVLIRPDSAIQFGIDATRAGVLNIDPSLSSRVVPVLRNLRTARPIVDVIADLTTAGLAPTAASSLLEDLLEFGVVRESAAAQVLLFGDGSLVDVTSFLLETSGFVPRPQIIDESPREFFELPSSHILVLNKLAHSQRLSPLLHKYAPTYLCAAIVDNRGIIGPGRRSRSGPCLMCVDLHRCDIDPHWLSIINQQPNGPTFPDPVTEMATAARLVAWVTADTWLPGVVEEVNPHDRTNSVRTLPVHPKCPMCWSLGS

SEQ ID NO: 2393 - DNA, 903 bp, Corynebacterium glutamicum
  CDS (101)..(880): RXA01748
atcaccaaatgtggcggttttgcgtcgaaaagcgtgctctttctacacctctttgaggttcattttcgcggtttcctcacaatcgcctattgttaagtacatggcagacgcgaaaaagcaggcggataaagccgccaagaagcaggtaagagcagccaagaaggcacagcgcaaggagactcgctcacaaatgtggcaggtcttcaacatgcaacgcaagcaggataaggctcttattccgcttctgttgctcgctattcttggtatcccgctggtccttttcctcatcggtttgatttggggtggtcagtggtggatgcttccgatcggcattgctgcaggtgttgtagctgcaatgtttattttcacccgtcgcgttgagcgtgacgtgtacaagcgcgccgaaggtcagcagggtgctgctggttgggctgtggagaacctccgctctggcgtgggcatgacctggcgcaccaagaccgctgttgcagtgaccactcagatggatgcagtgcaccgcgtcattggtctgtgtggtgttgtgctggtcggcgagggctcccctcaccgcctgaagccaatgcttgcgcagcaaaagaagcgcctgaaccgcgtggcacctggtgttccagtgtatgaaatcatcacgggcaacggcgaaggccagacccctatcgcgaagctgcagcgtgaactggtcaagctgcctcgcaactacaagaagaacgacgtcgctgccctggccgctcgcattgaggctatggacaatgtcggaaacgctcctggcggatctttgcctaagggtccattgccaaagggcgcaagcatgtccggtatgaaccgccgcgctcgccgacaggctgaacgcaagggcgaggcttaaagccttttcgctttcgcgtc

SEQ ID NO: 2394 - protein, 260 aa, Corynebacterium glutamicum
MADAKKQADKAAKKQVRAAKKAQRKETRSQMWQVFNMQRKQDKALIPLLLLAILGIPLVLFLIGLIWGGQWWMLPIGIAAGVVAAMFIFTRRVERDVYKRAEGQQGAAGWAVENLRSGVGMTWRTKTAVAVTTQMDAVHRVIGLCGVVLVGEGSPHRLKPMLAQQKKRLNRVAPGVPVYEIITGNGEGQTPIAKLQRELVKLPRNYKKNDVAALAARIEAMDNVGNAPGGSLPKGPLPKGASMSGMNRRARRQAERKGEA

SEQ ID NO: 2395 - DNA, 1740 bp, Corynebacterium glutamicum
  CDS (101)..(1717): RXA01749
ggtttttgcgtgctctggtttagggactggttttgggaacgtgcccagttccacatcaaataacgctgaggtcgtacttaatccatgagatcatgaatgggtgagcttccttgtagaaaatcaattactcgcgttggttgtcatcatgacggtcggactattgctcggccgcatcaaaattttcgggttccgtctcggcgtcgccgctgtactgtttgtaggtctagcgctatccaccattgagccggatatttccgtcccatccctcatttacgtggttggactgtcgctttttgtctacacgatcggtctggaagccggccctggattcttcacctccatgaaaaccactggtctgcgcaacaacgcactgaccttgggcgccatcatcgccaccacggcactcgcatgggcactcatcacagttttgaacatcgatgccgcctccggcgccggcatgctcaccggcgcgctcaccaacaccccagccatggccgcagttgttgacgcacttccttcgcttatcgacgacaccggccagcttcacctcatcgccgagctgcccgtcgtcgcatattccttggcataccccctcggtgtgctcatcgttattctctccatcgccatcttcagctctgtgttcaaagtcgaccacaacaaagaagccgaagaagcgggcgttgcggtccaggaactcaaaggccgtcgcatccgcgtcaccgtcgctgatcttccagccctggagaacatcccagagctgctcaacctccacgtcattgtgtcccgagtggaacgagacggtgagcaattcatcccgctttatggcgaacacgcacgcatcggcgatgtcttaacagtggtgggtgccgatgaagaactcaaccgcgcggaaaaagccatcggtgaactcattgacggcgacccctacagcaatgtggaacttgattaccgacgcatcttcgtctcaaacacagcagtcgtgggcactcccctatccaagctccagccactgtttaaagacatgctgatcacccgcatcaggcgcggcgacacagatttggtggcctcctccgacatgactttgcagctcggtgaccgtgtccgcgttgtcgcaccagcagaaaaactccgcgaagcaacccaattgctcggcgattcctacaagaaactctccgatttcaacctgctcccactcgctgccggcctcatgatcggtgtgcttgtcggcatggtggagttcccactaccaggtggaagctccctgaaactgggtaacgcaggtggaccgctagttgttgcgctgctgctcggcatgatcaatcgcacaggcaagttcgtctggcaaatcccctacggagcaaaccttgcccttcgccaactgggcatcacactatttttggctgccatcggtacctcagcgggcgcaggatttcgatcagcgatcagcgacccccaatcactcaccatcatcggcttcggtgcgctgctcactttgttcatctccatcacggtgctgttcgttggccacaaactgatgaaaatccccttcggtgaaaccgctggcatcctcgccggtacgcaaacccaccctgctgtgctgagttatgtgtcagatgcctcccgcaacgagctccctgccatgggttatacctctgtgtatccgctggcgatgatcgcaaagatcctggccgcccaaacgttgttgttcctacttatctagcattgaccccttaagcgcag

SEQ ID NO: 2396 - protein, 539 aa, Corynebacterium glutamicum
VSFLVENQLLALVVIMTVGLLLGRIKIFGFRLGVAAVLFVGLALSTIEPDISVPSLIYVVGLSLFVYTIGLEAGPGFFTSMKTTGLRNNALTLGAIIATTALAWALITVLNIDAASGAGMLTGALTNTPAMAAVVDALPSLIDDTGQLHLIAELPVVAYSLAYPLGVLIVILSIAIFSSVFKVDHNKEAEEAGVAVQELKGRRIRVTVADLPALENIPELLNLHVIVSRVERDGEQFIPLYGEHARIGDVLTVVGADEELNRAEKAIGELIDGDPYSNVELDYRRIFVSNTAVVGTPLSKLQPLFKDMLITRIRRGDTDLVASSDMTLQLGDRVRVVAPAEKLREATQLLGDSYKKLSDFNLLPLAAGLMIGVLVGMVEFPLPGGSSLKLGNAGGPLVVALLLGMINRTGKFVWQIPYGANLALRQLGITLFLAAIGTSAGAGFRSAISDPQSLTIIGFGALLTLFISITVLFVGHKLMKIPFGETAGILAGTQTHPAVLSYVSDASRNELPAMGYTSVYPLAMIAKILAAQTLLFLLI

SEQ ID NO: 2397 - DNA, 1764 bp, Corynebacterium glutamicum
  CDS (101)..(1741): RXA01750
tcgcccccgaggattgtgttgcgaacagtcctgaagatcatgtcagacctacattgagccaatgatcgacatgtggacgagggaaactcgaccgaacaatatgtgtatcaacgaccctaaaggcgagttgctgaagaaaaattatgttcggatgtctaagcgcggttttcaggttgttcagtttaacctgattaacaacctgaaaactgatatttataacccgttgggattagcagccgaagcagctcgcgaaggtaacgggatgaagtgcgcaacctatgtggaaaatatcgcagaggtgttctttccggtggacggtgccgatgatccggtatggccgaatgcggccaacaatgccttcaagcgtgcagcctatggtcttatcgacttctatttggaagaggagcgcgagatgcgcaagcaggctgcagctgagaattgggatgccaaggtgcttgatacacgtattgatcagatgtggggtaaggtcacgctctacaactgctaccagctctttgtgcagctttcggcaaagaagctgaagaatcccgttgagcgactcaatgaacgtgcacgtgccggtgaattcggtaacttagagactgatgaaaatgcagccatgatgttccaggatgctgtgacagaggccgaagagaacgaaatgtttctgtgggagggtgagaaagaaaaagacatgctcaccttgttctttagtgccacagacggtctgccaaagtccagtgttcgtactctggtgggcaacgcagataaggccctgaaagcaatgggtggcgctgaaaaaatgatggcgtcggtctacggtatcgcgattacagcgatgtccttctttacagaccccacaatttcaacgttaacctcaggcacactaagtcagaacgttgacttggccggattgtcgtttccacggcgcatgggtgttcgttttgcggccccctatgtgaagcgctacaacctggttggatcacaggtgaaatgggatgcgtatagtgacgccaagttcaccaagccgttgggtaagaattttgttcatgatgacacgctgtcggttgagggttgggcgcggttctatattaaagactcgttcccgagtaatactgcgtacctgcgtttgcggattctcaatggtacttctggcacgttgatcaagactctgtacttcaagttcaccaagggctaccaaacgaaccttaaaggccgtgcgtttattactgatccggtgaccgatgagaagatcattaagaatggtctgctgatcgagctggtgaaaaacgatgctggtgactttgttccaggtcatgtgcagtttaagacgaagaaactgaatcttgaccaactcacgcaggaacagatcaatatgccgggtcatgacatgatcaagcaggttgatgcgatggttgatgcggtgtcggctctgaatgtgcggtattcggagaagcctaaggcagtgttcttcgtaacgcctccgcatcttatgaaatatgcgaagttgattttgattctcatcaaacagcttgtggatctgaacttcgattcctcgtatatgacgcgtgagaatcagaagccggattataagactcgtttcatgttggacgagttgggaaaccttcagagtgagggtcatggtattgcgggatttgaaaccatgctctcgatcggtctgggacaagaacaacaatttagtgcgaccagttgcgtagcgaaaaactacgctcttgcagcttaaagttgcaagaaactgtttca

SEQ ID NO: 2398 - protein, 547 aa, Corynebacterium glutamicum
MCINDPKGELLKKNYVRMSKRGFQVVQFNLINNLKTDIYNPLGLAAEAAREGNGMKCATYVENIAEVFFPVDGADDPVWPNAANNAFKRAAYGLIDFYLEEEREMRKQAAAENWDAKVLDTRIDQMWGKVTLYNCYQLFVQLSAKKLKNPVERLNERARAGEFGNLETDENAAMMFQDAVTEAEENEMFLWEGEKEKDMLTLFFSATDGLPKSSVRTLVGNADKALKAMGGAEKMMASVYGIAITAMSFFTDPTISTLTSGTLSQNVDLAGLSFPRRMGVRFAAPYVKRYNLVGSQVKWDAYSDAKFTKPLGKNFVHDDTLSVEGWARFYIKDSFPSNTAYLRLRILNGTSGTLIKTLYFKFTKGYQTNLKGRAFITDPVTDEKIIKNGLLIELVKNDAGDFVPGHVQFKTKKLNLDQLTQEQINMPGHDMIKQVDAMVDAVSALNVRYSEKPKAVFFVTPPHLMKYAKLILILIKQLVDLNFDSSYMTRENQKPDYKTRFMLDELGNLQSEGHGIAGFETMLSIGLGQEQQFSATSCVAKNYALAA

SEQ ID NO: 2399 - DNA, 652 bp, Corynebacterium glutamicum
  CDS (101)..(652): RXA01752
gaaatgacgtgaccatcgataccaatacccaattgaaagatcttgacctggtcagccaagttggccgtcagatcgtggcagaacaacaggtggggaggtcatgatggaacaagatctcagctaccgtgaaattcttcccctcaacgcgagtgaggagaagaaaaaggctgcactgattgatgccattgaagggttaagggtgcgcgatccgctactctctgcctcgattgcatttactagagggcagaaagtcgccttcattgctgtggtggtgggctttatcttgatgctcatttttgctcggcaagcagcacttattggactgtcagcaacgtgtacgttcatgtacctcattacattgttggacagatttatcatgttttccagaggtatccgcgcggaatccatcatccaggtatcggatgaagatgcgctggctttccctgaggacaagctgaaaacctacacggtgttggtgcccgcctatggcgaacctgaggtgattgcgcagctgctggcatccatgcacgcttttgattaccccaagcatcttctgcaggtattgctcatgttggaggaagatgatctgcccacgatcgccgcggcagaggcagcgggagtggatcaggtggcaacgatcattaaggtgccg

SEQ ID NO: 2400 - protein, 184 aa, Corynebacterium glutamicum
MMEQDLSYREILPLNASEEKKKAALIDAIEGLRVRDPLLSASIAFTRGQKVAFIAVVVGFILMLIFARQAALIGLSATCTFMYLITLLDRFIMFSRGIRAESIIQVSDEDALAFPEDKLKTYTVLVPAYGEPEVIAQLLASMHAFDYPKHLLQVLLMLEEDDLPTIAAAEAAGVDQVATIIKVP

SEQ ID NO: 2401 - DNA, 1662 bp, Corynebacterium glutamicum
  CDS (101)..(1639): RXA01753
ctgattgtcgcagccgtggtgtcagtgtccaggcgttcgcaaaaaggatacaaatgatttcttctttacccagtagaacgcaggggaggaggttgggtccatgagtaacccgtcgctagaacctctagaaccgatcgagctttctgacggtactgaaattgaagtttcagacgttgatccagaaccgcaagctggcaatgcgcagatggaagtacccagcttacggacatatgtttttcgcggaatcattgccattgcctgtttgatcattggtttttatgagagctttgtgctgatgtggcaaaacctccgaatcggcgtggccaactactcactacttgtggtgctcatggcgatcgtgttgtttatcggactggaccgcaagcgtgctcgtgcattgaacattcacgaccgcgaagtcgactacatcattggtggcattgtcgtactgatagccatcacgattaagagccagcttctgccacgttttgtggactgggaaactctgctgcgcttggatatgttcgcactgttattctttgcgtttggtatttccggcctggtgtttggcatgcgctctaccttttcttttgcacccggctggattttgctgtttggctacaacgcggtggcacacctgatcatctcggtgattttcggtggtggcttttggggcccggtgatggcaaacatcattggactgtctcttgcggtgttggtgtcctccaacagggacctggttcaggccacctatttggcactgatgacggtgttgtttggcgtcattattgccatcatcgtgtgggcgctgaccgatggcagtaagttcctcaccttggtcccagcagtgctggcaaccatcactgtggtgttggtgtcttcgcgttggaggcttggtcagtggaaaattcgtcgtagacaacccacggtggaaaaagccggacccgcgcttatcgcggtcgtggttgcgacagcactcttggcgtggattcctactccttatgtggagcgcgtcaacaacctccccgggcttcaaatgctggcaaagcctgccccaggtgttatcgcacctattggttggcacatcgacgatgtgcagtattacaactgggcttcgcgctacttcggccccggttcctctctgcttaggcagacgatgacggcagatcattacaacgaggcgtgggatccagatggactcgaccgaactgttgtggtggataccctccaatcggcggaacggttccagcagcgtgcctttggtgacgagacgctgtattccactctgagaggtcgaaagtcagataccgtccaggtggatctgggatacggcgtggacggacgcgcctacacggtgctcgatgaaactgacttcttgacgtacaccaagctggtttttgaatggcagaccaccaacaacaccgtggagaagatctccgtcatcgcggtggatgatcaccgcgcagaagcgaagttcccggagcttgcaccatcggttaccagaatgtttatccaggtggctaccattttgttccgtggaaatgacgtgaccatcgataccaatacccaattgaaagatcttgacctggtcagccaagttggccgtcagatcgtggcagaacaacaggtggggaggtcatgatggaacaagatctcagctac

SEQ ID NO: 2402 - protein, 513 aa, Corynebacterium glutamicum
MSNPSLEPLEPIELSDGTEIEVSDVDPEPQAGNAQMEVPSLRTYVFRGIIAIACLIIGFYESFVLMWQNLRIGVANYSLLVVLMAIVLFIGLDRKRARALNIHDREVDYIIGGIVVLIAITIKSQLLPRFVDWETLLRLDMFALLFFAFGISGLVFGMRSTFSFAPGWILLFGYNAVAHLIISVIFGGGFWGPVMANIIGLSLAVLVSSNRDLVQATYLALMTVLFGVIIAIIVWALTDGSKFLTLVPAVLATITVVLVSSRWRLGQWKIRRRQPTVEKAGPALIAVVVATALLAWIPTPYVERVNNLPGLQMLAKPAPGVIAPIGWHIDDVQYYNWASRYFGPGSSLLRQTMTADHYNEAWDPDGLDRTVVVDTLQSAERFQQRAFGDETLYSTLRGRKSDTVQVDLGYGVDGRAYTVLDETDFLTYTKLVFEWQTTNNTVEKISVIAVDDHRAEAKFPELAPSVTRMFIQVATILFRGNDVTIDTNTQLKDLDLVSQVGRQIVAEQQVGRS

SEQ ID NO: 2403 - DNA, 405 bp, Corynebacterium glutamicum
  CDS (101)..(382): RXA01760
acctactcaaactttcctctgcgccataacgtgaagtgagtgccggggcagtcccggcagcacccaaaagcgcatttttgatacgaaagtgagtcatacgatggcagcatttctagagatcaccttgaaaatcaatgacgaaggccgcccatcagcagctggcgtctaccaggaatacaagcaaccattcctcagctcaattgctggcgctacaagcaaagaactcctcatccgagaagaagacgtgcaggtgctccacggctgtgacaccgtagctaatgctgaagattatcttgtcagcgaactgttcacggccgatgttgtcggtggtctagctccactattgcaggctgatccagagattcgtatttaccaggtcgcgtaactgctgtggcaggctcatcg

SEQ ID NO: 2404 - protein, 94 aa, Corynebacterium glutamicum
MAAFLEITLKINDEGRPSAAGVYQEYKQPFLSSIAGATSKELLIREEDVQVLHGCDTVANAEDYLVSELFTADVVGGLAPLLQADPEIRIYQVA

SEQ ID NO: 2405 - DNA, 501 bp, Corynebacterium glutamicum
  CDS (101)..(478): RXA01768
gacaacgaacacaacacccagatcctgcactggtccggcgttaatcgctacctcatgcaggcactctcccgtactcatttctagaaaggtttttcccgtcatgtctgaatctacttcttctgctaactccaccaccatcctcaacgacaccttcaacccgaagcctggcgtaccttatgcacgcgtcgataatctcgaatttgccacacgtgacgaattccgcgcttgggctaccgcagagatggaggccggtaacgttatctctgcaaccatcgccaatgccccacgcgaagaccgcatcaagtcttttgtcatggatcttgttcgagacggtattgacgacgctgctgaggaaatcgtctcacgcattgatagcggtgacttcactatgaaggaagctctcaccgcgatcgcggcatcaatcaacgacctcgatgctgacgatgtagtcagcgacatcgttgaaaaccacttcaactagtcaacacaccagccctccac

SEQ ID NO: 2406 - protein, 126 aa, Corynebacterium glutamicum
MSESTSSANSTTILNDTFNPKPGVPYARVDNLEFATRDEFRAWATAEMEAGNVISATIANAPREDRIKSFVMDLVRDGIDDAAEEIVSRIDSGDFTMKEALTAIAASINDLDADDVVSDIVENHFN

SEQ ID NO: 2407 - DNA, 3888 bp, Corynebacterium glutamicum
  CDS (101)..(3865): RXA01770
tgctcatgacaggtaattcaacgcgttaccctgctgcagcataaaagaacctgcctcaacacacctccactttttctacttttaagaaagccacattctcatgccaattatcattgataacctcaattctgacgacgactccaccatcggcactgccaccgaatacaaccctgacactgacgccgatttacttgatgctattaacgctgatgctgaccttgatggcgacgccaccatcagcactaacgcgacagaagaaggtgtagacgcagcagctgaaaaacctaagaaaaagcgtaaagcccctgctctgaagcctaaaggactcacggcaaagttcttccaccgtgatcttactggcgtaggtggtaggaccggtcgcctcaacaagaacgtacacccgaccaacccagatctgtcctaccagccagtctctgatgtctacaccccacaatcagcagatcacaagggtattaagacccgctacatccttacccatccaacccccgctgttgttctcagtgagtccatcagcaacgcgtttcatgtctctaccctgcgtcgcaacaataatgtcaacaactctgattcggaattggctgcctggccgtacctctaccaactcgatattccgcagctggaccagatgattaatgtcgctgacatctgtgattaccatttccacggatataacctgtgggtggattttaccccgcagactatcgctctacgatccggtaagacggtactcgatgacggtaccaccgcctctgataacaccactcatgtctattaccgcgtcaccgttcacgttattgccggtcaagatcatggatctactctgcttgatgaccagggcaaccaggtgcttgatagggatgataatcctatttctaccccaagtatcaagcgtattggcgctgtcactgatcttttcgatcacaatccttttggcttcgctagtgtaaactctttcgcatttgtcgatttctcatgggacccagccaccaccttggtcgatatgctcaacaaccttgattcatatctctctaatcacatcaatattgccagctccccaacccccattgccctcgatatggttgtgctcaatgaatggtctgaaaagtcctatcagctgtgcgaacgcgttgttgcacaggcaaagctcatcaacagcaacaagatcaccgcacatgtgagtgatgtcatcaagcaaaatgcccacaatatcttgtggtttaccgaacagatgaaccctggcaccaccaacctcagcgaggtacctatctccaagaagtctatgctgccgatgtctcgccagctacgtattttggagcactacgatgtaccactgaccgcgtactctgctcttttctggactgtcagcgccattaagaatgaatctatggtgcagtaccttgtgcgacagaatatgcagctcaccttgagctcaaatctggatgcactcaactccattgtctcccagctccctgtaccagataaggacgttgtggctgcttctggctaccagattcagccacacttctccacgcagcagcgtgaagcaatcaccactgataatcctctcgcgattattcaggccggtgctggtaccggtaaatccaccgtgattctggaacgcattgagtacttgtgcgctgcaggcaccaaccctgaagagattgctgtgctgtcttttactaatgctgccgccgataacatcacagcaaaaaatgacaaggtgacctctatgaccatctccaagatggttcatgagatttacgcacacaatttccctgatcatgagatctccaccatcgacaccattatcaatacgcttgatattgaatacggcgatcaaatggtgacctccgattacatgattcagctccgtgacctgctctataaggtcatgacgcagggtggcaacgccaacctgacagcgttgagcatcttcatggaatcccatatcgaggcgttcatctcggtgttggatcagatcaagcagacttctcttgagctggaaatcatcatctgctacctgctcttggataagctgatcgagcctcatgcatcgccgaagtacctcattattgatgaggtgcaggacaactcggtcttcgagttcgtctttgcacttcgttttgcggcaaagcacaatacgagtctgtacttggtgggtgactcgtcacagaccttgtatgagttccgttctgctaaccctaaggctctgaactccctggaagcatctggtgttttcggtacctaccgtttgaccaccaattaccgttccaaccaggaaattcttgacttcgctaatatccacctctcggatattgaagctaaccagttcgcaggtattcagctctacgccaactcttttgatgcacctactgcggacagcttcaaagaaaaggttgaactggacatgcaccatgtgtctaagcagtctgagtttaccgacagcattccttatttcatggagtccaataaagctcgctttgatgctgcgatcttgaacaatgagcaaaccattgtgcttgctcattctggtcgtgaaattcgtgcagcgcagcaagcgctagccgagatgtaccccagcatcacggtgcgtaacttgcagtccgataagggtttcaacaacacggtattttcgacctttattaaggatttctggtttgaggtcaccgctgtagacccagctcatgccgcatttacctttaccagccaagtcaccgctcatctagataagttggtacgcggaaagcgtgagcagatggaggatcgcgttatccggtctatggctgcatggtggcgtgaaaatgagcgtgacatccagggttgggtgcagcaaactcagtccggtgcgatcaccaacgaagagttcttctaccgtcttcgtcagtgcattcttgactatgaaatcaggaataaccgagcacgtcagtccatgctcaatgcgcgcaacaacgctaacaaggaggctgtcgcacaggagaaaccactgctcatggtctccaccattcacagtgcaaagggtctggaattcgataatgtcatcgtgcttcaaaaaccaagctccgatgcagagatgaccgaagaaggtaagcgcgcaacctatgtggcgctgacccgtgcaaaaaagcgtgaactcattattgctggttctactcgcgcatacccacgcatcgtcaccgattatgagcaaatcgttgatcttcttgaaaagcgcgatgaggagcgcaaaattaaggaggaagaggctgcagcactcgccacccttgaagctgaacaggagacgcgcgcccttgctgctgctgaggcgcaggctcaggcgttgttgcttgagcacaacccgtggttgcgtgatctcagcgatgaagaagtcactgctctaactgagcaagagatcatcaacaatgttgagccagccctacagattgaagaagaggaggaagaggctcgtgcactcgctgcagcagagccagcaattcagcagtacttgtctcagtttgctttcgatgagttcccggacgacgacaatgtagccaacactgtcgtacatgtagcaccacagcctattctccaccaggcagtgcctgcagatgtgactgtacaatcaagcaccgcccccgtaacacctgttgttgcggatcttgaggtaaccactgttgcagctgatccagtcgaaccgactatcgttgctgcacagcctgaggtggacgacaaccttgtctacagcacgtccacccctaatagtcacagtgacgttattgcagtgaactctgatacctcagaaaacgctgctgttaatccagttctgtccgatattgaggcactccgagcaattttcaacaaccaggactaaaacacctgctgctgttgagc

SEQ ID NO: 2408 - protein, 1255 aa, Corynebacterium glutamicum
MPIIIDNLNSDDDSTIGTATEYNPDTDADLLDAINADADLDGDATISTNATEEGVDAAAEKPKKKRKAPALKPKGLTAKFFHRDLTGVGGRTGRLNKNVHPTNPDLSYQPVSDVYTPQSADHKGIKTRYILTHPTPAVVLSESISNAFHVSTLRRNNNVNNSDSELAAWPYLYQLDIPQLDQMINVADICDYHFHGYNLWVDFTPQTIALRSGKTVLDDGTTASDNTTHVYYRVTVHVIAGQDHGSTLLDDQGNQVLDRDDNPISTPSIKRIGAVTDLFDHNPFGFASVNSFAFVDFSWDPATTLVDMLNNLDSYLSNHINIASSPTPIALDMVVLNEWSEKSYQLCERVVAQAKLINSNKITAHVSDVIKQNAHNILWFTEQMNPGTTNLSEVPISKKSMLPMSRQLRILEHYDVPLTAYSALFWTVSAIKNESMVQYLVRQNMQLTLSSNLDALNSIVSQLPVPDKDVVAASGYQIQPHFSTQQREAITTDNPLAIIQAGAGTGKSTVILERIEYLCAAGTNPEEIAVLSFTNAAADNITAKNDKVTSMTISKMVHEIYAHNFPDHEISTIDTIINTLDIEYGDQMVTSDYMIQLRDLLYKVMTQGGNANLTALSIFMESHIEAFISVLDQIKQTSLELEIIICYLLLDKLIEPHASPKYLIIDEVQDNSVFEFVFALRFAAKHNTSLYLVGDSSQTLYEFRSANPKALNSLEASGVFGTYRLTTNYRSNQEILDFANIHLSDIEANQFAGIQLYANSFDAPTADSFKEKVELDMHHVSKQSEFTDSIPYFMESNKARFDAAILNNEQTIVLAHSGREIRAAQQALAEMYPSITVRNLQSDKGFNNTVFSTFIKDFWFEVTAVDPAHAAFTFTSQVTAHLDKLVRGKREQMEDRVIRSMAAWWRENERDIQGWVQQTQSGAITNEEFFYRLRQCILDYEIRNNRARQSMLNARNNANKEAVAQEKPLLMVSTIHSAKGLEFDNVIVLQKPSSDAEMTEEGKRATYVALTRAKKRELIIAGSTRAYPRIVTDYEQIVDLLEKRDEERKIKEEEAAALATLEAEQETRALAAAEAQAQALLLEHNPWLRDLSDEEVTALTEQEIINNVEPALQIEEEEEEARALAAAEPAIQQYLSQFAFDEFPDDDNVANTVVHVAPQPILHQAVPADVTVQSSTAPVTPVVADLEVTTVAADPVEPTIVAAQPEVDDNLVYSTSTPNSHSDVIAVNSDTSENAAVNPVLSDIEALRAIFNNQD

SEQ ID NO: 2409 - DNA, 467 bp, Corynebacterium glutamicum
  CDS (34)..(444): RXA01773
tttcagcgagatggcgtgcgctttgatcatacgatgatcacccacattcaagccggcctgcatcttggtggctgccgcgcagcaggtttactgcctataccagcacatattgatcatattgtgcgcctgacagccgcagatttctatgacacccagtcagcaccgcagctgctcagcaacactgtgcttgatgtattggacaccaccactcaagacttgaaggcattgtggcctgttgcagaacatattgctacaaccattcctgaatctgagaacgtgcttatccactgccagatgggtatcaaccgctcagctgcactcatgacacgggtgttgatgttgcgcaacgattgcaccgccgatgaagcaattgcactgctgcgtgatcgacgctcaccgtttgtactgttcaatgagcattttgtggaacaacttcgagcactgtaagcgctcaaagacccattacc

SEQ ID NO: 2410 - protein, 137 aa, Corynebacterium glutamicum
MITHIQAGLHLGGCRAAGLLPIPAHIDHIVRLTAADFYDTQSAPQLLSNTVLDVLDTTTQDLKALWPVAEHIATTIPESENVLIHCQMGINRSAALMTRVLMLRNDCTADEAIALLRDRRSPFVLFNEHFVEQLRAL

SEQ ID NO: 2411 - DNA, 687 bp, Corynebacterium glutamicum
  CDS (101)..(664): RXA01775
gtggaaaccaaagacgaggaaagtatgtctatttgtttgtccccaggttgtccacatttgttttattccccgagaatgtcctagaaaggaactcgaccccatgtcctattcactcattatttctaaagcaccaacccactccatgccttttaatgaggctgaactcctagagcttgtcgatgaactgcactccgacaacaccgtgaaaaagccggttattgtgccactccccgatgatttctcctacaccgtagatagcgccgtgcgactacatgatttgggtgttgaccaggaactgactgactggattactgcacaagttgctgcagcctatccaaaccagatcgtctcagagattgctgctgcccctgatccgcaagccaagaccttattctccgccaatgcgtataacaccaggtcttttggtactttttggactgagcaccctattacacagctccaatacaagcgctgctaccaaattgtcatcgagaacgttacgggtgtctatcatccgttacctgttgataactaccgctacgtaccccctgtcacgccctcattgccacagccggtctaccacgaagctatcgccttaaatgagtctgatgtcgctgatcacggtactcgtgcagccaagcacgcaatgatcaaccgcaacgtataaccacacacgccacagatact

SEQ ID NO: 2412 - protein, 188 aa, Corynebacterium glutamicum
MSYSLIISKAPTHSMPFNEAELLELVDELHSDNTVKKPVIVPLPDDFSYTVDSAVRLHDLGVDQELTDWITAQVAAAYPNQIVSEIAAAPDPQAKTLFSANAYNTRSFGTFWTEHPITQLQYKRCYQIVIENVTGVYHPLPVDNYRYVPPVTPSLPQPVYHEAIALNESDVADHGTRAAKHAMINRNV

SEQ ID NO: 2413 - DNA, 1575 bp, Corynebacterium glutamicum
  CDS (101)..(1552): RXA01776
cgtataaccacacacgccacagatactcagctatctgtggcgtgttgttttacatcaacctctcacccatcccccatcactattaaagaaaatcaccatcatgacccacactgataccccagcccctgcacacggcgtaacaccgagtgaattcgctgttacctcacacgaactcaccacctcaccaacacctagtccgacacaggtcgctattgcagcccaggaaaaaattcgccagcgcaagctcgaagagcttaaagcaaaaaagcgcacagacacgacagctcaaccacttctacctgcacctgtgctgcatacacgcccactcccctcaccgaatccaccgcgaccatctccaccggcacctaccactggacactgggaacttcttattgtcaggtcacagcagaagaaaatgaccgcagccaatccctttctcaaattccttcatctcggtaaagccttcaacgtgaaagacctagggctcacctgcgatcgcaccactgatgttgacctctcacggcttggcaagctcaatccgcccagctcacttatccttgaactagcaacggcacttgacctgcatccattcctctcagtcgcactctcttcgcacagtgcggtcaacgcccgtcgcaaccaacttgaattaaccctgcacaaccatgacactcagggcacagcattaggtcacagcgttactatggtccagctacccgaggtcattaatcgagctgctgtagagccctatatcaaacccaagggctcgggcaatgacccgcttgaccaaagcctgaaccaccgcgcacccaccgtaagtgacgtgcaaaaagcccttgtgcaggaaaacacaggcacggcaacagacagcaacaactacctgcttccttttgatcctgattctggtgcaccaaaaaccaccgcgcttaatgcgcctaataaggatctcctacaggccaggcatgagcttgcctatattcccgagatccccgccattgcatcgtggctcgatcaccttgaccccatcatgcgtgtgcaccgtagtcttgcgctttcaattttcccagtgcagcttctacgtgctgccgttgagaatctccctcataacgtaaccgatctgcataatcaccttgatcctgaggatctgctccctgaggaactcaccacctggctcgatcacctcttcgatgcagacttaaccgctctcgcttcatgcccacagcttgcaccacctatcgtgcgcagccacaatcacgccaaagcgatcgcagctatcaccgtgacctctgtcatggacgctctcatcgccaaaactcttgatgcgcatgacgatccactgccctcactaccggagtttgtagaactactgcgtgacgctgtagcccagctcgcagcgcattttaagcagcagcgcggcgaggtactaccgcagcccaatggcttgcgatacgccaccgactttggcctgctctcttatattgccgatggcttacatgaatatgcacttgccatcgacttcgggctgatctacccgaatgaactcatcaccgagtaaacccactcctagaaaggtct

SEQ ID NO: 2414 - protein, 484 aa, Corynebacterium glutamicum
MTHTDTPAPAHGVTPSEFAVTSHELTTSPTPSPTQVAIAAQEKIRQRKLEELKAKKRTDTTAQPLLPAPVLHTRPLPSPNPPRPSPPAPTTGHWELLIVRSQQKKMTAANPFLKFLHLGKAFNVKDLGLTCDRTTDVDLSRLGKLNPPSSLILELATALDLHPFLSVALSSHSAVNARRNQLELTLHNHDTQGTALGHSVTMVQLPEVINRAAVEPYIKPKGSGNDPLDQSLNHRAPTVSDVQKALVQENTGTATDSNNYLLPFDPDSGAPKTTALNAPNKDLLQARHELAYIPEIPAIASWLDHLDPIMRVHRSLALSIFPVQLLRAAVENLPHNVTDLHNHLDPEDLLPEELTTWLDHLFDADLTALASCPQLAPPIVRSHNHAKAIAAITVTSVMDALIAKTLDAHDDPLPSLPEFVELLRDAVAQLAAHFKQQRGEVLPQPNGLRYATDFGLLSYIADGLHEYALAIDFGLIYPNELITE

SEQ ID NO: 2415 - DNA, 582 bp, Corynebacterium glutamicum
  CDS (101)..(559): RXA01777
ccgatggcttacatgaatatgcacttgccatcgacttcgggctgatctacccgaatgaactcatcaccgagtaaacccactcctagaaaggtctttacccatgtctcgtatcatcactgctcccgtccacaagccttatattattgctcgtgaagtcaagggggtctcccatgtccacgacactgttggcggcaagtggcaggccaccttgcacacacttaaaccggggccctcctggccgaaaccgtcacagttcactgcgcctaaatccacgtccatctggtttattgcggtagcaacccacccacgtaacccacgggcacgcaaaggtaccctacttggtcgcggtggtctttacgaactcaaagacactgatctgaactttctcacagagcgacaggatttgctcgccacatctacctctcgtgacccagaggattgccgtttacgctttaattcgcgtcacgatgcagcagcatttttacatgctaacgcccgccacatcaacaagctttttcatccagcactaggtcatgctcgctacgatctcatagatgtgtaagcacaacgcttagcttatga

SEQ ID NO: 2416 - protein, 153 aa, Corynebacterium glutamicum
MSRIITAPVHKPYIIAREVKGVSHVHDTVGGKWQATLHTLKPGPSWPKPSQFTAPKSTSIWFIAVATHPRNPRARKGTLLGRGGLYELKDTDLNFLTERQDLLATSTSRDPEDCRLRFNSRHDAAAFLHANARHINKLFHPALGHARYDLIDV

SEQ ID NO: 2417 - DNA, 1260 bp, Corynebacterium glutamicum
  CDS (101)..(1237): RXA01778
ctactaccccctccgggtgtggggtagctgtaacaactaccccacaatcttagccggtcttccatacataactgcgaaattggttagagtctttttcatgatgctctaccaacacaccacacgcgggctgatcattagtgacgcgatcatcgcgaaaatcagccaagtcaaccaactgctgctactaagacccacgctgttgcaagacaaagatatgcaccatgcgacattgagtagcgacaccccatcaattcgcagtcgccgtcgctcctatcgcgagaataaagccgcctatgcgaccacgagcaccatcagaaaccgtgagacctttttcagcacatctgatattgatttcgccatactcatgattcaggacgtacaagaatctctcgtatcttttgaccccaccttggctcaagatatgaagccaagaaccaacgcagtcatttctgcactcaatgagctacgcgagccactggataccttctaccgtgcccatgaatacggtgacatcatcagcgatggtgcttatgagttcgatcatgctgccattgatgcacaacacagccttagtgaactcgttgccggtctgcataattatgacaacctcatgtttccccaggaaaccgctccgttgatgagtgaatccaatggcattcagctggctcagtactataagtccaccaaactcgatgagtcacaattgacggtggaacctaatgagcctggtatcagcattatgtggcacgcccatgatttcacctggtcttgcctagtgcgctatgacgacatgaaccgttaccctgagcatttcagcatttcttttaaagacatgctgatccctgaacagatctatactttccacttcaccccacgtgaggcaatgcaactgcgcaagggactttttaatgccatcgctgcctacaagtctcagacatggggtgatgagaacactgatctcaccaaggctgaactcgaatttggtggcacctccatgaccttccgcgccggcctctcacagcttagcgtcaccggacctcctgatcaccgccaggtgttctgcttgtcgtcttctggtcgtgaggatcacaacaccccgccaaacatgcgagacggacatgtcattgatattgcggttactcaattgtccaccctgcgtaacctcattcgggtactgtgcaccactcacccggatcattcaccagcactgctaccttatggtcagcagtacaccatctaacatgctctaactcgaccccg

SEQ ID NO: 2418 - protein, 379 aa, Corynebacterium glutamicum
MLYQHTTRGLIISDAIIAKISQVNQLLLLRPTLLQDKDMHHATLSSDTPSIRSRRRSYRENKAAYATTSTIRNRETFFSTSDIDFAILMIQDVQESLVSFDPTLAQDMKPRTNAVISALNELREPLDTFYRAHEYGDIISDGAYEFDHAAIDAQHSLSELVAGLHNYDNLMFPQETAPLMSESNGIQLAQYYKSTKLDESQLTVEPNEPGISIMWHAHDFTWSCLVRYDDMNRYPEHFSISFKDMLIPEQIYTFHFTPREAMQLRKGLFNAIAAYKSQTWGDENTDLTKAELEFGGTSMTFRAGLSQLSVTGPPDHRQVFCLSSSGREDHNTPPNMRDGHVIDIAVTQLSTLRNLIRVLCTTHPDHSPALLPYGQQYTI

SEQ ID NO: 2419 - DNA, 1542 bp, Corynebacterium glutamicum
  CDS (101)..(1519): RXA01779
ttagtatttagtcaattagccaactacgataaaactagtgaataaacatactagttcactttgtcgcgcttaaaatactagaaagtaatataaaaaactcatgcgttatactccccgtacccaccgcgcactcggacttgctgcacttaccgctacagctctcctactgagctcatgctcgaccaccgctgaccttctcggcgccgattctgtggcgcaggctgtcaccgatggtggctctgcccttgatcccactgcagctcatgtgctcaccatcaccaatgccactgcaatgactcttgctgagctaccagaaaacaccgaccctgacgcagccaataacacggagccaacaatggcccaaagcgccctcaagcgtatttacggtctcgaaattgccgccgatggcactctgattgctgtcgcagcgccattaacctcgcgaaatagtggttctgagcagcctactgtcgcagcaatggctgatccagaaaacaatgctgaactcaccacagcacatattcttgagatcgacccagccacaggaactgccacaccacgtcaagatattgctctgactgaagattttcagaccatggctagctcttttagccagatccgtaatggctggggtactacccaactcatcggacaacaccctgatgatcccaagcaacctattcgttcagctgatacctggactgtcaccggctccactcagatcaccggctttaacaccaacaccccaacgggaaccgaagatgctgcctacaccatgccggcgactgagccagctgtgggactgtgcgctctagaatcaggctccgatgcaccactggatgaacaccgtgagctcagcaccagtgcattgcgtaccgcatcagtattgtcgagctctggatctgccaccctcaagctgcatgatcctatggtcatgtctgctactggcattgtccaagcacgcgcctatgtcgatggcgaagtcattaaccagcacgagattggcgatctccgcgagcagctcggtatcaccatcgaagaatctgaggctgctcaagcagaatcggatgcccaagcagccaccgatcacccacttgcagccctgggcttaagcaaccccaccagctcagcgttggttccaggtcttgctgagcttgattgtctcagtgctgaccaggctgccacctggcataaccgcgacaccagcattggcaccggtaagcccagcgtgcttgctgtcatcaacgcggaaatggccgatgactttaccctgcagctgttgagctcaggtgccaccactgccgaaacgcagcttgcccagctgccggatgaaaccgcgttcgtgctcattgacccatcatctggtgctgttactgacctgttctttatccaaagtctcaacactgatctgccggcaccaacaacccagattaattctattgctgttgatgagcgcgaccccaacatcatctacgccacttttagcggcgatgaccacctgtaccaaatgatgctgggttagttacacaactaactaaccag

SEQ ID NO: 2420 - protein, 473 aa, Corynebacterium glutamicum
MRYTPRTHRALGLAALTATALLLSSCSTTADLLGADSVAQAVTDGGSALDPTAAHVLTITNATAMTLAELPENTDPDAANNTEPTMAQSALKRIYGLEIAADGTLIAVAAPLTSRNSGSEQPTVAAMADPENNAELTTAHILEIDPATGTATPRQDIALTEDFQTMASSFSQIRNGWGTTQLIGQHPDDPKQPIRSADTWTVTGSTQITGFNTNTPTGTEDAAYTMPATEPAVGLCALESGSDAPLDEHRELSTSALRTASVLSSSGSATLKLHDPMVMSATGIVQARAYVDGEVINQHEIGDLREQLGITIEESEAAQAESDAQAATDHPLAALGLSNPTSSALVPGLAELDCLSADQAATWHNRDTSIGTGKPSVLAVINAEMADDFTLQLLSSGATTAETQLAQLPDETAFVLIDPSSGAVTDLFFIQSLNTDLPAPTTQINSIAVDERDPNIIYATFSGDDHLYQMMLG

SEQ ID NO: 2421 - DNA, 498 bp, Corynebacterium glutamicum
  CDS (101)..(475): RXA01780
ccacttttagcggcgatgaccacctgtaccaaatgatgctgggttagttacacaactaactaaccaggcaccaacattttcttaaagaaacacccttatcatgacttttctccaccccaaggctgcgttctaccctctcaccatggatcatcttaccgatctcggtcttgatcctgagcaactcattaatgagttgccgacgattacctacgacgttcaaccacacaatgtctttgttctacagttcagcaccgccgatgtgcgcgtctaccaggaaggtaataccctttttatccgcagtgctgaattaatcaaccctgaactacgacaacgacagcgcacacagctcaacgacgatctcaacaaccctgcttcacttcgcgtctgtgatgagatcagtggccgcagcaccgtgttcctcaaagacaaaagtgttgtcactcacgatcacgggaccaattgctgtgattccgcataatcctgatgaagccagcgcca

SEQ ID NO: 2422 - protein, 125 aa, Corynebacterium glutamicum
MTFLHPKAAFYPLTMDHLTDLGLDPEQLINELPTITYDVQPHNVFVLQFSTADVRVYQEGNTLFIRSAELINPELRQRQRTQLNDDLNNPASLRVCDEISGRSTVFLKDKSVVTHDHGTNCCDSA

SEQ ID NO: 2423 - DNA, 384 bp, Corynebacterium glutamicum
  CDS (101)..(361): RXA01781
cgacagcgcacacagctcaacgacgatctcaacaaccctgcttcacttcgcgtctgtgatgagatcagtggccgcagcaccgtgttcctcaaagacaaaagtgttgtcactcacgatcacgggaccaattgctgtgattccgcataatcctgatgaagccagcgccaaggctgtcgctaccaaacataagcacaccttgtccggcgctacctctgatcacccttatgccggcatgacgcttaaagacatgattgaacagggctttacgctcacaccgctggaattcccgctctgtgctgtcgatgatccaacagattctgatcgcaccatgcacgtgatcaatgttcgcgagcacagtatgtagattctaaagtgcggtacaac

SEQ ID NO: 2424 - protein, 87 aa, Corynebacterium glutamicum
VLSLTITGPIAVIPHNPDEASAKAVATKHKHTLSGATSDHPYAGMTLKDMIEQGFTLTPLEFPLCAVDDPTDSDRTMHVINVREHSM

SEQ ID NO: 2425 - DNA, 519 bp, Corynebacterium glutamicum
  CDS (101)..(496): RXA01782
acgtgatcaatgttcgcgagcacagtatgtagattctaaagtgcggtacaacctgtaccgcccacacaattccaccctttaagaaaaggacttagccatcatgaccaccttcgcccttattgctagccccaacaatgttgatcccactgctgagtccccactcgccattgaaatccataccgatgaggacagcagctatccactagggcttattgactcagaccacctggttcctgctgtgatttacggcgatatggtgatctacaccaaaacactgctcgcacagaccccaccagatgatgtgtccactgctagcgccttcttcgacaaactcaccgcacttgacgctcagggtcgcacccgtgatctggtctacagcgccacctacagccaacttgttattgccggccacaaccgcactgtattaactgacgactcagagttctacgatgagttttaccaggttattgaggctgctcctggggtgatcttgaaatgatgtttatcgggcaacacctc

SEQ ID NO: 2426 - protein, 132 aa, Corynebacterium glutamicum
MTTFALIASPNNVDPTAESPLAIEIHTDEDSSYPLGLIDSDHLVPAVIYGDMVIYTKTLLAQTPPDDVSTASAFFDKLTALDAQGRTRDLVYSATYSQLVIAGHNRTVLTDDSEFYDEFYQVIEAAPGVILK

SEQ ID NO: 2427 - DNA, 360 bp, Corynebacterium glutamicum
  CDS (101)..(337): RXA01783
accaggttattgaggctgctcctggggtgatcttgaaatgatgtttatcgggcaacacctcacacttaggctaggtctctaacatgaagcagatagcgccatgatcaatctttttgctgcagccctgcccgcattcgagcctttgagtattacctccatactcgtgctcggtgctgtggcattgatctgtggcctccctgtttttctcgcactggaaaaaagcgctgagctcgatgatctcttcgcagcactcatcatcgctgtacttttaggttttgctgcttatacgtttgtgctccccaagctcgttgaattgggctgtactatttgccagctctgactagcgacacttacactttc

SEQ ID NO: 2428 - protein, 79 aa, Corynebacterium glutamicum
MINLFAAALPAFEPLSITSILVLGAVALICGLPVFLALEKSAELDDLFAALIIAVLLGFAAYTFVLPKLVELGCTICQL

SEQ ID NO: 2429 - DNA, 699 bp, Corynebacterium glutamicum
  CDS (101)..(676): RXA01785
gaccctggcccaactttgcaacagcaccatccacagtgatggcactaccaatactgagcctgactacgcatctaaggcggcgcacattagtgatgcaactgtggatcagttcgttgagttcggcggtggacaagcaaacattaaccctgatggatcagcgaccgttgattgggagggttctttcagcatcaacttctacgatggtttggtgccgtttaccatcacgaatccgcacctcgaggtttctgtagctggtactggtgttttgactggtgacctcactagctatgcagtggagatgtcgaacccgaatgagaaaaccccgttgactgacttgtatgaggatgtcacgatcacaacgtttgggggagtgaaccttgatcctgaaggtgttgtgacaagcaatcctgattatgacggagtgattgttgatgtcccactggatgccacctctcaggttacttccggtgcaggttggggagcgtggccgcagggcttccttgatttccactttgataccaacttgccttcctactggtattcctcagatggcgcaggtgatcctaagaaggcgcctatgagctttaatgttgatttcactaatggtccaggtctggtgaacagccaattgctccacaggcaagtgatctcaatgccggaaaccaaggcagtctcgtagttccatcggaggcagaagct

SEQ ID NO: 2430 - protein, 192 aa, Corynebacterium glutamicum
VDQFVEFGGGQANINPDGSATVDWEGSFSINFYDGLVPFTITNPHLEVSVAGTGVLTGDLTSYAVEMSNPNEKTPLTDLYEDVTITTFGGVNLDPEGVVTSNPDYDGVIVDVPLDATSQVTSGAGWGAWPQGFLDFHFDTNLPSYWYSSDGAGDPKKAPMSFNVDFTNGPGLVNSQLLHRQVISMPETKAVS

SEQ ID NO: 2431 - DNA, 564 bp, Corynebacterium glutamicum
  CDS (101)..(541): RXA01788
cctttaacccaaattcctatatcactacagataccgtgcgcatcgttgtcgatcctgtaccggaaactaatcccgacgatgagaaagcaggacgctagccatgtctcgcagctaccccatctacatcatttcttttgccccagcggatgatctccacggcgttggaggattcgagtgggttccagcatcaacaccagaaaacaaagctgccgccttcacgacctttgatcgtcaattcgatgattctcgtaacaatggtggctcgcatattgtgcgtctactcaatatctctgatcccaatatcacagcggatatgacccaagacgatattaccgcgtacctcgactcaaacatcgaccgctgggaatccacggaacatgcgctcaagcagtttgtcccacttaacgcgggtgctgatcgcgtacctaccggtggtgccgacgagcacattacccacgcctgccgcataataactgtgcagcgtagctgcacacggattcacctgcgctgtggatgcatcccaacaccacaacaccgcccctagtgccataaatgctaggggtg

SEQ ID NO: 2432 - protein, 147 aa, Corynebacterium glutamicum
MSRSYPIYIISFAPADDLHGVGGFEWVPASTPENKAAAFTTFDRQFDDSRNNGGSHIVRLLNISDPNITADMTQDDITAYLDSNIDRWESTEHALKQFVPLNAGADRVPTGGADEHITHACRIITVQRSCTRIHLRCGCIPTPQHRP

SEQ ID NO: 2433 - DNA, 765 bp, Corynebacterium glutamicum
  CDS (101)..(742): RXA01789
tgcatcccaacaccacaacaccgcccctagtgccataaatgctaggggtgtttttttcatacccacaacaccgttcttctctagaaagagactcgatactatgcctcataaccccatcgaacttcacactaatgatgtactcgatgctctcgacattgacgccatctgcgacgatgtgtttctctacaccgacttcgagcacaccccaggtcagcttgatcgcttcgagcaactcgccttcacaaaaatctacgacatgctggaaacagctgctgaaaaattcccagatgtagcaattaatgacactttaagcactggcaaccacgctgctgaacagtactttcttgccaatcccggcaacatcatcgtgctgaccagcttcgcgctcaatcagaccgatctccgcgacctcataatctcaccgtgcattaagtacacagcacatgcacgagcactcatgcgtgcggtgacacgaacattgtgcactgcaaacaaccctgtagaacgcgcgactatcttccctgtgtctgtcgctaatgccttaagcatcgaagcgctgtgttccgaatatcatgcgttccgcaccaagcaggtgctcaacactgctgcactcatcaatcctgataacactcttatacccatgttgttgagcaaagcgtatgaggcatacgcctggcacaagggtgtcgaatccgcgcaacgaggtagcaacctagctcgtgagtactacgcaggacttatctgaaaattcactactcaactctg

SEQ ID NO: 2434 - protein, 214 aa, Corynebacterium glutamicum
MPHNPIELHTNDVLDALDIDAICDDVFLYTDFEHTPGQLDRFEQLAFTKIYDMLETAAEKFPDVAINDTLSTGNHAAEQYFLANPGNIIVLTSFALNQTDLRDLIISPCIKYTAHARALMRAVTRTLCTANNPVERATIFPVSVANALSIEALCSEYHAFRTKQVLNTAALINPDNTLIPMLLSKAYEAYAWHKGVESAQRGSNLAREYYAGLI

SEQ ID NO: 2435 - DNA, 183 bp, Corynebacterium glutamicum
  CDS (101)..(160): RXA01790
gaaaggctcgaacacccatgatcgttgaggtagctccgagaccgaagagatcagcctcattgatgatgattcccctgatctcgatgaggacgataacaccgtgctcatcgccgaagacatccgtgatatggatgactatggcgaagatcatcctgatctttaaagctcactgttaagcccgca

SEQ ID NO: 2436 - protein, 20 aa, Corynebacterium glutamicum
VLIAEDIRDMDDYGEDHPDL

SEQ ID NO: 2437 - DNA, 486 bp, Corynebacterium glutamicum
  CDS (101)..(463): RXA01791
ccgcctgtgcaactaaccctgttgtgcaggcggttttctctatctacaccaacaactccacaacactatccggtccaaatctagaaaagagacaacccccatgacctcccccaccacgttaaagccctggtctattcgcggacccatcgacggtgaatacaccatgcttgaggcatatccgtttcagtatgtagcaaatactcgcccggccatcatgctctacgcactcgatgaaaacggtgtaccggaacaatatgccgacctcaccatcaaccttgccgatgtggagctcaagcaacttaaccacgtcatcattaacccagatctgcacgctgatgttaccgaactgtgcattagcgccggcctgctgcgacctggtgttctgggccagcaccaagtcggtagcaccaccgccaaggtctaccgactcactgagcgtgctgatggctggctacagctgttttagcagctacctgcgcctaatcc

SEQ ID NO: 2438 - protein, 121 aa, Corynebacterium glutamicum
MTSPTTLKPWSIRGPIDGEYTMLEAYPFQYVANTRPAIMLYALDENGVPEQYADLTINLADVELKQLNHVIINPDLHADVTELCISAGLLRPGVLGQHQVGSTTAKVYRLTERADGWLQLF

SEQ ID NO: 2439 - DNA, 396 bp, Corynebacterium glutamicum
  CDS (101)..(373): RXA01792
gactcactgagcgtgctgatggctggctacagctgttttagcagctacctgcgcctaatccccccacccatactcactccaaaacaagaaagtagtcatcatgcctcagtacaccatcacaatcaccgacgagcagaaagctgttctacacagcctcaccaacccccatatcgccactgctgaacacggcgctatcaccgcaatcgagattcatgacgaccacgatgttgttgtctatcacgttcaaccagacggcacactaacttacgagcgccttgttgaaggcttccattacggctggacacgttttgacagcgaaggttttgagatcgactccgacaataaccgcgttgtagacggactccgcgacgaatagttaacaacaacgaccgcaca

SEQ ID NO: 2440 - protein, 91 aa, Corynebacterium glutamicum
MPQYTITITDEQKAVLHSLTNPHIATAEHGAITAIEIHDDHDVVVYHVQPDGTLTYERLVEGFHYGWTRFDSEGFEIDSDNNRVVDGLRDE

SEQ ID NO: 2441 - DNA, 357 bp, Corynebacterium glutamicum
  CDS (101)..(334): RXA01793
ccttctctgcaggctacgcagtgctgcgcctagttcgcagcctgcgccgacttttgcagcgccactaaacacccaaacacaacaagaaagaaacaccactatggcacaataccgcgtcagttttatcgcgctcgccgagtcaaccatcgaggtcgaagcagacagtcctgaagaagcactcgacctagccaatgcagaatttgactacccggtcaccttggccggcgatccctatgagctgcacgactgggaagcacgcgctgaaattgaatggctcgataccagctcgaccccgcagcaacgccttggagaacatgtcgtcaagatcgaagattaaactcgatcattaaacacact

SEQ ID NO: 2442 - protein, 78 aa, Corynebacterium glutamicum
MAQYRVSFIALAESTIEVEADSPEEALDLANAEFDYPVTLAGDPYELHDWEARAEIEWLDTSSTPQQRLGEHVVKIED

SEQ ID NO: 2443 - DNA, 357 bp, Corynebacterium glutamicum
  CDS (101)..(334): RXA01794
ataccagctcgaccccgcagcaacgccttggagaacatgtcgtcaagatcgaagattaaactcgatcattaaacacactcttaagataaggacactaattatggcaacccaccgcgttcattttgtcgcaaccgcatccgcctacatcgacgttgaggcagattcccccgaagatgctatagaaaaagcgtatgatctcgccggtgatctgcccggcctcatcgccgacaacgaatttgatctcggtgaatgggaggtacaggccgatgtccagtggcctgataactctgtacctcgcgagcaacgccttgaagagggcgttgacctgctcgattaaacagaattaactcaaacccc

SEQ ID NO: 2444 - protein, 78 aa, Corynebacterium glutamicum
MATHRVHFVATASAYIDVEADSPEDAIEKAYDLAGDLPGLIADNEFDLGEWEVQADVQWPDNSVPREQRLEEGVDLLD

SEQ ID NO: 2445 - DNA, 1317 bp, Corynebacterium glutamicum
  CDS (101)..(1294): RXA01799
tattttgggcatgcactcgtcatatcttcacagacgtatggttttgtaacaacctcccccaaaatccccatagtttcccccggtgcatatccttaaaggtatggaaattccgctgcccacatcccttatcgatgtcatcactgatggtgccctcggccaaacctgcattgatcaggcatttgctgcccaattggggcgagttactggagtcgaattcaacctttctgacgataaaaccgcggctgaagtgaggatcaataaggcgtcggggagtccttttgataccaccggtgaagtcattgcgtggattaataatcaggaatttgagtgggtcagcacgcgcggtgaggatttgggactgcctgaattgcagggcattcagccgctcgacgatgatctgatcaccgccgcacgcacgctgtatagcaatgcgccggcgttcatcgccccgttgcgcgatggtcgcagggcgttggttgcgatcaatcacacgccaaaactggttggtatccgtcgcacgctcatcgaaggcctgcaggcgctgaagcctggaactgacctcaaacgggcattgacttcatttgctgcattctgcgaactgggcatccgattcgatgacaaccgcatctccttcagcgatggcacctcgctgttgcttcgtggcggcaaagtcatcgaaatcgcaggcgggctgagcttgcgcgacgtacgcgcggatgcggcgttcatgtccgctgagcatcaattgcttttcgacgccatctcctcgtctcacaacgtcacctttgacccacacaccaacgtggcgaccgtggcaaacgaacaccaagttcacgccatcccccttgctgttatcgacggcacgcgttgggtatggacatggtctttaaaagaactcaatggtcaagcaactgaaggccttgcccgctttggtttcgataacggcctactactgctcaccaatgcagagatccttgctgaggaagccaccgcattcaacctgattgatgtggctaaacaggtgctcaacacttggacgcacaccatcgtgcagcaacctgatggcaccggaattgtcctgctgctggatcatcctcggctgcagcttccgccagcatcacatgcagctgttgaggccacgctgtatcaccagctaccaggcgatattgatgcccgccgcgcggtggcgtcctatgcagctcaccgacagcttccttttgatggctacgcactcaccgttgagggccaacaagtcggcgtgacttttgacggcgagcatttaacaaaggtgggctagttttctagcaaaacccaacc

SEQ ID NO: 2446 - protein, 398 aa, Corynebacterium glutamicum
MEIPLPTSLIDVITDGALGQTCIDQAFAAQLGRVTGVEFNLSDDKTAAEVRINKASGSPFDTTGEVIAWINNQEFEWVSTRGEDLGLPELQGIQPLDDDLITAARTLYSNAPAFIAPLRDGRRALVAINHTPKLVGIRRTLIEGLQALKPGTDLKRALTSFAAFCELGIRFDDNRISFSDGTSLLLRGGKVIEIAGGLSLRDVRADAAFMSAEHQLLFDAISSSHNVTFDPHTNVATVANEHQVHAIPLAVIDGTRWVWTWSLKELNGQATEGLARFGFDNGLLLLTNAEILAEEATAFNLIDVAKQVLNTWTHTIVQQPDGTGIVLLLDHPRLQLPPASHAAVEATLYHQLPGDIDARRAVASYAAHRQLPFDGYALTVEGQQVGVTFDGEHLTKVG

SEQ ID NO: 2447 - DNA, 843 bp, Corynebacterium glutamicum
  CDS (101)..(820): RXA01800
ccagcgcagttcataaaaccgccaaacttttgatagcgtagcaatggccctttcggtggatggggccatgtttgcacaatgcttgaagaagggtagggcagtgaagccgctgggcaagatcgccgttccttggacttggtacctgggaattgttggggtcatcatatttgatgtggtggcagcaataacgatgctcaccctcgtgcccaacaaaatgcccgaaagagtcaacagtgggcttgtcgcgctgggtggatcgtatgcacccccgatgagccgggaaacactcattgccagagtcattgccggtgcagtgctggttctggtgatttctttaggtatttcgctgctgatttccgcgcagtccaagaacctcgcgtccgatcacccggatgcatctgccattcagattgctcggcgttgggcgtttttgaacaatattcaaagctgtatcggctggtttagtttcttcctcgcagcgattttgagcatctcatcgctaagactcaacggcccaggtgccaccacgcatcttgagatggccgtttacatcatcgctgtgtcggtgttggcttgggcgttgatgatttccttgcgacgcggccaggtggcgattgatcgtgccattccaattcgggaagatgattccgaactgaaatggggcatgatctaccacgatgcttcagacaaacgagttttcgtggaactcgatgatggccacacgaccgtcatcaacatggcgcgcgggggagcgtggctgctcatcgcagtgatggtgctgcctgcgctggccatcgtcggttgggttttgctagaaaactagcccacctttgttaaatgctc

SEQ ID NO: 2448 - protein, 240 aa, Corynebacterium glutamicum
VKPLGKIAVPWTWYLGIVGVIIFDVVAAITMLTLVPNKMPERVNSGLVALGGSYAPPMSRETLIARVIAGAVLVLVISLGISLLISAQSKNLASDHPDASAIQIARRWAFLNNIQSCIGWFSFFLAAILSISSLRLNGPGATTHLEMAVYIIAVSVLAWALMISLRRGQVAIDRAIPIREDDSELKWGMIYHDASDKRVFVELDDGHTTVINMARGGAWLLIAVMVLPALAIVGWVLLEN

SEQ ID NO: 2449 - DNA, 444 bp, Corynebacterium glutamicum
  CDS (101)..(421): RXA01804
agtgggaccgcatggcagagttcgcagtcaactaaaatatgacctttgctggttggctaattttgggtcaaagttttgtgaaacgaagtaagcttaagttatgcatatcgtcaacattcgcttcaagcccaaggctaagtacgtggatacattccgctacacagtcgacaaattcactgagtcaaccaggacagaggaaggctgtctctactttgattggttccgcaacaccgattacccaggcgagtaccttgtaattggtgtgtggacggatgaaggtgcgacggaacataagaagagcgagcacttcttgcgagctcaagaaacacttccaccgttgctgcaacaaactccaatgattattcagagtgagttttccaagaagaagggttgggaacgtttcagcgatttcaccgtctactaaggagcccgcaaaagctttgt

SEQ ID NO: 2450 - protein, 107 aa, Corynebacterium glutamicum
MHIVNIRFKPKAKYVDTFRYTVDKFTESTRTEEGCLYFDWFRNTDYPGEYLVIGVWTDEGATEHKKSEHFLRAQETLPPLLQQTPMIIQSEFSKKKGWERFSDFTVY

SEQ ID NO: 2451 - DNA, 453 bp, Corynebacterium glutamicum
  CDS (101)..(430): RXA01805
ggcattgtcgagcgaactcatggtttaactcccttcatgaaatgtgtgcggggtcactggttcccagcctagtctgaactggctaaacaagatcggtacagtggtggtcgtgattttgattaatgtgaaattcaagccattgccagaatatgtagacaccttccgcgagcaggtagcggagtttacagaaaagacccgtgcggaagaaggaaacatcttcttcgattggtcaattaacaccgacaacccaaacgagttcatcctcatcgaagcattccaggacgacgctgccgaagctcacgtcaacagcgaccacttcaaggcggcctgtgagctgttcccaaccatcctgtctgagaccccagagatcatcaacacccttatcgagggcaagactgagtgggaccgcatggcagagttcgcagtcaactaaaatatgacctttgctggttg

SEQ ID NO: 2452 - protein, 110 aa, Corynebacterium glutamicum
VVVVILINVKFKPLPEYVDTFREQVAEFTEKTRAEEGNIFFDWSINTDNPNEFILIEAFQDDAAEAHVNSDHFKAACELFPTILSETPEIINTLIEGKTEWDRMAEFAVN

SEQ ID NO: 2453 - DNA, 603 bp, Corynebacterium glutamicum
  CDS (101)..(580): RXA01806
aatcaaaatcacgaccaccactgtaccgatcttgtttagccagttcagactaggctgggaaccagtgaccccgcacacatttcatgaagggagttaaaccatgagttcgctcgacaatgccccgctgctggaattggatgttcaggaatgggtaaaccacgaaggcttgagcaatgaggacctgcgcggcaaggttgtggtggtggaggtgtttcagatgctatgccctggatgcgtgaatcacggtgtccctcaggctcaaaaaatccaccgcatgattgatgaatcccaagtgcaagtcatcgggctgcacagcgtgtttgagcaccatgatgtgatgacacctgaggctttgaaagtgttcatcgatgagtttgggatcaagttccccgtggcagtggatatgccgagggaaggccagcggattccttcgacgatgaaaaagtatcgtttggaaggaacgcccagcatcattttggctgatcgaaaaggacggattcgtcaggtgcagttcgggcaggttgatgatttcgtgctgggattgctgctcggcagtttgctgtcagagacggacgaaacctaaagcgctttggtctgcaggcc

SEQ ID NO: 2454 - protein, 160 aa, Corynebacterium glutamicum
MSSLDNAPLLELDVQEWVNHEGLSNEDLRGKVVVVEVFQMLCPGCVNHGVPQAQKIHRMIDESQVQVIGLHSVFEHHDVMTPEALKVFIDEFGIKFPVAVDMPREGQRIPSTMKKYRLEGTPSIILADRKGRIRQVQFGQVDDFVLGLLLGSLLSETDET

SEQ ID NO: 2455 - DNA, 855 bp, Corynebacterium glutamicum
  CDS (101)..(832): RXA01816
ttgggtgtaacggcgtgggaaaataggaaatgccctcctgaacaggaagaatcaagcttagttagagtccttcttcccctgccagaaaggcacctcacaggtgcaattattacacacccccgcagccatatccatttccttcgacgaccccaacctcatctctaccgcagggctggtcccgaccatggccctggccgaggaccggttaacagtaccaaccgacaaaggtgctaacccaggtgccaaaatcacgaccctcattgcggggatggtcgccggtgccgactccatcgacgatatcgatgcactccgccacggcggtatgcaccgactctttgactggatctacgccccctccacgttggggtcgttcctccgggcctttaccttcgggcatgtccgccaactcgacgctgtggcctcccggttcctggtgggtctggcaacacaggccccggccctggtcccggttgatgcttctaccagtgattacgtcttcatcgatgttgatgacaccatcattaaggtccacggacatcagaaacaaggcgctggttttggttactccggtatccgtggactcaacgccctgctggccacagtgaccacaccagagtcagcaccagtggtcgtggcccaacgattacggaaaggatcgtgcggttccccgcggggtgcaggccggttgattgctgatgcggtggctaccacccggcgtttgccggggatggaggatgagaagatccttttacgcgcggattctgccttttatggccatcccagtatcagtgctgcgatcaaggcaggggcggatgtgtcttcacggtgcggatgacccccaatgtcaagaaagcg

SEQ ID NO: 2456 - protein, 244 aa, Corynebacterium glutamicum
VQLLHTPAAISISFDDPNLISTAGLVPTMALAEDRLTVPTDKGANPGAKITTLIAGMVAGADSIDDIDALRHGGMHRLFDWIYAPSTLGSFLRAFTFGHVRQLDAVASRFLVGLATQAPALVPVDASTSDYVFIDVDDTIIKVHGHQKQGAGFGYSGIRGLNALLATVTTPESAPVVVAQRLRKGSCGSPRGAGRLIADAVATTRRLPGMEDEKILLRADSAFYGHPSISAAIKAGADVSSRCG

SEQ ID NO: 2457 - DNA, 756 bp, Corynebacterium glutamicum
  CDS (101)..(733): RXA01817
aggatgagaagatccttttacgcgcggattctgccttttatggccatcccagtatcagtgctgcgatcaaggcaggggcggatgtgtcttcacggtgcggatgacccccaatgtcaagaaagcgatcgcccaggttcctgatgatgcgtggcagacaattaagtacaccaacgcgatcttcgacgaggacaccgggcgctggatctcggtggccgaggtcgccgagataccgttcaccgcatttacctcccggaagaaaaccgaccacatccccggactgctggtggtacgccggataccggagctgaataacaaggatgtggatcagccggggttgtttgatctacaccgcttccatgcggtgttcaccaccgccgacccaggcatcctcgatactgttgctgcggataaaacccaccgtcaacacgcaatcatcgaacaagtcaacgcggacgtaaaggccagtgcgttggcgcatatgccatcaggtgtattcaccgccaacagcgcctggttggtgtgtgcggtcatggcgttcaacctcacccgcacagccggtgtgatcgctgcaggcgcgatggccagggccaccaccgcaacgatccggcggaaacttgtggccgttccggccaggattgcacgcagcgcccggagattgattcttcacttgccacggaactggcggtgggaaacccagtggtcaagattgtgtgatcacggccgtttaccaccgtaaccggtagctccctgactacc

SEQ ID NO: 2458 - protein, 211 aa, Corynebacterium glutamicum
MTPNVKKAIAQVPDDAWQTIKYTNAIFDEDTGRWISVAEVAEIPFTAFTSRKKTDHIPGLLVVRRIPELNNKDVDQPGLFDLHRFHAVFTTADPGILDTVAADKTHRQHAIIEQVNADVKASALAHMPSGVFTANSAWLVCAVMAFNLTRTAGVIAAGAMARATTATIRRKLVAVPARIARSARRLILHLPRNWRWETQWSRLCDHGRLPP

SEQ ID NO: 2459 - DNA, 1497 bp, Corynebacterium glutamicum
  CDS (101)..(1474): RXA01820
aaatgccctcctgaactggaagaatcaagcttgcttagagtcctgattcacctgccagaaaggcacctcacaggtgcaattattacacaaccccacagcgatgtccgcatcctttgatgaccccaacctcatctcgcttgctggactggttccaaccatgcacttagccgatgctgccagcctgtccaccttggcccaggaccggttgagcatcaccggtgataaaggtgccaatgctggtgcgaagatcgcctccctagtcgcgggcatggtcgccggtgctgattccatcgatgacatggatgtactccgccacggaggtatgcgccgacttttcgaccggatctacgccccatccacattggggtcttttctgcgggccttcactttcggccacgtacgccaactcgatgctgtggcctcccgattcctggtcaacctggccaggcaggcaccacacctggtgccaccaccaccggcaggcagtggcggtaacgggtatgtgttcgttgatgttgatgacaccatcattgaagtccacggccacaccaaacaaggtgccggctttggttactccggtatccgtggactcaacgccttgctggccacggtcaccaccgcacagtccgcccccatcattgtgggccaacgattgcggaaaggatcgtgtggttccccacgaggggcccaccgcctgatcgccgatgcgatgaccaccaccaggcgcctgcccgggatggaggataagaaaatcctcgtccgggcagattcggcgtattatggtcatcccagtgtcagtgtggccctaaggtccggtgcggatgtgtccgtcacggtgcggatgaccccgaacgtcaagaaagcgatcgtcgcgatcccggaagatgcgtggcagacgattcagtacaccgatgcgatcttcgatgaggcatcacaatcgtggatctccttagcccaggtcgccgaagtgcctttcaccgcgtttacctcccggaagaaggccgaccatgttcccggacgcttggtggtacgccggattcctgagctgaataagaaggatgtgtatcagccgggcttgtttgatcttcaccgcttccatgcggtcttcaccaccgccgacccaggcgtgctggatactgttgctgcggataaaacccaccgtcagcacgcgatcattgaacaggtcaacgcagacttgaaggcaagcgcgttggcgcatctgccgtcggggacgttcaccgccaacagtgcctggctcgtatgcgcggtcatggcgtttaatctcacccgtgccaccggggttatcgctgcaggcgggatggccaaggccaccaccgcgacgatccggcggacactgatggccgttccagcccgggtcgcccgcaggtcccgccgactggtgctccaccttcccgaggggtggacgtggcaaccacagtggcagaaactgtttgatcacggccattcaccaccgtaaccggtagctccctgaccacc

SEQ ID NO: 2460 - protein, 458 aa, Corynebacterium glutamicum
MSASFDDPNLISLAGLVPTMHLADAASLSTLAQDRLSITGDKGANAGAKIASLVAGMVAGADSIDDMDVLRHGGMRRLFDRIYAPSTLGSFLRAFTFGHVRQLDAVASRFLVNLARQAPHLVPPPPAGSGGNGYVFVDVDDTIIEVHGHTKQGAGFGYSGIRGLNALLATVTTAQSAPIIVGQRLRKGSCGSPRGAHRLIADAMTTTRRLPGMEDKKILVRADSAYYGHPSVSVALRSGADVSVTVRMTPNVKKAIVAIPEDAWQTIQYTDAIFDEASQSWISLAQVAEVPFTAFTSRKKADHVPGRLVVRRIPELNKKDVYQPGLFDLHRFHAVFTTADPGVLDTVAADKTHRQHAIIEQVNADLKASALAHLPSGTFTANSAWLVCAVMAFNLTRATGVIAAGGMAKATTATIRRTLMAVPARVARRSRRLVLHLPEGWTWQPQWQKLFDHGHSPP

SEQ ID NO: 2461 - DNA, 1041 bp, Corynebacterium glutamicum
  CDS (101)..(1018): RXA01842
cacgtcatggtctcgcggtgatcatcttcctaccgtgacaggcaaggccgcaaacggccgtgaccacaggaaagaaattcacgaggagaggaagcacacgatgtcgaaggtatacgtgtccaacgagtacggcggcccggaaaaccaggaactgatcacccgcaacaccccccagccaggcccgggagaactcggggtcaaggtccacgcggccggggtcaacccgcttgattggaaggtccgttccggggttgccggaaccccgcgagagcttccggcacccctgggcgaggaggcctccgggatcgtcaccgccgttggagacggtgtggagggcttcgcggtcggcgatccggtgctcggcctggtggcccccggcgtcggcggatatgccgaggacaccctgctggtggcagagagtaccgtgctaaagccggaggagatctcgttcaccgacgccgccgcgatcccggtcgctggggcgagcgcctacgccggcactcaccaggtcgagcttgaaccaggccagtcgttgctgatcaatggggccggtggtggggtcgggctgatggccgcgcagatcggacgggtccacaagttccaggtcgtcggcgttgaccacgaggacaagcgcgagctcatcgaatccaccggtgctatcttcgtcgccaccggcgacgccgtcgcggagcaggtgcgtgcgctgctccctgacggtgtggacgtagtcttcgacctagtcggcggggaggcgttgcgggtggttgctcccttagcgaagaatccggcgcacgtgatctcggcggctgatgctgccaccgtgggagaactcggtggacaggtgctgcgccgcaccccggaaatggtcggacagatcaccggggtggtccagtacgggctggtcgacccgaaggtcgatacgacctacccgctggaacaggccggtaaggccctggcccacgttgagcagggccacgcccgcggcaagatcgtcctcgagctcatcacctcccaggactaaccagacaacgcggtgacctc

SEQ ID NO: 2462 - protein, 306 aa, Corynebacterium glutamicum
MSKVYVSNEYGGPENQELITRNTPQPGPGELGVKVHAAGVNPLDWKVRSGVAGTPRELPAPLGEEASGIVTAVGDGVEGFAVGDPVLGLVAPGVGGYAEDTLLVAESTVLKPEEISFTDAAAIPVAGASAYAGTHQVELEPGQSLLINGAGGGVGLMAAQIGRVHKFQVVGVDHEDKRELIESTGAIFVATGDAVAEQVRALLPDGVDVVFDLVGGEALRVVAPLAKNPAHVISAADAATVGELGGQVLRRTPEMVGQITGVVQYGLVDPKVDTTYPLEQAGKALAHVEQGHARGKIVLELITSQD

SEQ ID NO: 2463 - DNA, 303 bp, Corynebacterium glutamicum
  CDS (101)..(280): RXA01844
gaccaattggtcctgctgcatccgcatgatcgccaacgccagttgcgggtaggcgtccacgacctcggccagggcctcgacgggcaggtagagcgcgcaggtggtctcaatcgcccaggagttggagatcattgaggacggcacgggtgcggtgctcgtctcggagcaggcaaccaccttcgacaacgggttcatcggctactcctacttcaccaccggtacggacggagccacctgcatcaccgaccttcgcctcagggcctccccactgccgcaggtttaaccggtactagccggtttttc

SEQ ID NO: 2464 - protein, 60 aa, Corynebacterium glutamicum
VVSIAQELEIIEDGTGAVLVSEQATTFDNGFIGYSYFTTGTDGATCITDLRLRASPLPQV

SEQ ID NO: 2465 - DNA, 531 bp, Corynebacterium glutamicum
  CDS (101)..(508): RXA01845
ggctccgtccgtaccggtggtgaagtaggagtagccgatgaacccgttgtcgaaggtggttgcctgctccgagacgagcaccgcacccgtgccgtcctcaatgatctccaactcctgggcgattgagaccacctgcgcgctctacctgcccgtcgaggccctggccgaggtcgtggacgcctacccgcaactggcgttggcgatcatgcggatgcagcaggaccaattggtccggtcccgggaacgcgagaccgcacagaccacctcgactgtcgagcagcgcgtggccgccgccctccaacacctggacgccaagctcgggcaaatccgacaagacggatccagcctgctgcaggtccgcctgcgccgcgacgacgtggccggcaccaccgtcgagtccgcctcccgggcaatggcgcggatgaagaaaaccggtgtcatcgactccggccgcgaatggatcgccattaccaaccaccaggccctggccgacctggtcgccggcctctaaacgcccacatccctctctct

SEQ ID NO: 2466 - protein, 136 aa, Corynebacterium glutamicum
MISNSWAIETTCALYLPVEALAEVVDAYPQLALAIMRMQQDQLVRSRERETAQTTSTVEQRVAAALQHLDAKLGQIRQDGSSLLQVRLRRDDVAGTTVESASRAMARMKKTGVIDSGREWIAITNHQALADLVAGL

SEQ ID NO: 2467 - DNA, 669 bp, Corynebacterium glutamicum
  CDS (101)..(646): RXA01856
cactctccagcgttcgcgccagatatgcagccaactcttgatcgtggtgtggaagcgctggttgtagctgcttctgcgtggctagtaaaataattggctaatgaatccttttctttcggacacgttgattgtccagcagacctcttccttcctgtctaacaactttgagatctacaatccagacggcgaagttgttatcagaatcaaaactgaagggtcgttgggctctcggctggtcaagggcgaccgcagattcacactggaagacgccttcggcaccccattgatgcaggtgcgcgatcccatgaactttgttcgcgacacctatgaaattgatgatccaaatggcaatcccattgctcatgtgcggaagcgtttcaccttcttcaacaagcggatggacatcgaactaccaggtgaccgcgttattgaaatgcacggtaacttccttggatttgaatttgagttccgcatgggcgatcggattcctgcgaaagtaacccgaaaatggtccggcgctggcaacggatacctaggccgaagcacctacgcccttattttcgatgaagaagcccctgatgaaatcagaaaagtcatcattggaggcatggtcgcgctagatctgatccgggagaaggaacgtaattaagccacccccgtttcatgtct

SEQ ID NO: 2468 - protein, 182 aa, Corynebacterium glutamicum
MNPFLSDTLIVQQTSSFLSNNFEIYNPDGEVVIRIKTEGSLGSRLVKGDRRFTLEDAFGTPLMQVRDPMNFVRDTYEIDDPNGNPIAHVRKRFTFFNKRMDIELPGDRVIEMHGNFLGFEFEFRMGDRIPAKVTRKWSGAGNGYLGRSTYALIFDEEAPDEIRKVIIGGMVALDLIREKERN

SEQ ID NO: 2469 - DNA, 774 bp, Corynebacterium glutamicum
  CDS (101)..(751): RXA01857
ttaagggacttcgcagcctacttgagagattttgacagataactaataacctccacttggtcgtactaatctaacttaatctctccctaggagttctcccatggcttcacgccgtttccgtatgatgctcaccgcaagcatcaccgcagcttcccttggtttttccctcaccccagcaatcgccgatgaagctgtaaccgttgctacggcaccctccgtcggattcgattccggcgtcgaacgcgatgcaccattcaccgcagttccacacgacgtagttctcggcgttggagcgacccagtccgagctcattttcaactggatcaccgcgcagggcctaaccggccaggttgcacagatctccctggacgataccttcgcatccccaatcaccgttgatgcagtttctgaaaacgtcagcatcgtgaacaccgaaggcgattcccgcgaccgagctgaaggtgaatacgttgaataccgcgatggcgcagtcaaccgcgcaaccgtagatagcctcgcagaaaacaccacctactcctaccgcgtcggctccgaagctgacggctggtccgaagtgcaaaccttcaacaccggcacctacggtgacaactggaacttcctcttcttcggcgacacccagctgtacaacacccactccaaccgtgcagaagaagtccagaactgggcaaacaacctggaacggcggcccaccaatcgaaaacccaggaacctccttcatcctctccgcgggtgatcaggcaaaccactccagct

SEQ ID NO: 2470 - protein, 217 aa, Corynebacterium glutamicum
MASRRFRMMLTASITAASLGFSLTPAIADEAVTVATAPSVGFDSGVERDAPFTAVPHDVVLGVGATQSELIFNWITAQGLTGQVAQISLDDTFASPITVDAVSENVSIVNTEGDSRDRAEGEYVEYRDGAVNRATVDSLAENTTYSYRVGSEADGWSEVQTFNTGTYGDNWNFLFFGDTQLYNTHSNRAEEVQNWANNLERRPTNRKPRNLLHPLRG

SEQ ID NO: 2471 - DNA, 673 bp, Corynebacterium glutamicum
  CDS (101)..(673): RXA01858
cgtgtgtttgttttgactggaacagcgtcggcttttcggccacgcggcctgcggacagtagcggaatcacgcgggacattgatccccggacgtaaagccgatgtttatgacaccgcgggcgttgaccgaagataatgagttgaccctggctttgaaatcactcggagggcttatggtgtcacccaatgagtgctcagtagtgacagaagtgatgccgacttggagagaattatggcatcaaaggcttcgatggcaacgcggtgcgctggaaaacctcggtgcttatggcatcacaccacaaacgacacggtattggttccagcagctgggaatcggttacggcgcattagccttggtcgcctatttcgcagtcattatcattacgtttctcgcccgcgatcaatggatctggtatccattctggatgctgctgggactgttgttcatgattgaacgcgtgctaacggtgtggagatccacatggtttgccaggtttgttgctgcgttattaatcccagagctcatctacgccagctatctcaacctggtatttctcaaaggcgttgtggatattctattggccaagcaagctcactggggtgagcatggtgacaagacaatgcaggtagccgatgcagctgccgaaattaacgatgaaggggaggaacgccga

SEQ ID NO: 2472 - protein, 191 aa, Corynebacterium glutamicum
MFMTPRALTEDNELTLALKSLGGLMVSPNECSVVTEVMPTWRELWHQRLRWQRGALENLGAYGITPQTTRYWFQQLGIGYGALALVAYFAVIIITFLARDQWIWYPFWMLLGLLFMIERVLTVWRSTWFARFVAALLIPELIYASYLNLVFLKGVVDILLAKQAHWGEHGDKTMQVADAAAEINDEGEERR

SEQ ID NO: 2473 - DNA, 798 bp, Corynebacterium glutamicum
  CDS (101)..(775): RXA01870
ggatcatgtccaccccagaaggtagcctgtcagtgtgagcgtaatcgagggcaagtaccagctgaaacctcaaggccgaggtggcctgtggtggtcaatcgtgggtgtggcagttgttttgttgctgcttccaacgttgatcaacctggtggttccggataaagccaatgactacaagcagctagaaatcgatcttctgggtgtggattggtcagtgccaatcaccacggaggaatccgctgcggtgctgtgtgaggaaacatctgatgaaatcacacagaagtattgggactgcaacggggacaccacggtggtgaccatgatcgtcgagggcgtgaaagatccgtccaatacgttgcgtcgcatggtgggttcatcgctgataaccagtgtggatgacagcctagaggcagtatctagcgaagatggccgtgcgcatgcgttgtatgtgccaggtcagcaagaaggatctttgtggacgctgcctatcgtggcactgagcgtgcagggttcgggtgattatgaagacctcacagcgatcgcaattatcaacggcacctcgttggattattacagcacccacatttggtccagcatggccgctgaccgcgggttgccgtaccagcaggacttccccctgatgctggaagaggagccatggcaagacacccccggcggggatcgtcccttcgagctgcccaatgatttctttgatcagtaccccgatctttttggcccaggctccgtcattcccaaccttgaaggagaatccctatgagtcgcatgtttagcatcacc

SEQ ID NO: 2474 - protein, 225 aa, Corynebacterium glutamicum
VGVAVVLLLLPTLINLVVPDKANDYKQLEIDLLGVDWSVPITTEESAAVLCEETSDEITQKYWDCNGDTTVVTMIVEGVKDPSNTLRRMVGSSLITSVDDSLEAVSSEDGRAHALYVPGQQEGSLWTLPIVALSVQGSGDYEDLTAIAIINGTSLDYYSTHIWSSMAADRGLPYQQDFPLMLEEEPWQDTPGGDRPFELPNDFFDQYPDLFGPGSVIPNLEGESL

SEQ ID NO: 2475 - DNA, 1086 bp, Corynebacterium glutamicum
  CDS (101)..(1063): RXA01871
gcggggatcgtcccttcgagctgcccaatgatttctttgatcagtaccccgatctttttggcccaggctccgtcattcccaaccttgaaggagaatccctatgagtcgcatgtttagcatcaccttgtgggttgccatcctcctctcaaccccggcgctgtttttgagcttggccacgttcatcttcgtggatggcatctctgtcctcgtgaatatagtgttcgcggtgctctacttggtagtcattgttttcctgttaagtcgcaccccgctgtggccacgttttaaaggctccggcagcaagaagggaggcggattcgcgtgggcggcgtcatcattgttgtggggcgcgttcgttggtttcggcatcgtcatgttgtttgccggtccggtcatggatctcacggacaaactcggctgggatttcgttgccatgagtttcaccggagcgtatccagaagaaatcgccaaagcgttaggcgttgccatcatcttgttgagcttccgccaactcaaccgtccgtggcatggatttatcaccggcgcgctagtgggcttaggttttgaggtcaacgaaaacctcctctatggcgccaccggtgcaatcatggaccccaacgctgacctcgacggcgtccttatgatgtggcaataccgcaccatgttgggcccactcatccatacgttgctcaccggattcgcaggttacggcatcgcgttggcattcttccgcgcacgaaaaacagtcgcctggcgctggggcgtggcgatcggttggactctcatcgccttcgcactgcatttttcatggaacctgatgtgggaaaacgtaatcggttcctatgtcaccatcatcgtggtcagcgttgtcatgtacggtctggctatctacatcctctggagtaattgggccgaagcccgcaacgactccagctacgctttcgtcccgggaatcatcacaaacaccaaagatttatcgcttcttgacgcccccattccagtaggcgctgaggttcccgagtcgcgcattccccaacagatagaggaacccaaggcggagaactagctttcactcgctctccatcc

SEQ ID NO: 2476 - protein, 321 aa, Corynebacterium glutamicum
MSRMFSITLWVAILLSTPALFLSLATFIFVDGISVLVNIVFAVLYLVVIVFLLSRTPLWPRFKGSGSKKGGGFAWAASSLLWGAFVGFGIVMLFAGPVMDLTDKLGWDFVAMSFTGAYPEEIAKALGVAIILLSFRQLNRPWHGFITGALVGLGFEVNENLLYGATGAIMDPNADLDGVLMMWQYRTMLGPLIHTLLTGFAGYGIALAFFRARKTVAWRWGVAIGWTLIAFALHFSWNLMWENVIGSYVTIIVVSVVMYGLAIYILWSNWAEARNDSSYAFVPGIITNTKDLSLLDAPIPVGAEVPESRIPQQIEEPKAEN

SEQ ID NO: 2477 - DNA, 302 bp, Corynebacterium glutamicum
  CDS (1)..(279): RXA01903
gctcaccttgatgaccgtggcatctatatcatcccagctcaatatccttggggatacgaggaaatcattaacctaccggcacgcgctacctctacacctgctgttgctcctcgcactgaggctgctccagctacagtatctgatgctgaggtccagagcctgcttgagtacttgcgtactaatgctttcgtaagtcgtcacgacggcgacaccacgaaggccgacatcttcaacaagcacgcggatactgtcaacaagcttgcagcactacgtgcaccctaaacccacaccgcataaccccc

SEQ ID NO: 2478 - protein, 93 aa, Corynebacterium glutamicum
AHLDDRGIYIIPAQYPWGYEEIINLPARATSTPAVAPRTEAAPATVSDAEVQSLLEYLRTNAFVSRHDGDTTKADIFNKHADTVNKLAALRAP

SEQ ID NO: 2479 - DNA, 546 bp, Corynebacterium glutamicum
  CDS (101)..(523): RXA01904
attagtttttattcgcaagggtggtctaaattttttactactgcgtcgtgtccaccggatacacttgaggtaatacagttacgaggctaaggagtatgtaatgagcatttcgccgaagaattccggtacaccaaacgagaacgccgcagcagcgcaggtggcagcaaatctggctaatttaacgtcgcaggctacagggtccatggacgaaactaatgagcaagtcattaaaagtaacgagcatggctctgatgcttatttggcggatattaaagccagtcgagagatgtgggcaaaaattgcgctcgatccgaatcaatctgaagaaactaggaaagaagctcgggagaatatggcgcggatagatgagtacgctcgtgagcacgataaagacaacaagggtttgttgcagaagttagcgaaaaacaaagcagagctcatcgggactgttgcggttgcaaccttaggtgtagtggcagccattgctaacaatggcaagataccgatgattcagttgaaaaaataacccccgcacaggctggacat

SEQ ID NO: 2480 - protein, 141 aa, Corynebacterium glutamicum
MSISPKNSGTPNENAAAAQVAANLANLTSQATGSMDETNEQVIKSNEHGSDAYLADIKASREMWAKIALDPNQSEETRKEARENMARIDEYAREHDKDNKGLLQKLAKNKAELIGTVAVATLGVVAAIANNGKIPMIQLKK

SEQ ID NO: 2481 - DNA, 654 bp, Corynebacterium glutamicum
  CDS (101)..(631): RXA01905
aaatgaaagtcacaaactttgttggggtttctttaaagtaaaatacagaagtttctctggcaaaaaacctcactactttctacagaaaggcgtcttcctcatgaaggcttctcagaccctcacccgcaacactcgtgcacgcaagctcggcatgggtattctcgcagcaactattatggctaccggtgcacttgctggcactgctccacaggcgacagcagcagtagataccactgcgccatacgtgtcctatgtcgttgacattcctggcaaggttggtgaaccaatcaagcctcagtacctcaccatctccgatcagtccgcctacaccgtgaccttcaagtacatgccatcctggttgaagtacgacgcaaacaagaagatgctgtacggtaccccaaccgaggttgatgtctggactcctgaggtacatgttgttgatgctcatggcaacaagactgtccgttacttcaccgttgtagcagtcccagcaaacactggaccaaccaccaccacgccatctacttcaaagccatctaccccgcaggtgaccaccccaactactccgaaggcgcctaccttgccaaagtccaccttcgactggaccttgtggggctccatctttggtttctagttctcactagcacctcaaaa

SEQ ID NO: 2482 - protein, 177 aa, Corynebacterium glutamicum
MKASQTLTRNTRARKLGMGILAATIMATGALAGTAPQATAAVDTTAPYVSYVVDIPGKVGEPIKPQYLTISDQSAYTVTFKYMPSWLKYDANKKMLYGTPTEVDVWTPEVHVVDAHGNKTVRYFTVVAVPANTGPTTTTPSTSKPSTPQVTTPTTPKAPTLPKSTFDWTLWGSIFGF

SEQ ID NO: 2483 - DNA, 588 bp, Corynebacterium glutamicum
  CDS (101)..(565): RXA01906
gcgttcgggtaaacccgtgacaatcgcacggggcttgtttacctgacactcaagccccgtgcaccacaacaacccaccttaaagaaaggtttttccacccatgtccgaattccctacacctacgacttttcacgtcgaaccagaaacgcttagctccgccaccgatctcactgttgatgcacataaaatcgcagaactgctgctcagcaccactgattaccgtgtgttctacatgccgcgtctcgccggtgtgactcctatcgtgtcctacctctatgtctacgatggtgaaaacttcctcattgttggtcgctccactcatgtgccgtgggagtactacgttcactaccccatcaagccatcacgtgaatttggctctgctattgctgtgcctctcgatgattctgatgacccttatgatgcagcagaagttgttgctctagtaaagcagtacatgacgcccacgctcactcctggtgagggttatatgcagggcttttacaagggtctcaccttcaccaaccacctcgatatacatcgaccactgacccagattatctcagactaacagctatattcacccaccta

SEQ ID NO: 2484 - protein, 155 aa, Corynebacterium glutamicum
MSEFPTPTTFHVEPETLSSATDLTVDAHKIAELLLSTTDYRVFYMPRLAGVTPIVSYLYVYDGENFLIVGRSTHVPWEYYVHYPIKPSREFGSAIAVPLDDSDDPYDAAEVVALVKQYMTPTLTPGEGYMQGFYKGLTFTNHLDIHRPLTQIISD

SEQ ID NO: 2485 - DNA, 735 bp, Corynebacterium glutamicum
  CDS (101)..(712): RXA01907
ttcgttttacccacaccagcacgtcaccctcttgcatcacgccgagagggtgacgtgcttttttcctacttttcctcataactacagaagggacgccctcatgtctgcttttgatgaactccgcaagaactaccgctacaagttcactgacacctggccggccaacgctgttaccggcaccggctactacgccaacccagcttttatcatcatctccgctgatgccatgacgcagaacacccatgccgattccaatctcatcacggttaaagagcaccttaacaccctgtttccgtacagcgtacaacgcaaggatcgtgcctttgtctctgagatctacacccctattaacctgctcgaagataatccagaactagctcaagaaatactcgatgtgctcgacaccctgagcaacaacgctgtttttaacgatgcgcactacagcgagcttgaactagagcgcctcaatgaatatgtcatcgacaccttggcctatgacatgaagtccgacatgatgcgcgccctcgttaaggcccgaccagaggccgatcttgaggcgatggaagaactcgacattgccaatatccagagctggattaatctccactcctccactgtgagcgaacacaacgatggcagcgttgatgatgcaccgtttaattctctcgcattagctgagatttatttgcaacagcttgcagaccacactgtctaagcacgctgtgtaactaccac

SEQ ID NO: 2486 - protein, 204 aa, Corynebacterium glutamicum
MSAFDELRKNYRYKFTDTWPANAVTGTGYYANPAFIIISADAMTQNTHADSNLITVKEHLNTLFPYSVQRKDRAFVSEIYTPINLLEDNPELAQEILDVLDTLSNNAVFNDAHYSELELERLNEYVIDTLAYDMKSDMMRALVKARPEADLEAMEELDIANIQSWINLHSSTVSEHNDGSVDDAPFNSLALAEIYLQQLADHTV

SEQ ID NO: 2487 - DNA, 529 bp, Corynebacterium glutamicum
  CDS (101)..(529): RXA01923
ccaaagtgaataccccgactgcagcagcgcaaaagttcaagtactttgggatgcaaatctagtagcacgtcccatgtttctcacactctcaggagctgacatgtctgcacttattaaaggttcaggacctcatcatgtggttgtcttaaatggttggtttggtcatgctgcgggctggggagctttcgctgactatcttgacctcggcaactacacctggcacttttgggattaccgaggttacggcaacagaaaagacgacgcaggagaatttactctggaggaaatttcagcggatatcgttgcatacatcgactcgattgaggcagaaaaggtttccatcctgggccattccatgggtggagtgttcatgcagaaagtccttgcagacagcgccacccccatcgcttcactggttggaatttctgccgttgctgcagctggaacaccattcgatgaggattctcggaagcttttcacctcagcagggcacaacccggactcgaggcgagccatcatcgatttcacc

SEQ ID NO: 2488 - protein, 143 aa, Corynebacterium glutamicum
MSALIKGSGPHHVVVLNGWFGHAAGWGAFADYLDLGNYTWHFWDYRGYGNRKDDAGEFTLEEISADIVAYIDSIEAEKVSILGHSMGGVFMQKVLADSATPIASLVGISAVAAAGTPFDEDSRKLFTSAGHNPDSRRAIIDFT

SEQ ID NO: 2489 - DNA, 777 bp, Corynebacterium glutamicum
  CDS (101)..(754): RXA01931
tcgataggcatggcgccgattctaggtcgaactgatctaaagtcccaccacgcaaaagtaaccaaggcgtacatctacccggcactttaagatcagtggcatgagcacttcttttgagtccattcccggagttactatctccgctcgaaaagccttgagcactgcggggtttaaagatctggaatcgcttgcaggtaccaattacgaagaagtggctggtctgtcaggaattggcgcacgtactttggagcgattgcaagcagcgctggtggagaagagaatgagctttggcggtaaagtgccagaggcagaacagcgcaccgcgacgtggacaacgctagattctgcagcaccagaggcaacagaaacctcagaatccccagagtacttcattcaaaacctagacattcctcgcagaattacccacggccggttgttgttggaaattttcaacagagcgacaggccagaaaccttatgtagcagggtcttcgattgttggttatgggcgagttcattatcgctatgccacgggtagggaagggatcactattcgtgtgggtttcagtccgcgaaaggcaaagatttcactttatggactaaccagtgcgcctgcgtctcgagaacttctgaagaaattgggtaagcattctgttggtgtgtcctgcctatatatcaacaaaccagaggatgttgatcttgaggtgcttgaggaaatgatccgtatttcttgggaagcggaacctggcgaatgttaaatctcaacctttaacaaagt

SEQ ID NO: 2490 - protein, 218 aa, Corynebacterium glutamicum
MSTSFESIPGVTISARKALSTAGFKDLESLAGTNYEEVAGLSGIGARTLERLQAALVEKRMSFGGKVPEAEQRTATWTTLDSAAPEATETSESPEYFIQNLDIPRRITHGRLLLEIFNRATGQKPYVAGSSIVGYGRVHYRYATGREGITIRVGFSPRKAKISLYGLTSAPASRELLKKLGKHSVGVSCLYINKPEDVDLEVLEEMIRISWEAEPGEC

SEQ ID NO: 2491 - DNA, 558 bp, Corynebacterium glutamicum
  CDS (101)..(535): RXA01941
ccggacttgccgctggtttagtcactttttgctcacgacggtatttattggtcgatttcaccagcgcagcgttgaaaaacgttgggcgccagtcacccacatggccttgacttcacttttgcaccagcttgcagataaaaaacacagtgacctcagccgggaagacatcgtaccgcgggcctttactgtcccgacctctactgacgcccacgctattcatcaagacttggaaaaactccgaaactccgtactcaaagagcaaaatcacctaaccactgtgttgggaacttggtcagaattcctcacctccaacagcgataactccgacattttgcgttcctccgctgaacttgggctccaattggagcaggtccgcgataaagcactcgaagtggaacagcgtatcaaagcctctgctcaggtggatcttacggacctggctcatgagattgagatctgcaatcaacaccacgcaaccctcatcagtgcgattcaggtaagactgcaatcgcatactgctgagcttcgggctgggtgatttcttaagactgacctagt

SEQ ID NO: 2492 - protein, 145 aa, Corynebacterium glutamicum
MALTSLLHQLADKKHSDLSREDIVPRAFTVPTSTDAHAIHQDLEKLRNSVLKEQNHLTTVLGTWSEFLTSNSDNSDILRSSAELGLQLEQVRDKALEVEQRIKASAQVDLTDLAHEIEICNQHHATLISAIQVRLQSHTAELRAG

SEQ ID NO: 2493 - DNA, 723 bp, Corynebacterium glutamicum
  CDS (101)..(700): RXA01942
gccgcgaaattcggtgaaattgaaggtattcctgcagatcaggcaaattcttccacgactgtgatcaaggtcaacggcaagaacgagtaacctgggatccatgttgcgcattggactaacaggagggatcggcagcggtaaatctaccgttgccgatcttttgtcatctgaaggatttctcatcgtcgacgcggaccaagttgcccgcgatatcgtcgaacccggacaaccggcattagcagagctagctgaagcttttggccaagacatcttaaaacccgacggcactctagaccgcgcgggattagcagccaaagcatttgtcagcgaagaacaaacagcgctgctcaatgccattacccaccctcgtatcgccgaagagtcagctcgtcgattcaacgaagccgaagatcaaggcgccaaagttgcggtttatgacatgcctttgcttgtagaaaaaggccttgaccgcaagatggaccttgtcgtcgtagttgatgttgacgtagaggaacgcgtccgcagacttgtggaaaaacgtggcctcacagaggacgacgtgcggcgtcgaatcgcttctcaagtgcccgacgacgtcagacttaaagccgctgacatcgttgtggacaataacggcacgctagaggaccttcatgctgaagcaagcaagctgattgctgagattcttagtcgcgtgaattagcactaaaacatcgtcaaagt

SEQ ID NO: 2494 - protein, 200 aa, Corynebacterium glutamicum
MLRIGLTGGIGSGKSTVADLLSSEGFLIVDADQVARDIVEPGQPALAELAEAFGQDILKPDGTLDRAGLAAKAFVSEEQTALLNAITHPRIAEESARRFNEAEDQGAKVAVYDMPLLVEKGLDRKMDLVVVVDVDVEERVRRLVEKRGLTEDDVRRRIASQVPDDVRLKAADIVVDNNGTLEDLHAEASKLIAEILSRVN

SEQ ID NO: 2495 - DNA, 585 bp, Corynebacterium glutamicum
  CDS (101)..(562): RXA01957
acctcaactccacagagcgttgttatcagatgctgatatggctcgccttgcagcacaactgaccgacaaacactaaaacctccacaacaaggacatcatcatgactactcgcaccgtatctacttctgcaccccatgtcactgtcaacatcaataccgcgcacaacaaaacacgcactgttaccaatggcgccagaaaaactaatgcagagcgtggcaagagctgcatctcatttcgtgtagggccagaattgtttgatgaattcaaagcgacctgcatcgacaacgatatttccatgaccaaggcgtttgagaaagagcttcgcacctgggttgatgagcacaacgctggtgcaacaaagaaaagaaacacccatcgcacctacgtacaagcacccgttggtactgtcgccaccagctctattccaggtcttgggttatttactgtgttcaagaagagctctgatcagatgtggtacgacctggaaagcagcccgctgatcgcacaagagcccatgtcgaatatggacatgcatcgtaacggctcttttgagctgcacctgtagatctctctctcgaccacaca

SEQ ID NO: 2496 - protein, 154 aa, Corynebacterium glutamicum
MTTRTVSTSAPHVTVNINTAHNKTRTVTNGARKTNAERGKSCISFRVGPELFDEFKATCIDNDISMTKAFEKELRTWVDEHNAGATKKRNTHRTYVQAPVGTVATSSIPGLGLFTVFKKSSDQMWYDLESSPLIAQEPMSNMDMHRNGSFELHL

SEQ ID NO: 2497 - DNA, 630 bp, Corynebacterium glutamicum
  CDS (101)..(607): RXA01958
atatggacatgcatcgtaacggctcttttgagctgcacctgtagatctctctctcgaccacacacagctctcaccacctcctagaaaggacggtttcaccatgtctaaaaaacgcgaccacctcaccgtcattcctgaccttgagtcacgcacccatcacagccgcagtacacaaccgccaactacgctgcccgcaccacagctgactattatcaccgcaccagacaagcatcaaccacagcttcgggttgttaaaaacaccaccaccccatcttctgtgcagccctcgccgatcaactacagctttactgatcctgtacttcgcgaggctcactatgcattccagcacagcgaacttgccaggccaacagtcctggactcacactgggttcgtcgcgcacaagaagaattcgacactgagcataatgctgcctatgtccgtgccgctgaccagctcttatccccttttgatgcctacatcctcgacaacggcgatgtttacaccaagaccccacgtgccatcagtgctgctgaacaagaagaaatacttgagcacttgcacgaacaccatatctgctgggacgaagaagctgaattcctgctgcgctaaaggttgccactggtttcagg

SEQ ID NO: 2498 - protein, 169 aa, Corynebacterium glutamicum
MSKKRDHLTVIPDLESRTHHSRSTQPPTTLPAPQLTIITAPDKHQPQLRVVKNTTTPSSVQPSPINYSFTDPVLREAHYAFQHSELARPTVLDSHWVRRAQEEFDTEHNAAYVRAADQLLSPFDAYILDNGDVYTKTPRAISAAEQEEILEHLHEHHICWDEEAEFLLR

SEQ ID NO: 2499 - DNA, 481 bp, Corynebacterium glutamicum
  CDS (101)..(481): RXA01959
cccaactactatgcacagcccgtaaccatcgagccggctaaaatctatcaacagaaaaaccactgcctatttgaccattcttgtgcaagaaagtacacctatgccccacgacgtttacgatgtcgaacacatcatttccaagcaacctttctgctccatctttttccagctccccgctgcagcgctgaaacctactattcaaaaagctgccaccaaccgcgaccttactaagctcaacaccgaacagatcgctgagaacctacagcgctacctcgacacctacagtgtcatgtctcaccagcgtgtcaccattgaagaggtcactcatgtgcgcaaccctcatgagcctgattatgagttttcaccacagtacggtgcacatatctcgctcatcggtgagtcttatgctgtgaacacggccaccaacgagccttatgccaccgactccgagggccatcctctcgcactgtattttgaaatg

SEQ ID NO: 2500 - protein, 127 aa, Corynebacterium glutamicum
MPHDVYDVEHIISKQPFCSIFFQLPAAALKPTIQKAATNRDLTKLNTEQIAENLQRYLDTYSVMSHQRVTIEEVTHVRNPHEPDYEFSPQYGAHISLIGESYAVNTATNEPYATDSEGHPLALYFEM

SEQ ID NO: 2501 - DNA, 603 bp, Corynebacterium glutamicum
  CDS (101)..(580): RXA01961
aacacccagctagtgcctgtgcttgagctaccaaagttcaatccttttgaggcacttgctatccaccttgaagccgccaacaactaagaaagcatccttcatgactgacaacgctgacaacaccacagataacgtaaccaataactcagacaccaatctcgattacagcttcgacccgctccctgacgagccctatgcctacggctttgaactggtcgctgctgatgcacactctgactcaacaacaaccagcaccgataccccagagactgtcgctgtggcacttaaaacccgcgaggacactatcaactgggtcaacacccagcgtgccgaaggtaaacccgatgaaattcgtatcaataacccaattcgatcagagcgtattgctgagtttgtccacgaaatgatcatgcatcacggcctcgtagcctgcatggaagatctcgcaatacttatcaagcgcgacaagctcacccagctggaagccgaaaacgctatcacagcctggcacaacctcaccaaagaatcccttggtcagatcatggggctcttctatcagtacgtcgaaaacaacacaaaataggaaagaagaaacaccatcat

SEQ ID NO: 2502 - protein, 160 aa, Corynebacterium glutamicum
MTDNADNTTDNVTNNSDTNLDYSFDPLPDEPYAYGFELVAADAHSDSTTTSTDTPETVAVALKTREDTINWVNTQRAEGKPDEIRINNPIRSERIAEFVHEMIMHHGLVACMEDLAILIKRDKLTQLEAENAITAWHNLTKESLGQIMGLFYQYVENNTK

SEQ ID NO: 2503 - DNA, 693 bp, Corynebacterium glutamicum
  CDS (101)..(670): RXA01962
agcctggcacaacctcaccaaagaatcccttggtcagatcatggggctcttctatcagtacgtcgaaaacaacacaaaataggaaagaagaaacaccatcatgtctgacaacactcaggacaaccctttctccatccgctacgcacaccctgaccaccagctcgctcttaatgagcttgttgatactgccgatctacctgcaccaacaagctatatgaaaaatccctggtccggggacaacacgcctatcgccgagtggcgacgcgagcgcatcacccagtggcagcgcaccgagatcattgtcaatcaacgcgatgatgacgatctcattcacgtcagcttcccgaagctcggccagcacattcagctcaacaccgacgatattctcgcattggtcgcagcctgcgtcacacccactgctaacgacattgaggcaactatcgaagaaaatctccactcatatccgcacgatacggtcatcatgtttaacgcagatgatctagatgatgcccttggtctcgttgttgccgtcaaagacgcgagcggggaacactcaccgcgcgctgtctggcgcaccaacaccgatcatggagctcttgacgagactgaactcgcgcggctcattctcaaattcggtggcagcttcgatgactacggcgtgctgcaacattaaaccgactcactaagcaccgc

SEQ ID NO: 2504 - protein, 190 aa, Corynebacterium glutamicum
MSDNTQDNPFSIRYAHPDHQLALNELVDTADLPAPTSYMKNPWSGDNTPIAEWRRERITQWQRTEIIVNQRDDDDLIHVSFPKLGQHIQLNTDDILALVAACVTPTANDIEATIEENLHSYPHDTVIMFNADDLDDALGLVVAVKDASGEHSPRAVWRTNTDHGALDETELARLILKFGGSFDDYGVLQH

SEQ ID NO: 2505 - DNA, 784 bp, Corynebacterium glutamicum
  CDS (101)..(784): RXA01963
cagattttctctgtgtgagctggggttttctgcatttcccacttgtttttctccaacactccacacacacaccttcaaagaagaaagttcgaaagattctatgaaaaaccgtaaaaaaatcatgtctaccctcaccactgtctgcgccgtactgggtatagttgcagctcatccattccacgcctctgctgtcatcggcggctctgtcccatcaactgattccgttgccaacgctgtcgcaaaaatcggaccaggcgcattgaactgcagcggtgtcatgatctcaccatcgtgggcactcaccgcacgccactgtgtcgatgacatcaacatactcggcgacatcgacaccatcacgcctattactccaggtattcatcgcaatgaaggtaactatatgggtgaggtttaccgcgcaccgtccggtgatctagcgctcattaatatcaacggcgtgcacaagggcaccattgcgcagctccccacacaagaatatccactgggaaccgctgcacagtcagtcggttttggtggcggtggtgtcaatatccgcaccgctgaatcggtcaacatgattctcaccgacatatatagcgtgaggtcagggaaattccatcacggtgtcggtcgatcacactatctcctctttgattatgacagtgctgaaactggtcgaatccacaaaggtgattctgggggccccatcttcattggtgacgaggttgtgggcattatgtctcacggcacaataaataagaacgacgggtcttttgatgacgaatcc

SEQ ID NO: 2506 - protein, 228 aa, Corynebacterium glutamicum
MKNRKKIMSTLTTVCAVLGIVAAHPFHASAVIGGSVPSTDSVANAVAKIGPGALNCSGVMISPSWALTARHCVDDINILGDIDTITPITPGIHRNEGNYMGEVYRAPSGDLALININGVHKGTIAQLPTQEYPLGTAAQSVGFGGGGVNIRTAESVNMILTDIYSVRSGKFHHGVGRSHYLLFDYDSAETGRIHKGDSGGPIFIGDEVVGIMSHGTINKNDGSFDDES

SEQ ID NO: 2507 - DNA, 1426 bp, Corynebacterium glutamicum
  CDS (101)..(1426): RXA01964
agagccagatgatggctttgatatggatgatgtcatgggccaagcgttcggtcgctagctcataccttgttacaacgacactttttaagggaagaagattatgaccagcgctgtgaatgtgcagaagaagaccacacagaaagtacttaagcccattaatacgaagaattactctgcgacagatgcagtacagacaggccagcacggatctgctttaggctcgaatatcggtgtctacacctataccgctggactcgatattggaaacggttatgtcaagggcattatcgaggcaaccggtgatacgactggcacgtctgttgatgttattgatatgccctctgcagcaacgcgcatgagccggccaacggaagttcccgaaccagatgacaccgctgttgctgtcaccggtgcggatttcttcaaccacattgataccaatttcaattcgcctatggtgaaaggtaattatcgttacctttgtggcacgcgcagcttgtctgcacgaggtagcttggaggaatttgatctggtgggtaaccgctccaaggcggaacaagaactgagcaaggtgctggtcatggcagtacttgcggccaaggctgtgaaagactttgtggcagcacatggtcgaatcccacaggttgctgttgagggtgatcccggtgtgctgcgtgtgcatacgtatcttgcacttgcgttaccgattaatgaatatgtgggtcaccgtcatgggtataaggcacagtttatgggtgatggggcagcgaacccggctgtgcatgtggtgacggttaacaactttgaaaccccagcaacggtgcagctcatctttgagcgtgtcgaggtcattgccgagggcgcatcggcacagtatgccattaccgcaggtggcgaagtacttatgaacggaatgctcgccgatgtacgctccaaagggcttgctctagagggcgtgacagcaggtgatgtgctacaagctcgccacacaatcggtgtggatgtgggtgaaggtactgtgaatttcccagtctttacggatgggcggtttaatcatgatgcttcacgcgcctatgacaagggttatggcaccgtcttggagtcggcgattcaggctatggacgatgctgggttggcacacaactttaactcgcgtaagcagttggctgattatttgcagcgaccaccgagtgcactcaagcggaatttctatacccgcgtggaacagcatgttgatcaggaggcagtgttctttgttcaggatgtggctgcagagttcgcacgagtgttgagcgacgtgggtgctcttaccgaagtagcctttgtctacggcggtggttccggcccgctgcgtgatcgactgcatgaagcgttgctgattaaggcagcggagatgggttcggaagatacgttcccggtgctgtat

SEQ ID NO: 2508 - protein, 442 aa, Corynebacterium glutamicum
MTSAVNVQKKTTQKVLKPINTKNYSATDAVQTGQHGSALGSNIGVYTYTAGLDIGNGYVKGIIEATGDTTGTSVDVIDMPSAATRMSRPTEVPEPDDTAVAVTGADFFNHIDTNFNSPMVKGNYRYLCGTRSLSARGSLEEFDLVGNRSKAEQELSKVLVMAVLAAKAVKDFVAAHGRIPQVAVEGDPGVLRVHTYLALALPINEYVGHRHGYKAQFMGDGAANPAVHVVTVNNFETPATVQLIFERVEVIAEGASAQYAITAGGEVLMNGMLADVRSKGLALEGVTAGDVLQARHTIGVDVGEGTVNFPVFTDGRFNHDASRAYDKGYGTVLESAIQAMDDAGLAHNFNSRKQLADYLQRPPSALKRNFYTRVEQHVDQEAVFFVQDVAAEFARVLSDVGALTEVAFVYGGGSGPLRDRLHEALLIKAAEMGSEDTFPVLY

SEQ ID NO: 2509 - DNA, 684 bp, Corynebacterium glutamicum
  CDS (101)..(661): RXA01965
acttctatgttactattaaattagtcaataacgttagtcataaacaatgcagttattgaagagaaacttcccgacacaatgtacgaaatgggggtcacacatggctcaaaaacaggacacgacacatgtatcagaggacgatgccccgtggcgtaatgtgcgtatgcgcttcccagaaacagacgctatcgttgagcggtttttggaaacacagggtgctcgtggcatctcgcttgcgatgcgacagctgatctatttgtttgtcgctgaatacggtgatgtagaggttgctaccgttattggcctcaagctggtggaaagcctgcaggcaggggctgagggtagtgatctttttgctcagctcgcggccggggttgctgacgtagacgctgtgactacacgcaagaaggcaccgcagcagatagcaccgccatcgaccacaacccgtgcacctgatcaggtaaatgagtttgttgccgaggcggagagtcagccggttgaggagtcagttgttgaggccaaagtacccaagcagcaggtagcaccacagccggcacagaagccggagcaaaaaccagaacaaaagtcggcgcaaccagcacagtcagagccagatgatggctttgatatggatgatgtcatgggccaagcgttcggtcgctagctcataccttgttacaacga

SEQ ID NO: 2510 - protein, 187 aa, Corynebacterium glutamicum
MAQKQDTTHVSEDDAPWRNVRMRFPETDAIVERFLETQGARGISLAMRQLIYLFVAEYGDVEVATVIGLKLVESLQAGAEGSDLFAQLAAGVADVDAVTTRKKAPQQIAPPSTTTRAPDQVNEFVAEAESQPVEESVVEAKVPKQQVAPQPAQKPEQKPEQKSAQPAQSEPDDGFDMDDVMGQAFGR

SEQ ID NO: 2511 - DNA, 726 bp, Corynebacterium glutamicum
  CDS (47)..(703): RXA01966
ccctgttatgggctgggtttataagaagatgggttagtttttaaaagtgtctgaatctgaaaacaacacaacaccagcagtcgcagctcgcgatgaccgtctggtctgggtcgatctggaaatgactggtctagatttgaagcgccacgtgatcgtggaggttgcggcgttggtcactgacgctaacctcaacgttttgggcgagggcgtggacttggttgttcacgcaactgaagaagagctcgcgcagatggatgattttgtcaccaacatgcacgaatcctctgggctgactgagcagatccgggaatccgcggtcacgttgaaggaagccgaagatgctgtgctcgcattgattgaaaagcactgcgatccagcccatcctgcaccgctagctggtaactccattgccactgaccgcgcgtttatccgcgaacatatgccacgtcttgatgaggccctgcattaccgcatggtggatgtgtcctcggtgaaggaattggcgcgtcgctggtacccacgcgtgtactacaagcagccggagaagggtttggcgcaccgcgcgttggcggacattgtggagtcgattcgggagttggattactaccgtcgctcattttttgttgcagagcctggtcctacctctgagcagtgcgcagatgatgcgcaggcagcggtggaccgttttgcaccctactttgattagagggttttaagcagcctggt

SEQ ID NO: 2512 - protein, 219 aa, Corynebacterium glutamicum
VSESENNTTPAVAARDDRLVWVDLEMTGLDLKRHVIVEVAALVTDANLNVLGEGVDLVVHATEEELAQMDDFVTNMHESSGLTEQIRESAVTLKEAEDAVLALIEKHCDPAHPAPLAGNSIATDRAFIREHMPRLDEALHYRMVDVSSVKELARRWYPRVYYKQPEKGLAHRALADIVESIRELDYYRRSFFVAEPGPTSEQCADDAQAAVDRFAPYFD

SEQ ID NO: 2513 - DNA, 1281 bp, Corynebacterium glutamicum
  CDS (101)..(1258): RXA01968
gaactggcgctttttaagttgtggcaattttgccagaagggcgtaacaggtgcgggtttttcgtggtaggcgcggagcagtagcaggatcttttcttgcagtgctggcaattggttcactggcgcttacgggttgcacaattgaacgaagcgatgcgcaggagcaatcctcgcagcaaagtacagaagttgaagctgaagaagctcaagctcctgtgatttctgttgatgatggtgatgaggatgtggacccttcggaatctgtcatcgtaaagtcgatgggtgacggtctgagcaaggtcaccatgactaatgaagaaggctatgaggttgagtcagagctttctgacgatggccgtagctggaccactgcggaaacccttggctacaaccgcacgtacaccattaaggcaaccgataagaacggcgagaccgctactgcgtcttttagtactgcaacccctgcagctaccacaaacgtggcgctttctccgctggctgattctgtcgttggtgttggccagactatcggtttccgttttggttcccctgtgaaggatcgcaaggcggctcaggatgctattactgtgacaacttcaccaaaggtggagggtggcttttactggttgaacaacagtgagttgcgctggcgtccagcggagtactgggagccaggtactgaagttacggtcgaggctgacatttacggcaaggatctcggcggcggtgtctggggcgaaactgataacgccaccaacttcaccattggtgacaaggttgaggctgtggcagatgatgccaccaagaccatgagtgtgtacaagaacggtgagttgctgcgcactatgccggtatcctttggtcgtgacacctctgagtgggcaacgccaaacggtacctacatcattggtgatcgcaatgagtcgatgatcatggactccaccaccttcggtctgggatatgaggagggtggctaccgcactccggtgaagtacgcgacccagatgtcctattctggaatttacgtgcacgcagcaccgtggtctgtaggtgcgcaaggtagctacaacacctcacatggttgcatcaatgtatccaccgaaaatgctcagtggttccaggaggccgtgaagcgcggtgacattgtgaccgtgaaaaacaccatcggtgagactttgagtggctacgacggactgggggactggaacattccatggtctgaatggagcaaggggaacgcggatcaaacttcggcgtggtaactgcggaagtcgcaggtaaa

SEQ ID NO: 2514 - protein, 386 aa, Corynebacterium glutamicum
VLAIGSLALTGCTIERSDAQEQSSQQSTEVEAEEAQAPVISVDDGDEDVDPSESVIVKSMGDGLSKVTMTNEEGYEVESELSDDGRSWTTAETLGYNRTYTIKATDKNGETATASFSTATPAATTNVALSPLADSVVGVGQTIGFRFGSPVKDRKAAQDAITVTTSPKVEGGFYWLNNSELRWRPAEYWEPGTEVTVEADIYGKDLGGGVWGETDNATNFTIGDKVEAVADDATKTMSVYKNGELLRTMPVSFGRDTSEWATPNGTYIIGDRNESMIMDSTTFGLGYEEGGYRTPVKYATQMSYSGIYVHAAPWSVGAQGSYNTSHGCINVSTENAQWFQEAVKRGDIVTVKNTIGETLSGYDGLGDWNIPWSEWSKGNADQTSAW

SEQ ID NO: 2515 - DNA, 497 bp, Corynebacterium glutamicum
  CDS (1)..(474): RXA01969
aaatgccagcgtcgtggtttaagccaggatccgttgtataaaaaccggaattccttgttgaccacgcagaagtggtttagtcctcgtcagcaagaaagcttggagcagttgtgggcgtatgacaaagcctacggggcgttaaagcttgcgtggcttgcgtatcaggcgattattgattgttatcagatgggtaataagcgtgaagcgaagaagaaaatgcggaccattattgatcagcttcgggtgttgaaggggccgaataaggaactcgcgcagttgggtcgtagtttgtttaaacgacttggtgatgtgttggcgtatttcgatgttggtgtctccaacggtccggtcgaagcgatcaacggacggttggagcatttgcgtgggattgctctaggtttccgtaatttgaaccactacattctgcggtgccttatccattcagggcagttggtccataagatcaatgcactctaaaacaggaagagccacttaag

SEQ ID NO: 2516 - protein, 158 aa, Corynebacterium glutamicum
KCQRRGLSQDPLYKNRNSLLTTQKWFSPRQQESLEQLWAYDKAYGALKLAWLAYQAIIDCYQMGNKREAKKKMRTIIDQLRVLKGPNKELAQLGRSLFKRLGDVLAYFDVGVSNGPVEAINGRLEHLRGIALGFRNLNHYILRCLIHSGQLVHKINAL

SEQ ID NO: 2517 - DNA, 605 bp, Corynebacterium glutamicum
  CDS (1)..(582): RXA01973
tccgcgatgtctaaatcgcaggatgatcgaaaaattgcagagcttgaagcacagtttcatagtcttggtcttaacaacactgaactagttacccttgatgatgcagcgtcgctattgggtgtgccggcaggtattcatcagattgaggccgaggtgatgttggtgaatttcggtgatggtgcagatggcatgggcggtgacacgacgaagtttttgcattatcagccagatgagtcgcagccttacgtctgggtgatgaagcgggtgtattcctttgaggcgatgaaaaagctcatggtcgggttgtttattggcttgtgcatactcatcgtgggtgggccagctttagggcttatgctcggtggttttatcggtgtgcttattggtctatgtctaggtacttccgcagccatgattgttggcccttttgggcttatgcggatgaaggcgtatccaccatgtatggacagtccatgggtgtatatgtcacaagagcagtggcgcaccgctatgggtgcggcacagcagaccgaggtgtcttttgttgagcactgggacaatatttacggggataatctgcattaacaaattagttaataaagtgt

SEQ ID NO: 2518 - protein, 194 aa, Corynebacterium glutamicum
SAMSKSQDDRKIAELEAQFHSLGLNNTELVTLDDAASLLGVPAGIHQIEAEVMLVNFGDGADGMGGDTTKFLHYQPDESQPYVWVMKRVYSFEAMKKLMVGLFIGLCILIVGGPALGLMLGGFIGVLIGLCLGTSAAMIVGPFGLMRMKAYPPCMDSPWVYMSQEQWRTAMGAAQQTEVSFVEHWDNIYGDNLH

SEQ ID NO: 2519 - DNA, 1552 bp, Corynebacterium glutamicum
  CDS (101)..(1552): RXA01974
acaatatttacggggataatctgcattaacaaattagttaataaagtgtagtatttaattaattattaaattcaattaacttttttgtaaaggtgggaagatgacccaggttgtggcgggtacgttggtgggagagtcgattaatcgtgagattgatgaagacaagtacccttatttgagctcgtatgcagcgcctgttgctgtaccggtgcgtgagattattgggcgcgaagaagaagtcaataagattatggccgcgctgatgcgtccagagatttctaatgtcatgcttgtgggtcctgctggttcgggtaaaactacgttggtacagcaagcactggtgaaagatccagagcgtaactacatcgaggtcgatgtagcgaaaatggttgcggatttgagcaccccggcgcaaatggctgcgcgtattaaaggtgtgtttgaggacgccattgcctatcgcaagcacgaaggtcatgaattggtgctgttcgttgatgagtttcaccaaattgtgcagctgtctaatgctgcggtagaggcaatcaagccgattttggcgatgtctggtgtccttggtgtgcgcgttatcgctgcgacaactctcgaagaatttcacgaacacatcaggccgaaccaagcattgacggagcgtttgcaggaaattcgactaacgccgaccgatcagaagaccactgtggcgattttgcgtggtatggcagatcgttatggcgtaagtgatcagttctatgacgaccacgtttttgagcagatttactccaccactgagcgttttatgccgagttctgtccagcctcgtaaatccattcgtgtccttgatgcgatggttggttggcatcgactttccggcaagccgatggatatggatctgctcggtgatgtgctccacgatgctattggtgtcgatattgcattcaaggtcgatggtacgagcattaaagacaagcttgatgagaaggtaatggcgcaaagtcttgccaccactgtggtagcacgtcgtttgcagctggtggtggcggatcttcatgataaatcacggccactgtcgaacttcttgttcaccgggcctactggtgtcggtaaaacagagctggtcaagcaactagcacgggtgctctttggtgatgacactgggcgattgattcgttttgacatgtcagagttcgccttagaatcaagtcttgaccttttcaggtctgagctcactcgtcgtgtcgctgaccagggtaacgctattgtcctgctcgatgaggttgagaaagctgatcgagctattgcgcggttgttactgcaggtacttgatgatggccgactatctgacgattacaaccgtgaggtgagttttcttaatacctatatcgtcatgacaactaacgctggttctgagattttcgagacaatttcgaactatgccactgatgacacgggcgatggtcgggcgatcaaagactttgtgaaaaacattcacacgtcgatcaagaataagggttttccacctgagcttcttggtcgtgtagatgaaattgtgcct

SEQ ID NO: 2520 - protein, 484 aa, Corynebacterium glutamicum
MTQVVAGTLVGESINREIDEDKYPYLSSYAAPVAVPVREIIGREEEVNKIMAALMRPEISNVMLVGPAGSGKTTLVQQALVKDPERNYIEVDVAKMVADLSTPAQMAARIKGVFEDAIAYRKHEGHELVLFVDEFHQIVQLSNAAVEAIKPILAMSGVLGVRVIAATTLEEFHEHIRPNQALTERLQEIRLTPTDQKTTVAILRGMADRYGVSDQFYDDHVFEQIYSTTERFMPSSVQPRKSIRVLDAMVGWHRLSGKPMDMDLLGDVLHDAIGVDIAFKVDGTSIKDKLDEKVMAQSLATTVVARRLQLVVADLHDKSRPLSNFLFTGPTGVGKTELVKQLARVLFGDDTGRLIRFDMSEFALESSLDLFRSELTRRVADQGNAIVLLDEVEKADRAIARLLLQVLDDGRLSDDYNREVSFLNTYIVMTTNAGSEIFETISNYATDDTGDGRAIKDFVKNIHTSIKNKGFPPELLGRVDEIVP

SEQ ID NO: 2521 - DNA, 1644 bp, Corynebacterium glutamicum
  CDS (101)..(1621): RXA01976
gtgattccgggcgtcttcgcttagagtaaattaaaccgtaaaaataaactcaattaagttagtatattaattacttgatttaattgaaggggtttatagtatgacgcaaacacttgctggcgagcgcagaatcgtcaccacggcagagcttaaagcgatgctggcacgaggggataaggtgtttctgcctggtgtcgcagcgcgggcgccagagatcctcgacaacttcgatccagcagatcgggcacgtctcgacgtgcccgcagcagacaatgaaatcgtctctgtagaattctcccgccgcgataccgtgcaatgcatcagcattgccgaccgtgaccatctctacatcactgacgatatgatcccgacccacaacacgtccaacattatcttcttgaaatccacagacgaaacaatgattaagacgttggtggattggtcaggtgagcgacatgttgtacgcagaaattcaaagaccgtaacccgtgacttggcacagttagttatgcgcaccgagggtaaagtgtcgtacacgtctgcaactgaaaaagagccggtggtgtcttataatgacctaaatactctgccatcgcagaacgccatcgtcttccgtgcgggtcagtatccggtgtggtcacgcaatgaaacgatttggccgatgtcgttcatgttgtttgctaaccagattatccaaccgggtcgcgaatactcgttgcagactattccaacactgtcgagcgctaatgaattcgatgtgaatcaaaatgcaccggactttatggcgatgctggaaaagcgcatggcgcagtcgattcgtactcagcgtgccgtcgatatttataaaaaggcgactgggctcgatgactctgatattgcacgcctggatatggatgtgtattcagcagaaatcatggacatcgtggacacgatgatcgcgaaagatgagtacgatgacacgccggattatgacgagggggatgagtctgtcatgaatgctcgtgatttcatggagtctgaatatgacgtttttgatgatgagttcgaagacagtgctcagggcttccccgtggctactggtacgaaggtgaaaaagaaatctctgtctgaagaagcagaggtcaatgatgaattcattcacgatcaggagaatgcagaacataagctcgctgacatgcggttgaagcgttatgccgaaggcaaggtgtcacgagatatgctggctgatcaattcggccacatcctgcaggactcactcgaagatgagctcactgcagcctatgatgagagcctgcacgcttttgctcaagatccgaatttccgggtgactgctaacaacggcttggttaatgctgtcgatggcactgtgttgattgaggcgttgtcgcaggaagatattgcacttatgcgcgcgcaagcaggagtggagcagtcgcgtgtctactctgagggtgaagaagctctatctggcacagaggatgatccgctgtctgctatgggtaaatataagaccacccgagcattccgcatcatgctggtggagcttccgcattggcgtgatctcgcccagggtcactttgataaagaagtcgcgcgagcctttaggcgtattgaagatgcttaagtgtcgtgagcgataaaaaa

SEQ ID NO: 2522 - protein, 507 aa, Corynebacterium glutamicum
MTQTLAGERRIVTTAELKAMLARGDKVFLPGVAARAPEILDNFDPADRARLDVPAADNEIVSVEFSRRDTVQCISIADRDHLYITDDMIPTHNTSNIIFLKSTDETMIKTLVDWSGERHVVRRNSKTVTRDLAQLVMRTEGKVSYTSATEKEPVVSYNDLNTLPSQNAIVFRAGQYPVWSRNETIWPMSFMLFANQIIQPGREYSLQTIPTLSSANEFDVNQNAPDFMAMLEKRMAQSIRTQRAVDIYKKATGLDDSDIARLDMDVYSAEIMDIVDTMIAKDEYDDTPDYDEGDESVMNARDFMESEYDVFDDEFEDSAQGFPVATGTKVKKKSLSEEAEVNDEFIHDQENAEHKLADMRLKRYAEGKVSRDMLADQFGHILQDSLEDELTAAYDESLHAFAQDPNFRVTANNGLVNAVDGTVLIEALSQEDIALMRAQAGVEQSRVYSEGEEALSGTEDDPLSAMGKYKTTRAFRIMLVELPHWRDLAQGHFDKEVARAFRRIEDA

SEQ ID NO: 2523 - DNA, 699 bp, Corynebacterium glutamicum
  CDS (101)..(676): RXA01977
aagtccagtgactaataccaatagaattgaagaccactacctcaagggcggacgtggcaggggcacagacgatcctagcaatatgcaaattgcaggaagtatgttgcgcacattattcgtccgcaagattagagcgctgctgctggttttgatgattgcgccaactccattggtcgaagggctaacttcgactgcaatgattgtatccgtagtaatcctggcgatctacatggcgataacaatgtatagagtagtgcacggtcgccatgagttcgcgcatatcgcacgtcgcatggcgctttacgtcaacaagacttcttctaggttcagtgttgttattgcttatgtagtattaattgctatttatgcgctactaattcccggacttgtctactctgttacatttggattcatcgtcccaagcacacctaatacgtttagtgatgcacctgcatggattatgtgcgtatcgctgctgctcattgcagtcgccagtttcatcacatcaatcatggatgactttattgatggcatactcactgatttttatgacgaagataatgctgatagccccgatagtcctgccgaggatatagccacccgtcctgtcgagagcgcaacaacaagtgctcttgctggatttgctgttggttatatttgtgggcgctttaatcgctaacacttaaaacacttctcaac

SEQ ID NO: 2524 - protein, 192 aa, Corynebacterium glutamicum
MLRTLFVRKIRALLLVLMIAPTPLVEGLTSTAMIVSVVILAIYMAITMYRVVHGRHEFAHIARRMALYVNKTSSRFSVVIAYVVLIAIYALLIPGLVYSVTFGFIVPSTPNTFSDAPAWIMCVSLLLIAVASFITSIMDDFIDGILTDFYDEDNADSPDSPAEDIATRPVESATTSALAGFAVGYICGRFNR

SEQ ID NO: 2525 - DNA, 1281 bp, Corynebacterium glutamicum
  CDS (101)..(1258): RXA01982
tgccgccgaccatgagatgatcaagcgctttttcaccctgcaccttcgctaagactctaccttcacccaactcatcatctactgaaagaaggcttctgctatggctaccaccagcctccccacgacgattacaccggattccgaggagaccgtagaaaagcgtcactccctgaccccgatcctggattcacttccctgcgagtcagttccctatgctctggctgcaggtgagggacaacaacaccagcttggcccctaccatctcacagttatgtcccgtcccgaagacaacggtggaatattttcgctggctcgtgtgagcgcaggcaagactcccgccacccggttcttctctgtcgcaggaccgacgttcctctacatgatggaggggcggttgactctctggttcgctgatggacgtcaagagatcatcgctggcggcagtgccaccattcctacgaatacgccctggtccttcgcctgtgagggcctagtaaattcagctctagtgtactactcatcctcgaatgcattcctacacgcggcagagaaacttggcacgtcctcgttctcccacaccttccgcgtcagtggcgaggtcacagggattccctacgaggaactggaggattgcggattcacattctatgagcgggaccaccttgccgagctcgggccgcatttcgatcgcctcccagaagatatgaaggcgtttgccctgaacgatggtgagggggaccggcttgagcagttcgagcagatcaacagcttcgtctgccgtccgagacacaccggaaatcagttcctcgctatgcagaccaagggtgccaagacgccttatatacctcgtcatttccaccgccttcacaccgaaaacttcatctgtctggacgggcgcgtcaaactgcacgtcaacggtcaagagatcatcctctcccgtggggattacgttcatgccccagccggaaccatccactctttcgccttcgcagggcacaatacccagatgctgggagtgctcaccacagaggtattcgagaagttctttgactacataaacactccgactaatgctcgagttcagctggaggacggggggaagccattttttcctgctgaagcattcgcgaaagtccaagctgaactcgatgtcgtggtggtcggccccccacgaattagtaccctggatgttgttacaaactcgcgtttcgaaccaattaacagaactatcacctatcgtgcgctggacgctaaccaatagtgagtgagccgaaatccctg

SEQ ID NO: 2526 - protein, 386 aa, Corynebacterium glutamicum
MATTSLPTTITPDSEETVEKRHSLTPILDSLPCESVPYALAAGEGQQHQLGPYHLTVMSRPEDNGGIFSLARVSAGKTPATRFFSVAGPTFLYMMEGRLTLWFADGRQEIIAGGSATIPTNTPWSFACEGLVNSALVYYSSSNAFLHAAEKLGTSSFSHTFRVSGEVTGIPYEELEDCGFTFYERDHLAELGPHFDRLPEDMKAFALNDGEGDRLEQFEQINSFVCRPRHTGNQFLAMQTKGAKTPYIPRHFHRLHTENFICLDGRVKLHVNGQEIILSRGDYVHAPAGTIHSFAFAGHNTQMLGVLTTEVFEKFFDYINTPTNARVQLEDGGKPFFPAEAFAKVQAELDVVVVGPPRISTLDVVTNSRFEPINRTITYRALDANQ

SEQ ID NO: 2527 - DNA, 1022 bp, Corynebacterium glutamicum
  CDS (1)..(999): RXA01990
acatctgatcatgtggcacagtttggtatggcaactgcgtctgctgcgacgttgccggacagtattgtgaccagtgtttcttatacgttgaacgggctgtcattttctgacccggttgagctgggtatcagtgacaacgacaagcgtgaagagcttctaggagacatcaccaagggtgaactgcgattgcagatggagttttcgatcccggattcagcaactgccgaggatgagtacgtctttaatctcaccggcgatggacttcggtttttcaattcaaacgatcgcaccgtccctgtacgcaatgatgcaggtattcgtgtcgcagatcttttggtgagcaacggtggtacgcgcggtacgttgacaaactttagttcggatgctggcactacttctcgcaccgcagctcttgatatggaactgtacgggtgggtgagtagcgcccagcagacgggtgagcgaccaattcaagactggactgtgggtaagactgagggtcaggttgagaacaaggtagtccgctacggcgttgctggacacccgtggattatcagtactgtccagcacacgtgggttaagtctacgcagaccgtgtcgcatttccgaagtgaacaagactggaagattaatcaaccaccagctgttgatatgggcgcattagcatacgcagctccacttggcgtcgtggtcgggcacgccaatgttgtcattagcaataacaacggtgctggattccggggtgcgcttgtcaataccacacccaccacacgcgacgtgatacttaatttcacagccgcagacggagccactttacgcgaacgttccggaggtggatttgaggatttcgacgttttctcggaagttcctcgggtagaggaaacatcgacgaggatcagctattcttacaaaaattcatttgaatatgacgaatttgttgccgcatttcccgagtaccgacgtagctgcgtgggaaccaaccgttgtgtattcagcggataagaccacagcaacagcgacgt

SEQ ID NO: 2528 - protein, 333 aa, Corynebacterium glutamicum
TSDHVAQFGMATASAATLPDSIVTSVSYTLNGLSFSDPVELGISDNDKREELLGDITKGELRLQMEFSIPDSATAEDEYVFNLTGDGLRFFNSNDRTVPVRNDAGIRVADLLVSNGGTRGTLTNFSSDAGTTSRTAALDMELYGWVSSAQQTGERPIQDWTVGKTEGQVENKVVRYGVAGHPWIISTVQHTWVKSTQTVSHFRSEQDWKINQPPAVDMGALAYAAPLGVVVGHANVVISNNNGAGFRGALVNTTPTTRDVILNFTAADGATLRERSGGGFEDFDVFSEVPRVEETSTRISYSYKNSFEYDEFVAAFPEYRRSCVGTNRCVFSG

SEQ ID NO: 2529 - DNA, 573 bp, Corynebacterium glutamicum
  CDS (101)..(550): RXA01992
atagatcaatgctggcataaactaaaggcacaacagccgattcacttatttttaggcgaatgcttgaagtcgaagtaagtgagggggagaggatccgttagtgtactgcccattttgccaacatgatcattcaaaagtcattgactcccgcgtcattgacgccggaagcgccattcgcaggcgccgcgagtgcagcaaatgcgaaggccgtttcaccaccatcgaaaaagctgttctcctcgttgttaaaagaaacggcgtcactgaaccgttcagtcgagaaaaagtagtcaccggtgtccgtcgtgcatgccaaggccgcgacgtatcagatgacgcgttgaaacgcctagctcagcaagtggaagaaacagtccgcagcaacggaagctctcaagtacgcgctaacgatattggtttagccattctcgatccactgagagaactcgacgaggtagcgtacctacgctttgcctctgtgtataagtcttttgacagtgctgacgactttgaaaaagaaatccgcctcatgcgcagacgcggaagggactagcagacacaaagtcttaacta

SEQ ID NO: 2530 - protein, 150 aa, Corynebacterium glutamicum
VYCPFCQHDHSKVIDSRVIDAGSAIRRRRECSKCEGRFTTIEKAVLLVVKRNGVTEPFSREKVVTGVRRACQGRDVSDDALKRLAQQVEETVRSNGSSQVRANDIGLAILDPLRELDEVAYLRFASVYKSFDSADDFEKEIRLMRRRGRD

SEQ ID NO: 2531 - DNA, 594 bp, Corynebacterium glutamicum
  CDS (101)..(571): RXA01999
gggtatgtagttagagacgacagacacagaaatcttcagcctcgcgaaccgagtgatagcatacttgaccatatcgaattctctaccagctcgaggcatcatgactctccccacccctacacattccaccaaaggcagttcaggccgcatgaaacgaatggcccttatcggctcctcgctcattatttccatgggacttattactgcgtgcggttcggccgctgcagaacccgaagcccctgcaccaacagttaccgaaactgtaacagccacggtgacaaccacagctaaagccagcacgatcacctcgacagtgacggaaactacctccgcggaagatcttgcccaagaaattgtgaagccagcggccgtggaggaatattcagagcctcaggtaaatacgccacagcagtttgcggccatcccggaacctgcaccggcggttgcaccagctcaaacgtattacgccaactgcgcggcagttcgtgcggcgggtgcagctcccctttatgcgggatcacctggatatagttccaagcttgatcgcgatggcgacggaattgcctgcgaataaataggaatagttaaaaacac

SEQ ID NO: 2532 - protein, 157 aa, Corynebacterium glutamicum
MTLPTPTHSTKGSSGRMKRMALIGSSLIISMGLITACGSAAAEPEAPAPTVTETVTATVTTTAKASTITSTVTETTSAEDLAQEIVKPAAVEEYSEPQVNTPQQFAAIPEPAPAVAPAQTYYANCAAVRAAGAAPLYAGSPGYSSKLDRDGDGIACE

SEQ ID NO: 2533 - DNA, 572 bp, Corynebacterium glutamicum
  CDS (1)..(549): RXA02001
acccgcgaccccatcgtcgcagccgtcggaattgtccaagcgtttcaaacgatagtcagccggaatcacaatccggtcgaggaccttgtcgtgtcggtcacgcaaatccacaccggcagcgccgataatatcatccccgaaaccgcctatatcaacggcactgtccgcaccttcaacaaagacgtgcaggccatggtcatcacgcggatggaagaaatcgtcgcgggccaagctgcagcctatggggtcgaggcgacgctgacctacaaccgcaactatcccgccaccattaacgacgccgccaaagccgccatcgctgccgaagtcgcgggcgaggtcggcctcggggtcaacccgaacggctcgcgcgggatgggggccgaggatttctcgtatttcctcgaaaagcgcccgggtgcctacctgttcgtcggtaatggcgacagcgcgggccttcacaaccccgcctataatttcaacgacgaggccgcgccctacggcgcatcgttcttggcccgcatggcagaacgccccttgccgttaaagggctgatccatggcgctcgaagatgc

SEQ ID NO: 2534 - protein, 183 aa, Corynebacterium glutamicum
TRDPIVAAVGIVQAFQTIVSRNHNPVEDLVVSVTQIHTGSADNIIPETAYINGTVRTFNKDVQAMVITRMEEIVAGQAAAYGVEATLTYNRNYPATINDAAKAAIAAEVAGEVGLGVNPNGSRGMGAEDFSYFLEKRPGAYLFVGNGDSAGLHNPAYNFNDEAAPYGASFLARMAERPLPLKG

SEQ ID NO: 2535 - DNA, 230 bp, Corynebacterium glutamicum
  CDS (1)..(207): RXA02004
cgcgtcggccgtctgatgcgtcagaacggcattctcatcatccgcagccggaagttcaagcgcacgaccggcagcgatcataccttcaacatcgcaccgaactttctgcagcaggactttatggcgagcaggccgaaccagaagtgggcgggcgacatcacctatgtctggacgcgcgagggcctgggtctatctggccgacattcttgacctttatccccgccgggtga

SEQ ID NO: 2536 - protein, 69 aa, Corynebacterium glutamicum
RVGRLMRQNGILIIRSRKFKRTTGSDHTFNIAPNFLQQDFMASRPNQKWAGDITYVWTREGLGLSGRHS

SEQ ID NO: 2537 - DNA, 565 bp, Corynebacterium glutamicum
  CDS (71)..(565): RXA02006
atcatccatacatgcagagcacagctttcacacatagacatcactgcacatttatctaatgggagactcaatgacagttgcacacaaacgaagtctgacatggatcaagagactatctgcgactacatttgcagcttttcttggcattcagcttgtgacccccgctcactcaattgaaaacacgacgcagattccagaaagcgaattgcacaacctcgggctcacagacgaagaaattcaagaattcaatcaatatctcattgacgagtcactctttcaagagactgtagaaacctctccgatcgtagtcagcgacaatgaagatgcagcccaagatcccggtttcggccttttcaccacaaatcctgtgaaacacacagatgagcacattggcgctctatacttctccgacctaccaggtatttccaatcttacgtgcactgccaactacatcggtggaaaattctggaccacagcacatcattgtgttgaaggccgcagtcgcttcgtcggcttcatcgagcagtcggacggacaatatgcaggcattgagcatgtttacaca

SEQ ID NO: 2538 - protein, 165 aa, Corynebacterium glutamicum
MTVAHKRSLTWIKRLSATTFAAFLGIQLVTPAHSIENTTQIPESELHNLGLTDEEIQEFNQYLIDESLFQETVETSPIVVSDNEDAAQDPGFGLFTTNPVKHTDEHIGALYFSDLPGISNLTCTANYIGGKFWTTAHHCVEGRSRFVGFIEQSDGQYAGIEHVYT

SEQ ID NO: 2539 - DNA, 223 bp, Corynebacterium glutamicum
  CDS (101)..(223): RXA02009
aactgcatcattgtcgttcctgaacaagcgccgtggtttaagccagccatcatcaaacaggcttaaaaatactcaatcgtcccattcaagaaaagagcacatgaccatgtacaacgccgcaaagacccttgttccccagattgttgctttcgatgacacagcaatcatcgcactcgaccaagccgcggaagatgaattccgcaaggctaactaccccgaggtt

SEQ ID NO: 2540 - protein, 41 aa, Corynebacterium glutamicum
MTMYNAAKTLVPQIVAFDDTAIIALDQAAEDEFRKANYPEV

SEQ ID NO: 2541 - DNA, 649 bp, Corynebacterium glutamicum
  CDS (101)..(649): RXA02013
atcaccgcgctggcgacaatttcagaaaactcccacaaagcactgcttggcctttatttgtccggtcttaaacacggcatgatggctaacatcggagaacatgacggaaagtcctgatctagcagtttcctttttagccgccttcaatgacatcgaagcgcaccttcgaacccagctccgcgctaaacgctccgacagtttcagatggatggtacgtatcgccgagaaacagcatctgatttccaaagaacaagcagaaacccttgatgcttttgcggagctgcgcaacgcaattagccacggccaatacaacgatctacgcccgattgccgatccccgccccgacaccgtggacaccattgagaagattcgctccctccttctcaatcctccaattgcgttaaacgtcctcccggagcaaaaggtccgctcctactcacttgaagatccagtgagtagggccttagaagttgtgcacaccacggagatctcccaattccccatatataagggaacggaatacgtggcactgctaactaccaacacaatcgctcgctgggttgcctccgatttacatgacaatgcccagctggatgcacgttctatcaaagaggttctggattatgcagaatcctctgacactgcagtt

SEQ ID NO: 2542 - protein, 183 aa, Corynebacterium glutamicum
MTESPDLAVSFLAAFNDIEAHLRTQLRAKRSDSFRWMVRIAEKQHLISKEQAETLDAFAELRNAISHGQYNDLRPIADPRPDTVDTIEKIRSLLLNPPIALNVLPEQKVRSYSLEDPVSRALEVVHTTEISQFPIYKGTEYVALLTTNTIARWVASDLHDNAQLDARSIKEVLDYAESSDTAV

SEQ ID NO: 2543 - DNA, 1071 bp, Corynebacterium glutamicum
  CDS (101)..(1048): RXA02021
ttgggtcgccgaggagatctaatcctggtttgagttcagagttcacaggtttaagcctacaaaccttagttaaaacatgatggaagcggtcgattaaaaaatgagtgaaaacattcgcggagcccaagcagttggaatcgcaaatatcgccatggacgggaccatcctggacacgtggtacccagaaccccaaattttcaacccggatcagtgggctgaacgctacccattggaagtgggcaccacacgcctcggagcaaacgaactcaccccacggatgctgcagttggtaaaactggaccaagatcgcctcgtcgaacaggtagcagtccgcaccgttatccccgatctgtctcaacctccagtagacgcgcacgatgtttacctgcgcctccacctgctttcccaccggctggtccgcccccacgaaatgcacatgcaaaacaccttggagctgctgtccgacgtggtgtggacaaacaagggcccttgccttcctgaaaactttgagtgggtgcgtggtgctctgcggtcccgcggactcatccacgtctactgtgtggaccgtcttccccgcatggtcgactatgtggttccccctggagtccgcatctccgaagcagaacgcgtgcgcctaggtgcataccttgctccgggtacctctgtgctgcgtgaaggtttcgtgtctttcaactccggcaccttgggtgccgcaaaggtggaaggccgcctgagttccggtgtggtcatcggtgaaggttccgagattggactgtcttctactattcagtccccgagagatgaacagcgccgccgtttgccgttgagcatcggccaaaactgcaactttggtgtcagctccggaatcatcggagtcagtctgggagacaattgcgacatcggaaataacattgtcttggatggagatacccccatttggttcgcagccgatgaggagttacgcactatcgactccatcgaaggccaagcaaattggtcaatcaagcgtgaatccggcttccatgagccagttgcccgcctcaaagcttgacccattttcataaccagtgc

SEQ ID NO: 2544 - protein, 316 aa, Corynebacterium glutamicum
MSENIRGAQAVGIANIAMDGTILDTWYPEPQIFNPDQWAERYPLEVGTTRLGANELTPRMLQLVKLDQDRLVEQVAVRTVIPDLSQPPVDAHDVYLRLHLLSHRLVRPHEMHMQNTLELLSDVVWTNKGPCLPENFEWVRGALRSRGLIHVYCVDRLPRMVDYVVPPGVRISEAERVRLGAYLAPGTSVLREGFVSFNSGTLGAAKVEGRLSSGVVIGEGSEIGLSSTIQSPRDEQRRRLPLSIGQNCNFGVSSGIIGVSLGDNCDIGNNIVLDGDTPIWFAADEELRTIDSIEGQANWSIKRESGFHEPVARLKA

SEQ ID NO: 2545 - DNA, 504 bp, Corynebacterium glutamicum
  CDS (101)..(481): RXA02036
ctaaaatggaaggcaatggatacccgccgcatgaacctccgccaatggaaaatcctcgttgccctcatctctgctgcagtggcggctctcggagggtggtgtgcatattccttttgggcacctcgccgacaccgtctcctgggactgcgggggaggcagctgcgccaccaacgatttggtatccctgttcatgccggccgccttcatgagtaccctcgccgcctgcgtatttggcgcgtgggccataggtttgatcgctcccgcactattcatcgcggtgactgcctgggcatttcgctccggcgtgcaggctgcgattgccgacggctacacgtccgcgacttccgtcggcttcgaaatgactgtctcgctcattcttttcatcatcgcaggtctgtgctttctgggctggatccccatgttcatcaacaaccgccaagtcgcgcgcaaggtccgcgagagggctgcgggcttgagcaattaggctctcgcttttcgacgttt

SEQ ID NO: 2546 - protein, 127 aa, Corynebacterium glutamicum
VHIPFGHLADTVSWDCGGGSCATNDLVSLFMPAAFMSTLAACVFGAWAIGLIAPALFIAVTAWAFRSGVQAAIADGYTSATSVGFEMTVSLILFIIAGLCFLGWIPMFINNRQVARKVRERAAGLSN

SEQ ID NO: 2547 - DNA, 551 bp, Corynebacterium glutamicum
  CDS (1)..(528): RXA02040
tacataccttttgtcatttggtccgatctcggtgaggctgccgaaggtgagaactttgctcgcttctggtcctggctgaaatcgcgccgggacaaagctcgccagcagggacaaaccttcggtgtgttctgctatgccagcaacggcgaaaaccactggatgctctccactgctcgcagattcttcggcaaagtcaaaggtgtgcccgacgagcaagaaatccgcagcttcattagctctgaccaatggaatgacatgtttgctgtcgcgcgctcccaacttgttggccccggtggtttaggtctgaaacaactcgcgccggcagctggattccattgggaggaagaagacttcgcaggtgaagatagcctccacgcatatctcattgcttccacggctgccgaaccagaagctgaggccgctcgtgctcaattgctcagctacaacggcgatgattgcagggccaccgcagcggttcgccattggcttcgacaaggtgcgcgcacggcacctgtgctggggaatatttaaaccaaggaaggattctccag

SEQ ID NO: 2548 - protein, 176 aa, Corynebacterium glutamicum
YIPFVIWSDLGEAAEGENFARFWSWLKSRRDKARQQGQTFGVFCYASNGENHWMLSTARRFFGKVKGVPDEQEIRSFISSDQWNDMFAVARSQLVGPGGLGLKQLAPAAGFHWEEEDFAGEDSLHAYLIASTAAEPEAEAARAQLLSYNGDDCRATAAVRHWLRQGARTAPVLGNI

SEQ ID NO: 2549 - DNA, 364 bp, Corynebacterium glutamicum
  CDS (101)..(364): RXA02046
tccgtgccatcaccaccggcgagatcactggcatcgtggacgcaaaacaaacagcaacagaaattattaacatccgacgcaacgcttcaggagagtcctcatgaaagagacactgaccaccggtttaacccaccaaatgacctacatagtgccagcaaaccgcacagttccgcatctgcttcccgaagcagcagaatttgaaaccatgccagatgtcctggccactggatatatggtcggcatcatcgagtgggcctgcatggaacttctgcgtccccatttggacgacggtgaaatctcgctgggcactcatgtgaacttctcccacgcagctccaacggttcctggatccacggtcaccatc

SEQ ID NO: 2550 - protein, 88 aa, Corynebacterium glutamicum
MKETLTTGLTHQMTYIVPANRTVPHLLPEAAEFETMPDVLATGYMVGIIEWACMELLRPHLDDGEISLGTHVNFSHAAPTVPGSTVTI

SEQ ID NO: 2551 - DNA, 621 bp, Corynebacterium glutamicum
  CDS (101)..(598): RXA02051
cgcactgatcggtgtagtaactggcggtattttgctgctaattaactcgcaaaacggtgagcagacatcatcttcaactcgcacaacagtcaatgactccatggtcatcagagctctccagcgcgaagaagaaatcgtccttctcagcgccggagcacttggaatccatgagaaaaccgttgaacgtacaattcgtggaaaacgtattcctggcacgcaaaagaccgtgcacgtccaatacagctacaccggaaaactcggaatcgatgcctcagatgttgaaatcaaatccgcaggtgacaataagctttccatcactatccctgagttcatcttcatcggatacgacgatctaaagtttaagaccatagccgaagatgacggttggatcagtttcagcactgacgatatcgatactgcagaagtagtttctgagatcatgagccaagagaacttcgtcgagcaagtaaccactaaccgggaaatgttggaagatcaagcggttgatttctacaacgacctgctccacgaattcaccgagaaactcgatacagatcgatacgaagacaccaagattgagctcgaattcgagtttgagtagatagtgcttcgaagacagtt

SEQ ID NO: 2552 - protein, 166 aa, Corynebacterium glutamicum
MVIRALQREEEIVLLSAGALGIHEKTVERTIRGKRIPGTQKTVHVQYSYTGKLGIDASDVEIKSAGDNKLSITIPEFIFIGYDDLKFKTIAEDDGWISFSTDDIDTAEVVSEIMSQENFVEQVTTNREMLEDQAVDFYNDLLHEFTEKLDTDRYEDTKIELEFEFE

SEQ ID NO: 2553 - DNA, 702 bp, Corynebacterium glutamicum
  CDS (101)..(679): RXA02053
aaccagccagaaactatctccaaaagctaataaaacccttgcactgacaaataaggcgacctaccatgactctgtttccaacacataaaaaggataaaaaatgtcactttcagtcgtcgaggcgattaccaaccgccgcgccacccgcaaatacaccgatgaagctcctacccctgagctgatcgacaaaatcgttgaccttgccctggaggcacccagtgcgttcaatgcgcagcaacgtgaaattgttgtgattactgatcccgcacagaagcagaagctttacgaggcctcccatcagaaacaattcctcaccgcacctgtaactttcattgcggttgcccgcgtggaaaacgagcctgaggatttggaagagattcttggtacggaaagggctgaacgtgtcgcgggattcatcaacggtcgcagcattcagcaggcacgcgaagcaacgttgagggatgccagcctcgcggcggcttttctaattctggctgcccaggcggagggtttgagtaccagcccgactactggttgggatgaggaaaaagtgaaggaagcaatcggtctcggcgggcgtgaggatcgtgcaatcgcccttgttattgctaccggattccctaatgaacagccggagcaccctggtcgtttgcagaataggcgcatcgacaacagctactaactctgccagctcgcccggac

SEQ ID NO: 2554 - protein, 193 aa, Corynebacterium glutamicum
MSLSVVEAITNRRATRKYTDEAPTPELIDKIVDLALEAPSAFNAQQREIVVITDPAQKQKLYEASHQKQFLTAPVTFIAVARVENEPEDLEEILGTERAERVAGFINGRSIQQAREATLRDASLAAAFLILAAQAEGLSTSPTTGWDEEKVKEAIGLGGREDRAIALVIATGFPNEQPEHPGRLQNRRIDNSY

SEQ ID NO: 2555 - DNA, 654 bp, Corynebacterium glutamicum
  CDS (101)..(631): RXA02057
aagtctttatagtcctgcactagcctagaagggccttatgccgtgtgaatcacacagcatacggccctttttgctgccgtggttgcctaaggtggaaggtatgaaacgaatctgtgcggtcgcgatctcttcagtacttttgttaagtggctgctcctccacttccacaacgcagctcgagggattcgatggacgctcagcgcaggagatcatcacagaacttgatcaaaccccagtcgcagacagagcaactaacctcatggcctccattcgggcagatgagttaattctgtcggatcaaagcggacagctcagcattgacatgcctgcagatgagttctatatctccgcagccccgtacaccaccacaacccacgagtgcttctatcacagcctcaccacatgtactggtgaactcgccaacaccccagtgaaagtaacggtggtggcagataatggagaaaccatcctcgaagaggacaccatcacctacgataatggatttgttgggatgtggctcccccgcaacattgatgccacactcaccatcgaacatgacggcctgaaatccacccagccgatctctacgggtgatgacgcccccacgtgcatcaccacggctgaactagcgtgaaaatcctttagacaataaga

SEQ ID NO: 2556 - protein, 177 aa, Corynebacterium glutamicum
MKRICAVAISSVLLLSGCSSTSTTQLEGFDGRSAQEIITELDQTPVADRATNLMASIRADELILSDQSGQLSIDMPADEFYISAAPYTTTTHECFYHSLTTCTGELANTPVKVTVVADNGETILEEDTITYDNGFVGMWLPRNIDATLTIEHDGLKSTQPISTGDDAPTCITTAELA

SEQ ID NO: 2557 - DNA, 675 bp, Corynebacterium glutamicum
  CDS (101)..(652): RXA02058
gaagcggattttagtccttgcgcttggtgcctcggtagcgggatgctcaacgctttcccaagaaccttcaccacctgttccgttgggaaacgttgatactgtgcagattgtctctcccaatggggagattgagtcttttgtgctggggaagctgtatgagaccgcattagtggaacgtggcagatctgcatcagttcagctgattgacggcgacttggatgagcaactatctatgctgcgagatgacagcactgatttggtgattgcttgctcaggacaattactggaatattacaacccagatttagcctccgagtttgccgtcgaatacgctaatcagacagcctttgataaaaactctggtgaatggcgcgaaaaagtctacgatgctctccaaggatcgctgccggactccatcgtggccaccgatccttccaatgctattggttgtaaggacgatacgtcgctgcctcaaaacatcgtgccaatttatagaaagcccaatctggatagggacaatcgggacaccctgaactttgtgagcggttctttgggtacaagcgatttggaagcattggtcaaggacgcccaaacaacaggcacaacctctgaaactgcgctggatttcttattgtctaaaggattttcacgctagttcagccgtggtgatgcacg

SEQ ID NO: 2558 - protein, 184 aa, Corynebacterium glutamicum
VQIVSPNGEIESFVLGKLYETALVERGRSASVQLIDGDLDEQLSMLRDDSTDLVIACSGQLLEYYNPDLASEFAVEYANQTAFDKNSGEWREKVYDALQGSLPDSIVATDPSNAIGCKDDTSLPQNIVPIYRKPNLDRDNRDTLNFVSGSLGTSDLEALVKDAQTTGTTSETALDFLLSKGFSR

SEQ ID NO: 2559 - DNA, 702 bp, Corynebacterium glutamicum
  CDS (101)..(679): RXA02069
cgccatctgcttggtgccgtagctgtcgatgacttgctcgaccacatgctgccagaagactggcgcgacgccggaatccgaccaggaaaggagcacacccatggctgatttcaaccgctctgaattagacagcccactttttggatcccgcaaacgatttaaattcgacgatgacaccattggtgcctacgccgaaaaagtagcccggttctttggcacgggacagtacctgttttggcaaaccattttcgtggtggtgtggattttcctcaacatcggtggttgggcctggagttgggacccctaccctttcatcctgctcaacctggcattctccacgcaggctgcttatgctgctccgctgatcctgttggcgcaaaaccgtcaagaagaccgcgataagcacaccattttggcggatcgtcggcgtgctgaagagacaaaagccgatactgaattcctcgcacgggaactcgcaggcgttcgcttagccttgggagatactgtcacacgtgactatttgcgccatgagttagaagatctccgcggacttcttgaccgcattgaagccaagctcgacgacgaggcagcgtcccgtattgcagaccgccacgaacagcacggatcaggacctcaagatttgtctgaccccactcagggtgatgttgcagacgaattttagggagtatcaaaacttgggac

SEQ ID NO: 2560 - protein, 193 aa, Corynebacterium glutamicum
MADFNRSELDSPLFGSRKRFKFDDDTIGAYAEKVARFFGTGQYLFWQTIFVVVWIFLNIGGWAWSWDPYPFILLNLAFSTQAAYAAPLILLAQNRQEDRDKHTILADRRRAEETKADTEFLARELAGVRLALGDTVTRDYLRHELEDLRGLLDRIEAKLDDEAASRIADRHEQHGSGPQDLSDPTQGDVADEF

SEQ ID NO: 2561 - DNA, 1221 bp, Corynebacterium glutamicum
  CDS (101)..(1198): RXA02070
agcacggatcaggacctcaagatttgtctgaccccactcagggtgatgttgcagacgaattttagggagtatcaaaacttgggactactatcgatacgtgatgactcaagtaaccgaatccgctgtccgcagcgcgctatcccgcgtagaggatccagagatcggtaagcccatcacagagctcggcatggtcaaatcagtgtccatcgacggctctgatgtccaggtggaggtctacctgacgatcgcggcttgcccgatgaaaaccaccattgtcaccaacactgaagcagctctcaaagacatcgacggggttggccaagttcatgtcaccaccgatgtcatgagtgatgaacagcgccgtgcgctccgcgtctccctgcgcggtgaaacttctgagccagtgattccattcgctcagcctggttccactacccgcgtttacgctgttgcttccggcaaaggtggcgtaggaaaatcctccatgacggtgaacttggctgcagccctagccaagcgcgggctgtctgtgggaattttggatgccgatatttacggacactcagtgcccggaatgctcggctcggaccaacgcccacaccaggtcgatgacatgatcatgcctccccaggcgcacggcgtgaagatgatatccattgctcacttcaccgaaggaaatgctcctgtggtgtggcgtggaccaatgctgcaccgtgccatccagcaattcctcactgacgtgttctggggcgacctggatattttgctgctggatcttcctccaggaactggtgacatcgccatcaccgttgcccaattgatcccgaatgctgagttgctcattgtgaccactcctcaggctgccgcagctgaggttgccgagcgagcaggaacgatctctgtgcagaccaaccagaaggttgctggcgtgattgaaaacatgtctgccatggtgcttcctgatggcaccaccatggatgttttcggcaccggcggcggtcaaaagattgctgatcgtcttaccgctgtgacaggtgaagaggtcaaggttatcggatctgttccattggatccgaacctgcgtatcggtggcgatgtgggaaatcctattgcgatttctgaaccacactccccaaccgctgcagcgatcaatgagatcgctgaacacctagctcaccgcaaggtatcgcccaccaaatgacccagaaccacaccgcaaac

SEQ ID NO: 2562 - protein, 366 aa, Corynebacterium glutamicum
MTQVTESAVRSALSRVEDPEIGKPITELGMVKSVSIDGSDVQVEVYLTIAACPMKTTIVTNTEAALKDIDGVGQVHVTTDVMSDEQRRALRVSLRGETSEPVIPFAQPGSTTRVYAVASGKGGVGKSSMTVNLAAALAKRGLSVGILDADIYGHSVPGMLGSDQRPHQVDDMIMPPQAHGVKMISIAHFTEGNAPVVWRGPMLHRAIQQFLTDVFWGDLDILLLDLPPGTGDIAITVAQLIPNAELLIVTTPQAAAAEVAERAGTISVQTNQKVAGVIENMSAMVLPDGTTMDVFGTGGGQKIADRLTAVTGEEVKVIGSVPLDPNLRIGGDVGNPIAISEPHSPTAAAINEIAEHLAHRKVSPTK

SEQ ID NO: 2563 - DNA, 930 bp, Corynebacterium glutamicum
  CDS (101)..(907): RXA02080
cgtaaattcgaagcgagcttctaattctagcaagcttggtgatggagtatcctgccaaaatttgtcctgttgcttattgtgcaggaattcggaggcggacatgtcaatcgagtggttacaaattgttgaattaggagcgatctttggtgcaggtttcctcgcaggaagcatcaatgtaattgtcggagcaggaacattagtgtcgtttcctattctcgtgttcctgggccttccaccgttgactgccaccatcgccaacaccatcggcatcgttcctggaagtatttcgggtgtggttgcttatagacgtgaactacacgcccatgtaaaaaccatcagatttctgctgccagcatcaatcctcggagggatcaccggcgcctcgctcttgctgcatttctccgcagatgtttttacagcagtaattccctggctgattggattcggcacgctgttggttatcgcaggtccatcaattaagaagcatgttggcgctcatacttcaggtggcatctctgctgggtttaggcaattgcctttcccgagccgaaccaccttcatcgtctcagtatgtggtgccctgttgctgggcatgtatggagggtacttcagcgcagctcaaggcattcttctcatcgcattgcttggcatcacatcaacgctgcagatgcaggaactcaacgccatcaaaaacctcacagtggcggcagttaatctcatcgcagccagtgtttttataatcatctcccctgagttgatctcctggccgaccgttgccttaatcgcgcttggctcagctttaggtggatacatcggcggacggtacgcccgccgacttcgccccagtgtttttagagcatttgtggtcatcgtcggaatcaccacggtcatcgttatgacgatcggttaatgcagcagactagtaacccc

SEQ ID NO: 2564 - protein, 269 aa, Corynebacterium glutamicum
MSIEWLQIVELGAIFGAGFLAGSINVIVGAGTLVSFPILVFLGLPPLTATIANTIGIVPGSISGVVAYRRELHAHVKTIRFLLPASILGGITGASLLLHFSADVFTAVIPWLIGFGTLLVIAGPSIKKHVGAHTSGGISAGFRQLPFPSRTTFIVSVCGALLLGMYGGYFSAAQGILLIALLGITSTLQMQELNAIKNLTVAAVNLIAASVFIIISPELISWPTVALIALGSALGGYIGGRYARRLRPSVFRAFVVIVGITTVIVMTIG

SEQ ID NO: 2565 - DNA, 1752 bp, Corynebacterium glutamicum
  CDS (101)..(1729): RXA02081
cctggatgatgtcactgtcttaaatccggtatacgcagatgatttgtgggaagatccggaagctcaacataattttgcggtgccaccggtacaaaaacatatgacgttaagtggcttggagcttttagagttcgagcgtcgaacagctgcgatggaaaccaggcttggtcggcataatcggggagcgggtggcgcatttcctgaggcggtggtgtctcgaagcgtggagttgccactttttgtacaggcccggaatttcctcaacaatcagcagatcagagctcaagtgcatcgccgtattttggagcagcttccaaccgagggagagattgtgctgttggggcacagtttggggtcggtaattgctgcagaccttttgaggcgattgccgccagagcttacggtgaagggatttgtcaccatcggtagtccgttggcaaatggtcaattcaatgtggatgatttgtttaagttgctgcgcacgccgttgagcaatgtgtcgtggtgggtgaatttttggagtggatctgatcctgttgcagcaaaacgcggagtgtcggtggctgttccgtgggtattggattttcgtgtgaaaacctcactggtcccaggccctgggcattcttcgcgggaatactgtgccaatgatgcagtggcggaagcaattgggtttgggctgttcggatcgcgcagcaaagaaatcgtccttgcggagaaaaatctgcagattccgctcaatgacgcggagatttttgtgctgcaggcgctgcgttattgttacctcattttgcaacggctcaaaggcgatgaagccttaaggtatgagtacgcacttcgggagactcaggatcgcctgattgaggagattaaatccagaaacgccgaagagggccggccgattccgaaggaaatcgcacgcctggattttgataacggtgatccaaacgcagcagctcctgttccaggtttgagcccatttatgcccaaagagcaggcaattgagcggcttttagagatcattggacagaacctgctgctgccttttgagatcgaggtgccggagaaaattcagcgggaagcactgagggatttcacggcggaaactcaattgggttccaccgtgggcgctgatatttttgatgcattgcaaatggctgttggggtggtgtcgggaagcgcgaagagcaattggcgcaaatggggagcgtttggtgtgggggctgcagctttgaccgctgcaacgggtggtttggctttggcggctgtgccgactgttgctggagtagccactgttgcctcgacactcgcagcatttggtccaggtgggatgatgggcggtttggtcactgcaggaacactgctcacagttggtggcggcagtttaaccgctggggtgttgagctcggtgaacaccacggaagagatcgaagcgctcgttgtacagaagctaagtttggctattttgtggcagcgccatgagatagatagaactcatgaggtgtgggaagaattcgcggaggcagaacgtctgattgtgcgggagcacacgcgtgtgaaaaacgtgtcggatagttcttcgcccattttgaaagctttcgagcagcagcgttcgactattgagcgggcgttgaagtatttgagcgatcatgggatggaacctggctggtttgaagaactggaaccaccagccccaacaccgtttctaaaactgcgggctaagaaaactgattaggagaaacacaatggagaaag

SEQ ID NO: 2566 - protein, 543 aa, Corynebacterium glutamicum
MTLSGLELLEFERRTAAMETRLGRHNRGAGGAFPEAVVSRSVELPLFVQARNFLNNQQIRAQVHRRILEQLPTEGEIVLLGHSLGSVIAADLLRRLPPELTVKGFVTIGSPLANGQFNVDDLFKLLRTPLSNVSWWVNFWSGSDPVAAKRGVSVAVPWVLDFRVKTSLVPGPGHSSREYCANDAVAEAIGFGLFGSRSKEIVLAEKNLQIPLNDAEIFVLQALRYCYLILQRLKGDEALRYEYALRETQDRLIEEIKSRNAEEGRPIPKEIARLDFDNGDPNAAAPVPGLSPFMPKEQAIERLLEIIGQNLLLPFEIEVPEKIQREALRDFTAETQLGSTVGADIFDALQMAVGVVSGSAKSNWRKWGAFGVGAAALTAATGGLALAAVPTVAGVATVASTLAAFGPGGMMGGLVTAGTLLTVGGGSLTAGVLSSVNTTEEIEALVVQKLSLAILWQRHEIDRTHEVWEEFAEAERLIVREHTRVKNVSDSSSPILKAFEQQRSTIERALKYLSDHGMEPGWFEELEPPAPTPFLKLRAKKTD

SEQ ID NO: 2567 - DNA, 468 bp, Corynebacterium glutamicum
  CDS (101)..(445): RXA02084
cgttgatggttgggtggtgggtcacagtttagaaaaagtgacttcaaatcacgtcgaaaagaaattgaaagtacttaagaaacatgtcacgctaggagacgtgataatcattgcaagcgttgttttcctcctcgttggcgcaatgttggcgaatgctgccgctgcgctctttagtgccagcgagccattcggacgaatttcctacctcattggcctacctaacgaagacgacttcgtgccgtactcactacggttcgtggcctttttcccactgatgctctccgcatcgatggcagcatccttcttcggggtgtgggcagtactaatcattcctttcggttacttcccatcactgatgatggttcataagcacaacaagcaggtacagcgaacctgggattccgtcaccgttgctgacttctacgaggattccacccctctggtctaatttcgatttctaaatgtcat

SEQ ID NO: 2568 - protein, 115 aa, Corynebacterium glutamicum
VIIIASVVFLLVGAMLANAAAALFSASEPFGRISYLIGLPNEDDFVPYSLRFVAFFPLMLSASMAASFFGVWAVLIIPFGYFPSLMMVHKHNKQVQRTWDSVTVADFYEDSTPLV

SEQ ID NO: 2569 - DNA, 594 bp, Corynebacterium glutamicum
  CDS (101)..(571): RXA02089
ctagctgaccagtattaataccaataatagaacatattatcgaacaatgtcgcttgggtgctctacacttcccactatgatcaaacaccgaaaccgcctaatgtcttccatctactccgcaactcgctacgccgcccacttcaaaagcgtcttccccaccgccctggatgacattcaatccatgatgcgccaccctcgatcactggccagagccatacccacgtggcgcccgccgagcatcccgctaccgtcacttcccggcgaagatcccctcaccctcaccttgtcacgtcaccgcgcaggccccgccgcccgccaaatcatccgcgagttcggtgagcaacgtgaacccgcctatctcatcaccatccgcatcaccagcccagagggcttcaaagtatccacccgcctcgccgaaggctggatccgcgcaattctcagcaccgcgcacagcggcactgtccaccagctcaccgatgagccggcaccgacgttttgctggcttgtcgacgcccactttgatccggtgcgttccccttccttccttttcgaatattccaaaagtgcagcctagaaaatgacgaaaccctggat

SEQ ID NO: 2570 - protein, 157 aa, Corynebacterium glutamicum
MSSIYSATRYAAHFKSVFPTALDDIQSMMRHPRSLARAIPTWRPPSIPLPSLPGEDPLTLTLSRHRAGPAARQIIREFGEQREPAYLITIRITSPEGFKVSTRLAEGWIRAILSTAHSGTVHQLTDEPAPTFCWLVDAHFDPVRSPSFLFEYSKSAA

SEQ ID NO: 2571 - DNA, 924 bp, Corynebacterium glutamicum
  CDS (101)..(901): RXA02090
aggtgaaaggctaggcgcggattcgttgtggacgctaggcttgtcggcagtgtctttgggggacgtccccagcacaaaccagatggaaggtcatcagaacatgagcttttttgaggacatcgcggctggacttgatagtgacggtatcgagtcccgcgtaaacggcgacacaatgttcgttccgatcacctctgacttggaaatccagttcgtggagatcgattccctcctacctgcagcaaacgtttatatcgctgcagccaatgttgatgaagacgatgatgagttcgaggcagttctcgtttcggtggtgttctctgttgaggatgctgtcgctgctgtcgcaaagcatgttgctactgatcaggtggtgactgtgctgcgtgatctacttgaaggaactgatgaacgcatccaggatttggagtttttccaggatgcagtgaatgcaaatttggttcgtgcggaagtcggccagaattctgagcttcaggttttggtcgaggttgaagacggcgtcccaaccgcaacggtcaatttcatcgcgatcggtgagtcctttgaagatctgattgatcaggccattgaagaattgtgggaatccgacggcgacgcagttctatcggatgaagatcgccaacgcatgttcgctgatttgacctccgagttggaatttgtcactgatgaagtcctcgacttgggtaccttcactgattttgatcgacttttcgatatcctttccctcgccgatgaccaggctgaggattgggaagcacagctcgttccttttgaggacgaggaatttgatgagccggatgtttatgaccttttcgtcgatgactctgaagaagatgacgacgacctcgatgatgacgaggacgatgaggatgatgacgaagactagattttagcctttgtcgcggt

SEQ ID NO: 2572 - protein, 267 aa, Corynebacterium glutamicum
MSFFEDIAAGLDSDGIESRVNGDTMFVPITSDLEIQFVEIDSLLPAANVYIAAANVDEDDDEFEAVLVSVVFSVEDAVAAVAKHVATDQVVTVLRDLLEGTDERIQDLEFFQDAVNANLVRAEVGQNSELQVLVEVEDGVPTATVNFIAIGESFEDLIDQAIEELWESDGDAVLSDEDRQRMFADLTSELEFVTDEVLDLGTFTDFDRLFDILSLADDQAEDWEAQLVPFEDEEFDEPDVYDLFVDDSEEDDDDLDDDEDDEDDDED

SEQ ID NO: 2573 - DNA, 774 bp, Corynebacterium glutamicum
  CDS (101)..(751): RXA02091
agatctagccaacgaacttgatttcatcgagccggaagagacagaagaagagcagcaattgaagtggcttagccttatgcagttttttggaagtagataaatgagcatctggaaacgtctgttagtgcagtacccgcgcttcgccgacaccctcacagccggccaacccatcacgctcgaggaattagcaaccccggaagtgatcttggaagctgttgccaaaggccaagaaattttcggcattgagcagccaaaacatgcagcacaactctggtttcactccctgtgcaccgcaattgtcggccccgccgtcaccgccatggtggaattcgatgtcatccccagcctcgacatacgtcgaggtcagctgcataacatcgacggttactggttcggcttcaggccggaggagatgcttgtcgacgcctccctccacctgtcgggcacccaattcggcgagagtatccgcgtggtgattgatgcattatgcgctgccacggatctgcgaccggcacccctgtgggcggttgcctcagatgcgttgggaatcgcagctagcggcgcaggtgtcgaggcctttgaagaagaacatgcccgcgaggtggcggaagccctcattgaaggaatgaatagtgtgaactcagttccatcgccgcggtttaacgacgacgattatttcattcgagctggatgctgcatgattttccactcaccacgagctgatttttgcacgtcgtgcccacagaagaggtgaaaggctaggcgcggattcgt

SEQ ID NO: 2574 - protein, 217 aa, Corynebacterium glutamicum
MSIWKRLLVQYPRFADTLTAGQPITLEELATPEVILEAVAKGQEIFGIEQPKHAAQLWFHSLCTAIVGPAVTAMVEFDVIPSLDIRRGQLHNIDGYWFGFRPEEMLVDASLHLSGTQFGESIRVVIDALCAATDLRPAPLWAVASDALGIAASGAGVEAFEEEHAREVAEALIEGMNSVNSVPSPRFNDDDYFIRAGCCMIFHSPRADFCTSCPQKR

SEQ ID NO: 2575 - DNA, 3495 bp, Corynebacterium glutamicum
  CDS (101)..(3472): RXA02097
ttggctacagatgtttcagcgcttgcagtggggtagtgtgtttaaacatcacaattagttctagaggaaaacgcattttttgcgcggggagagtgtatacatgccggctggcatcgcagacatgacagattcattgctcggatgggcatcacaaactgagctggatctgaaccagcgtcttgcaggggtagagtactttccacaaattcagctgcgacacgatgagctcgagcgcattcatcggttttacggcacctttttgtcccgccaggtaggcgcgggcgcaagccttggggatctttttgaaatgaccccatgcctgacagtcaccaccttggtgtctcgggcgtcacggatcagcgatccagcagatttcttcggtgaatacatcggaggactgggacttagcgcagaacacgcagcagttgttgaagggttgaccgaaaagctcttcgcacaggctggcctgctcgttcctgagggaattgcatctccattggagttgttatccatccacgcaggcattagtaaccacgaagtggccgcagtgctgaccgaagtggaaaacggcaccaccgaatatccattcatgttcgacgctgtcctgcgcctaacccctgagtgggcacagacccttatcggcggagttcaagaactcattgaatttgccaccacccaccgaacttcttggtcagaccgccagcgcgaatcctcactgccagccatgatcgatgagatcgttgtggcggaacttcgggaacgcccagttggtactgccgaccgtgaaaactccgttggtgtggcacttcgtgagcttcgcccacgcctcatcctggatgcagaacgccgcaaagtctgcctgcgtctacctgaacagcgcgtcagcgacgatgaaatcaactggcgagtcagcctagaaggcaccacccggattttctccacccgccgagcatggggcgatacttctggatactccgaagccctcgacatcactgtcgagcgtcaaatccgcgaaaccaccgtcaccgacacctcaaaccaaatcacctgggttgtcccagtcgtggacttcaacgacccagtgctggtgttttccgcgcgcggtgaaaacctcaccgacaaggtctccctgcaccatcaagagatttacgttctcgcgccagcggaagcaaaactcgaagacatggtcactggccagccagtaccagttattgagcaattcctcgtagagggctggaactcatgggtgtgctcccgcgtggacgcccgtggcctgtcctctctgaaggtcaacaaagaagtccgatgcattgacccacgtcgacgcgttgccttccaccacccagccgaattggtccctcacgtacgatccatttccggactccccgtacacgcgcagtccctgatcgccgagttcccaccaaccctgagcggacaagacgaaacctggatgctctccatctcggctttcgcaggtgtaggcgctgctggtgaagaaatcgccgagccagagcctttggaagtccctgccgacggtggccttttcgccatcttcgacccagaaatatacgacgccccatgggtgggtgaatacctggtccgactccgcggcccacgcaatgaatccttccgacccgaattcgccatcgtcgaagacatgaccaccgaattcgaagtcgcctcaggtgcatcatttcgaatcccaaccaccactggtctcagcgaagccagcctacgcgtgcgttccggtgaaaagcacttcaccgcagagccacgcctggtcaccgttgaagcaaccgaccccaacgcatcattcgtggtcaccaccgatgaaggcgatcaaatgccattgcgatttgtgccaccacaaatcgccatcgaacttccactgaccaccgagccaccaacctggcgcgtcacccgtactgtctgtggaccacgcgacctcgacggtgcaggcgaactccgcatccgcaccggtgtcgatgtcggcgatccaaaggtcagtgtgcgcaaccaccacggttcaccactgcgaaccgtgaaaatggtcacccctgacaacggccgtacctggattgccagcatgaaggaaatcgcagccagtacctttgtgatgccacgcggatccatcgaatttgagtggactgaccgcaaggttgaccgtcgcgtttccgtgacgattgctgtcattgacaaaactgagaactttactggcatcaccatcgaagatggaaagctcgtattcgaagaactcgcagccggtcgccaactcgctgcatgggtgtggccacaaaccgcaccgtgggtaagcgcagtggaacttgctgtcaccggaccagagctggaactccctgaagttctcgtcggcgcaggcaacctgattgttcaactccacaccgctgacccattcactacctccgtgaccccactgtcaccaggaaaagctgcggtcaccgttgagcaagaaggctactactcagcacaaaccgaagaatatgcacagctttcagcattcttcggtggggaagtagaagaaccaccaatcagtgacgctgtggtccccgcactttgggatgtttcccatatctggaccgaacagggaaacaccgagcatcttccagtagtccatgccgccctgcgctcctcaccagccgcagcactgaagggtctgtccgcttcgctggttcccgcacaggcactacctggaaaagtcatttcctccggactggcagcctcaccgttcaccacggaatcaccagcaacagaagtgcaccgcaccgcatggatcggaaccctgcaactcctgggtgcactgccaagcgcattcaaggaagccgaagagcttggcaaccgcacaccactgctgccaatcctcggacaacttgaggaagtcgccggcaagaacatcctgtccacccttgcaactggccgtgactccactttggacaccgcatgcatcgaccaatccaccgttgcgattgccggcatgaacgaaacccagcaaaaagccctgctggacatgttcttcagcaacgccgacatcgttcctggaccactaatggaagacaacacccgcctcatggcagtgttcgaaaccttcaagaagcgcgatgcactccgtgaggttctccagactgaaggcttgattaagaccgctgtagaacttcttcgtgccatgcgtggaacccagcgtcagctgtattcctccgcacgtattcgattcgacaagctcgatggtgtcaacactgacaacccagaaaacatgtgggcactcaccccagttgtgtcactggtgttcgcgttgtcatcccgtttgcatgcacacgaattgatcggcaagacccgaactctcgatcgtgcatctgccggttggggtcgaatcgctgatctggtgccagaccttgtcaccggtgacttgatctccgcggaggcaatggttttgggagctcgaaacccaggactcgtcgattagtccctgatttcatcggaggg

SEQ ID NO: 2576 - protein, 1124 aa, Corynebacterium glutamicum
MPAGIADMTDSLLGWASQTELDLNQRLAGVEYFPQIQLRHDELERIHRFYGTFLSRQVGAGASLGDLFEMTPCLTVTTLVSRASRISDPADFFGEYIGGLGLSAEHAAVVEGLTEKLFAQAGLLVPEGIASPLELLSIHAGISNHEVAAVLTEVENGTTEYPFMFDAVLRLTPEWAQTLIGGVQELIEFATTHRTSWSDRQRESSLPAMIDEIVVAELRERPVGTADRENSVGVALRELRPRLILDAERRKVCLRLPEQRVSDDEINWRVSLEGTTRIFSTRRAWGDTSGYSEALDITVERQIRETTVTDTSNQITWVVPVVDFNDPVLVFSARGENLTDKVSLHHQEIYVLAPAEAKLEDMVTGQPVPVIEQFLVEGWNSWVCSRVDARGLSSLKVNKEVRCIDPRRRVAFHHPAELVPHVRSISGLPVHAQSLIAEFPPTLSGQDETWMLSISAFAGVGAAGEEIAEPEPLEVPADGGLFAIFDPEIYDAPWVGEYLVRLRGPRNESFRPEFAIVEDMTTEFEVASGASFRIPTTTGLSEASLRVRSGEKHFTAEPRLVTVEATDPNASFVVTTDEGDQMPLRFVPPQIAIELPLTTEPPTWRVTRTVCGPRDLDGAGELRIRTGVDVGDPKVSVRNHHGSPLRTVKMVTPDNGRTWIASMKEIAASTFVMPRGSIEFEWTDRKVDRRVSVTIAVIDKTENFTGITIEDGKLVFEELAAGRQLAAWVWPQTAPWVSAVELAVTGPELELPEVLVGAGNLIVQLHTADPFTTSVTPLSPGKAAVTVEQEGYYSAQTEEYAQLSAFFGGEVEEPPISDAVVPALWDVSHIWTEQGNTEHLPVVHAALRSSPAAALKGLSASLVPAQALPGKVISSGLAASPFTTESPATEVHRTAWIGTLQLLGALPSAFKEAEELGNRTPLLPILGQLEEVAGKNILSTLATGRDSTLDTACIDQSTVAIAGMNETQQKALLDMFFSNADIVPGPLMEDNTRLMAVFETFKKRDALREVLQTEGLIKTAVELLRAMRGTQRQLYSSARIRFDKLDGVNTDNPENMWALTPVVSLVFALSSRLHAHELIGKTRTLDRASAGWGRIADLVPDLVTGDLISAEAMVLGARNPGLVD

SEQ ID NO: 2577 - DNA, 1281 bp, Corynebacterium glutamicum
  CDS (101)..(1258): RXA02102
cggtaaaacgtcccgctagtgcgatggaatctgtgtcggggactaaaacatcaaactgaatcttcggcataacaccacagtagacaatagccttggtgttatgactagcccccattctttttctgtcacccccattcgcaccatggctgacggcacgatcaaacagattcaccctttcacaggcaccgaagtgtggacggtccctgggcgtggaaatcgacctctgtcacatcccgcttctacgatcgtcgaactatctgcacacgatcacacctcttactgtgcattttgttccgacaatatgctctccactccgcctgagaaatcgcgcatcatcattgatagctccggcgactttgacatccttcccggagcattgcctggtgagctttcagaaaccactccggaatttcgacgagtccccaatctgtttgagattgtctcttttgactactggcaccagaattttggtttcgatatggattcagaaaccgccatgcgcatggcgcaatacttggcgattccagaaggtcgcgaacatgttttagccattgtgcgcacccgactttctgccgctggtgaagatcccgcgcacatgaccgatggcgagttgttagaaaaagctcccagctactttgctggtggtcatgacgtcatcatcggacgccgacactttgtcgatgacgcaaccaccagtgatcaattggcctcatctggaacactgaccgttaaagagcatgaggcgttcatccgcctgactgtcgatggcatcagggatttgtaccaccgcaaccgttacgcaccgtatgtagtggcgtttcaaaactggttgaaacccgccggcgcgtcttttgaccatcttcataaacagctcgtcgccattgatgaacgcggccgacttattgccgatgaactgcatcatctacgtggcaatcccaatatgtacaacgaacttgctgttgattacgccggataccacaacctgatcatcgcggaaaacgatcacgccgtggccttcgcaggtttcggtcaccgctaccccaccattgagatttactctaagtccgctattcctgaaccctggcttcaaagcgacgaggaaatccaagcgatgagcaacctcatccatgcatgccatgctgcaaccggcgcagatgtaccctgcaatgagggatgggtacacaaaccaatcgatgttgatatgccaatgccctggcatgtgatgatcaaatggcgtgtttctaccctggcaggtttttgaaggtggcaccaaggtgtatc

SEQ ID NO: 2578 - protein, 386 aa, Corynebacterium glutamicum
MTSPHSFSVTPIRTMADGTIKQIHPFTGTEVWTVPGRGNRPLSHPASTIVELSAHDHTSYCAFCSDNMLSTPPEKSRIIIDSSGDFDILPGALPGELSETTPEFRRVPNLFEIVSFDYWHQNFGFDMDSETAMRMAQYLAIPEGREHVLAIVRTRLSAAGEDPAHMTDGELLEKAPSYFAGGHDVIIGRRHFVDDATTSDQLASSGTLTVKEHEAFIRLTVDGIRDLYHRNRYAPYVVAFQNWLKPAGASFDHLHKQLVAIDERGRLIADELHHLRGNPNMYNELAVDYAGYHNLIIAENDHAVAFAGFGHRYPTIEIYSKSAIPEPWLQSDEEIQAMSNLIHACHAATGADVPCNEGWVHKPIDVDMPMPWHVMIKWRVSTLAGF

SEQ ID NO: 2579 - DNA, 519 bp, Corynebacterium glutamicum
  CDS (101)..(496): RXA02103
gaatctgtttgatcgtgccgtcagccatggtgcgaatgggggtgacagaaaaagaatgggggctagtcataacaccaaggctattgtctactgtggtgttatgccgaagattcagtttgatgttttagtccccgacacagattccatcgcactagcgggacgttttaccgtagtcgccaaccttttgatcgaaaaaggcctcatggatcatggcgttgttgtccatgatccagcagcgaaaatcgcagaagctgtggaagagcagcttcgccagacttaccgcgacgagcatgaagatgcagacttggaagaatcctcggtcaaccgttacctcattgaagttgatggagttaaaggctccgttaaccaagtgaccatgatttttgcccgtttgctcaccccgccagcagagttgccaaaggacgctttcctcctggagcaggaacttgcctatgaagttcctgcagtctacccatggactgtggagatccttcgctagttttgagctacgtattcttg

SEQ ID NO: 2580 - protein, 132 aa, Corynebacterium glutamicum
MPKIQFDVLVPDTDSIALAGRFTVVANLLIEKGLMDHGVVVHDPAAKIAEAVEEQLRQTYRDEHEDADLEESSVNRYLIEVDGVKGSVNQVTMIFARLLTPPAELPKDAFLLEQELAYEVPAVYPWTVEILR

SEQ ID NO: 2581 - DNA, 1044 bp, Corynebacterium glutamicum
  CDS (101)..(1021): RXA02109
gactctaagggaagtgtttcgcttcaacccgtacaggtctaatatgtcgggagtcttgttttaagctcttatataacctgtataggaaagcgaaaacctcatgcttgcagtgctattcggggtggtggccggtgccatcatgcctttccaaacttcggtgaataatagattgcgtcagtccgtgggagcaccactgctggcgtcttttatttcctttttggtaggaactttttcactcctggttgcaacgtggatcaccagtgggcacccgtatcctgctctaggaaatacaactggccaaccgtggtggattttcaccggtggcatgttgggtgttgtgctgctgacgggaaacattttgctgtttccccgagtcggcagcgtgcagaccgttattttgcccatctccggacagatcatcatgggcctaattatcgatacaactggcctggcacattcgcctcaagcaccgttaaccctgttcagagtattgggtgctgctgcggtacttgttggatcgctggccgcagtgggagtgttctctaagaaaaacatcggacagacccaatcccaaggtgcctccatttggttgtggcgcctcttcggagtggtgatgggcatgtgccaagcaacccaggttgcagtcaatggttacttgggaactgtcctaggatcccccattgagtcagcactggtgtctttcgctgttggcaccaccgcgctgtttattctgctgttggtcacccgaaccaagtggcgtggaatcaacggcgctgggaagaaaaacccatggtggatgtggatcggtggcgtcatcggcgcgactgttattttcagtactgcttacctgggaccgatcattggcactggtgttaccgtggtggttatgttgctgggcatgatgttggccagcctgatgatcgacgcttttggaatccttggcagcccgcgccgccacattcacatcgcgcagcttctcgggctcgtggtgatcatcctcggcgtaacaatgatcagaatctaaaccaagaatctaaaccaaga

SEQ ID NO: 2582 - protein, 307 aa, Corynebacterium glutamicum
MLAVLFGVVAGAIMPFQTSVNNRLRQSVGAPLLASFISFLVGTFSLLVATWITSGHPYPALGNTTGQPWWIFTGGMLGVVLLTGNILLFPRVGSVQTVILPISGQIIMGLIIDTTGLAHSPQAPLTLFRVLGAAAVLVGSLAAVGVFSKKNIGQTQSQGASIWLWRLFGVVMGMCQATQVAVNGYLGTVLGSPIESALVSFAVGTTALFILLLVTRTKWRGINGAGKKNPWWMWIGGVIGATVIFSTAYLGPIIGTGVTVVVMLLGMMLASLMIDAFGILGSPRRHIHIAQLLGLVVIILGVTMIRI

SEQ ID NO: 2583 - DNA, 597 bp, Corynebacterium glutamicum
  CDS (101)..(574): RXA02117
tgaacacaaactaccacgtttattgcatcatgcaacacccttgctaggatataaaatactctatgagtccagacgtttttaaagggagcgaattaccatagtgtctacagatccagaagagttcgaccaagctgaaaccctcgatcaactcgcgtatgagatcatcctgctcacccggtatggtgtccaaaacacaccgaccaacaagcgcgaagccatcatggatcgcagcgccctcatcttgctcacccgccttgacgctcaaggacctatgacagttaatgagctagctgaaagctttggacttaacgtttctaccgtgcaccgccaactcaaagcagccattgccaatggcttaattgaagtcgtcgatgatcaagcatgccccgctaaacttcatcgtccaactgagttgggtaaagaaaaactgcagcaggagcttcttgcccgccagcaggatctcacccgcattcttcatgattgggatgaggaagacattaaaacgcatgccaagctattgcggaagcacaatgaaagcttggaagaatacctcgatatgaagtggccccgcccctaagtgcccataaacgcacctct

SEQ ID NO: 2584 - protein, 158 aa, Corynebacterium glutamicum
VSTDPEEFDQAETLDQLAYEIILLTRYGVQNTPTNKREAIMDRSALILLTRLDAQGPMTVNELAESFGLNVSTVHRQLKAAIANGLIEVVDDQACPAKLHRPTELGKEKLQQELLARQQDLTRILHDWDEEDIKTHAKLLRKHNESLEEYLDMKWPRP

SEQ ID NO: 2585 - DNA, 1494 bp, Corynebacterium glutamicum
  CDS (101)..(1471): RXA02123
ggattgagtcttttcggcagctgcgtgtgaacccggcttcatgacatgcagcatacctgtgcgaaaaattcctgaccgcccacttaaaaaaaggtctagggtgtggggtgtgagtcttccaccaaatgtacaaactgtcggtgagctgaaggccgccggccacatctaccgacctttgcgcgtagaaatccgcgacaacctcctagccaaacttcgcagcggcgaagatccgtggccaggcctgcacggcctgaactacacggtcatccggcagcttgaacgcgcgctcatcgccggccacgacatcgtgctgctcggcgaacgcggccagggtaaaacccgcctgctccgcacgttaataacgcttctcgacgagtggtccccgatcattcccgggcgcgacgttccagaacaccctcttgcgccaaacgtagagatctccgatgatcagcccattgaatgggtacaccgcgatgcgcgctataccgagaaacttgccaccccagatacttccgtggctgatcttatcggtgatgttgacccaatgcgtgttgctgaaggccgcagcctcggtgatctagaaaccattcactacggtctgattcctcgcgccaaccgtggcatcgtggcgatcaacgagcttcctgacctcgctgaacgcatccaggttgccatgctcaacgtcatggaggaacgtgatgtgcagattcgtggctacaacattcgtttggacttggatgtgctggttgttgcctcagccaaccctgaggattacaccaaccgtggccgaattatcactccgctcaaagaccgcttcggtgcagaaatccgcacccactacccacttgagttggacgatgaagtggcaattatccgccaggaagcagagcttgttgcgcaagtccctgatatcttggttgaaattcttgcccgctacacccgagcgcttcgtgaatcctcatcggtgaatcagcgttctggtgtgtctgctcgtttctccattgcaggtgcagaaactgtggccgcagcagctcttcgacgcgcagcagtgttcggcgaagatgaggccgttgcccgcctggttgatttggaagcagccgtggaagtcctcggcggcaagattgaatttgaatccggcgaagaaggacgcgaatgggaaatccttgattatctcctgcgcaccgcaaccgcagaagcgctgcgttccactctgcgctcgctggatctcaccccgctcatcgcagcattagacggcagcatcaccgtttccactggcacgaacatcaccgcgtcagaatttttggcttcgctccccgaactcggcgaaagcacgctatatgacgacatcgctcaagcttttggtgccaccacaccaagtactcgcgcgatggccattgagcttgctttggaaggtctttacctttcccgaaaaattgccaaggattctggcgaaggtgaaaccatttacggttaactggttttaaggagcaccac

SEQ ID NO: 2586 - protein, 457 aa, Corynebacterium glutamicum
VWGVSLPPNVQTVGELKAAGHIYRPLRVEIRDNLLAKLRSGEDPWPGLHGLNYTVIRQLERALIAGHDIVLLGERGQGKTRLLRTLITLLDEWSPIIPGRDVPEHPLAPNVEISDDQPIEWVHRDARYTEKLATPDTSVADLIGDVDPMRVAEGRSLGDLETIHYGLIPRANRGIVAINELPDLAERIQVAMLNVMEERDVQIRGYNIRLDLDVLVVASANPEDYTNRGRIITPLKDRFGAEIRTHYPLELDDEVAIIRQEAELVAQVPDILVEILARYTRALRESSSVNQRSGVSARFSIAGAETVAAAALRRAAVFGEDEAVARLVDLEAAVEVLGGKIEFESGEEGREWEILDYLLRTATAEALRSTLRSLDLTPLIAALDGSITVSTGTNITASEFLASLPELGESTLYDDIAQAFGATTPSTRAMAIELALEGLYLSRKIAKDSGEGETIYG

SEQ ID NO: 2587 - DNA, 2079 bp, Corynebacterium glutamicum
  CDS (101)..(2056): RXA02124
gcttgctttggaaggtctttacctttcccgaaaaattgccaaggattctggcgaaggtgaaaccatttacggttaactggttttaaggagcaccacagccatggccacttcacattcacgaccccgccgcagccgttacggacgctacaccggaggcccagatccgctggcacctccagtggatctcagcgatgccctgcgcgatattgctgatgatgtcatggctggttattcccctgagcaggcactacgtgaatacctgcgcagaggcgcccgaggacaggaaggcctcgatgatctagcctggcgtgcagccgaacgccgccgagaattacttagccgaaacaacctcggtggcacactcgctgaggttcgcaagcttctcgatgaaggcctcaagctggaacgcgctcaactggcccgcgatatcgatatggatgacaccgatcgagcattccgcgaaatgcagatcagcaacctccctgaatccaccgccgctgccgtttccgagctaaattcctacgattggcaatcccaagaagcacgccaaaagtttgaacaaatccgtgacctgcttggccgtgaaatgttagatcagcaattctccggcatgaaacaagccatggaaggtgcctccgacgaggacaaagcagccatcgccgaaatgctgcgcgatctcaacgacctgctctccaaacaccgcgagggaacggacactcccaccgatttcgccaattttatggccaaacacggcgagcacttccccgagcagccgcgcgacatcaatgagctcatcgatgccctcgcagcccgttccgccgcagccagtcgcatgttcaactccatatcagaggaacaacgccgcgaactcatgaaactatctgcccaagctttcggatccccagagctgcaggaattgctcggtgacctggctggaaacctccaaggtctgcgccccgacctcaactgggatggctccgaacaattctccggcgacgaaggcatgggacttggtgatggcaccggcgccatgcaggacctcgccgaactcgacaaccttgctgaacaactgagcaactcccacaccgacctcgacattgatgcgattcgccgccaactcggcgatgacgccgctgtctctgccgaaactttggccaaactggagcgcgcgctccgcgacagcggccttcttcgccgcaaccccgatggctcattgaagctcagcccccaggccatgcgccgtctagggaaagcgcttctcgacgccgccagcgaacaattatcgtcccgcccaggctcgcgagactcccggttggcaggagcaaacggtgaagcgacgggagcatcccgaccttatgttttcggagacacccaaccatgggatgtcacccgcaccatcaccaatgctctgcagcgaacagccggaacagatacggaaggtccgctgcgcatcaacttagatgatgtggaagtcattgaaactgaagcccgcaccctcaacgccgtggcactgctagtagacaccagttattccatggctgccgaaggccgctgggtgcccatgaagcaaacagcgcttgccctccaccacctggtatccacccggtttagaggagatgaactagcactaatcacttttggtcgacatgcccaaaacatggacatcgaggaactgactgcactgccaccggttcacgaacaaggaactaatctccaccacgcattactgctggcagaacggttctttgctcgccatccctccatgaaagcaagcctgctcattgtcacagatggcgaacccacagctcacctcgaagccgatggacacgcctggttcaactggcccactgacccagaaaccatgttcaagaccgtcacccaactagataaagtaaccaagcgaggaacccacaccacactcttccgactgggacatgatcaaggattagagcactttctcaaccaactagccgaccgtgttggcggcaccgtggtggctcccgatctggacggactcggcgccgcagtcgtgggcgagtatttacgacaccgctactgagcattggacgttttcgcctt

SEQ ID NO: 2588 - protein, 652 aa, Corynebacterium glutamicum
MATSHSRPRRSRYGRYTGGPDPLAPPVDLSDALRDIADDVMAGYSPEQALREYLRRGARGQEGLDDLAWRAAERRRELLSRNNLGGTLAEVRKLLDEGLKLERAQLARDIDMDDTDRAFREMQISNLPESTAAAVSELNSYDWQSQEARQKFEQIRDLLGREMLDQQFSGMKQAMEGASDEDKAAIAEMLRDLNDLLSKHREGTDTPTDFANFMAKHGEHFPEQPRDINELIDALAARSAAASRMFNSISEEQRRELMKLSAQAFGSPELQELLGDLAGNLQGLRPDLNWDGSEQFSGDEGMGLGDGTGAMQDLAELDNLAEQLSNSHTDLDIDAIRRQLGDDAAVSAETLAKLERALRDSGLLRRNPDGSLKLSPQAMRRLGKALLDAASEQLSSRPGSRDSRLAGANGEATGASRPYVFGDTQPWDVTRTITNALQRTAGTDTEGPLRINLDDVEVIETEARTLNAVALLVDTSYSMAAEGRWVPMKQTALALHHLVSTRFRGDELALITFGRHAQNMDIEELTALPPVHEQGTNLHHALLLAERFFARHPSMKASLLIVTDGEPTAHLEADGHAWFNWPTDPETMFKTVTQLDKVTKRGTHTTLFRLGHDQGLEHFLNQLADRVGGTVVAPDLDGLGAAVVGEYLRHRY

SEQ ID NO: 2589 - DNA, 924 bp, Corynebacterium glutamicum
  CDS (101)..(901): RXA02125
gacctaaaattcatcacctcaccgtttttaaggcttagaaaaatagcagtgttgggatgtgaatatccatttatgctgctgtagtcggctatgtggacgcatggtggcaacctctcagtttatcgatgacagcgaggctgcccaggcggtacgcgcagctattgttgcaggataccgaaacattgatactgccctagcgtatggaaacgagcgcggcgttggcgaaggcattcgcaccgctggagtgccccgcgaggagctctttatttccaccaagctagctgcagaaatcaaagattacgatggagcagtcgccgcgattgatgagtctttggcgaaaattggcttggattatgtcgatctgatgctcattcactccccacaaccatggagtgatttccgtggtggggactattcagagggaaaccgtgaagcgtggcgcgcgctggaagatgcctacaaagccggaaagattcgatccattggtgtctcgaacttcctggaggccgatctggagaatatcttagactccgcgacggttgctcctcacgttaatcagcttcttgtgcatgttggaaacaccccaagcgagttaatcagtttctgcgattccaagggcattctggtcgaagcatattcacccatcgcccacggagagatgctgaagaaccagcaggtcaaggcgattgctgacaagtacaacgtgagcattccgcagctatgcattcggtacacaattcaactgggaacggtgtctttgccaaagactgccaacccagatcatatgagctccaatgcgcagatcgactttgaaatttccgaggaagacatggcggcacttcaagaagtgaccgcccgcgattatggcgagcacagcggttttcctgtgtattccggcaagtagaaagatttttatcatgggac

SEQ ID NO: 2590 - protein, 267 aa, Corynebacterium glutamicum
MVATSQFIDDSEAAQAVRAAIVAGYRNIDTALAYGNERGVGEGIRTAGVPREELFISTKLAAEIKDYDGAVAAIDESLAKIGLDYVDLMLIHSPQPWSDFRGGDYSEGNREAWRALEDAYKAGKIRSIGVSNFLEADLENILDSATVAPHVNQLLVHVGNTPSELISFCDSKGILVEAYSPIAHGEMLKNQQVKAIADKYNVSIPQLCIRYTIQLGTVSLPKTANPDHMSSNAQIDFEISEEDMAALQEVTARDYGEHSGFPVYSGK

SEQ ID NO: 2591 - DNA, 357 bp, Corynebacterium glutamicum
  CDS (101)..(334): RXA02129
tgttctgccgatccagcaccagctctggtggcaggagctgagagttttgccaattaacttggcgaacagacttgttggaaatgaatttgtcaagaatggcatgaagatcatcttcaaaatggctagtaacaagttcatcgacaacaaaaaggggctggctatgctagtttttgccgaacttgtgatggaaatgcttgatcagcctgaagaacaacttcataatgtgcgtggagtggctattgagaagcgggagttcctcaaagctctcaccgctgatttcaccagcagacttaaacaagctcaaaccgataagattcttgtttgggatttcgcatgactattatgtgggcgacccgt

SEQ ID NO: 2592 - protein, 78 aa, Corynebacterium glutamicum
MKIIFKMASNKFIDNKKGLAMLVFAELVMEMLDQPEEQLHNVRGVAIEKREFLKALTADFTSRLKQAQTDKILVWDFA

SEQ ID NO: 2593 - DNA, 739 bp, Corynebacterium glutamicum
  CDS (101)..(739): RXA02132
gcagcccaccgccagcgattcctcgccgaacaaggctacgcataccgcatcctcgacgccgacgacatcctcttcccactacccaagaaagagctataacgtgcacaacttctccttcgacgtggacgaatcctacgccaagaagaacaacgaaatcctccgcgacgcaaagcgactccagatctcagcactgtgccttggactcatcctcggcggcggagccgtagccgtctacctgttttctaacggagcagtgtggatgtggatgatcgccatcgtcatggtcttcctcgccctgttgagcttcatcatgattcctgtgatcccccgccaaatgggcaacgcacaaacgctctacgatgactacgaactagcccccgccatcatcgcagaagtaaacccccgcgatgtggtcctcctggcactcgtcaaccgcaatgtgaaccccgaagccaaaccagagtgggcattggccacccgcacgatcgttcgcgtcggagcacacgaacgtcgcctcggcgaacgtatcccatccgtcgcaatcaccggccgacgcaccgtcaaagaccaagaccactgggatgaaatcagccccatgccaattacctggggcaccacggacaaagacatcatccgtgaagccgagaaaactatcccccacgaactctgggccaaactagaaaagaaccgcggcaagttggaggacgttaaaaagacccccaacaacctgttcaaacta

SEQ ID NO: 2594 - protein, 213 aa, Corynebacterium glutamicum
VHNFSFDVDESYAKKNNEILRDAKRLQISALCLGLILGGGAVAVYLFSNGAVWMWMIAIVMVFLALLSFIMIPVIPRQMGNAQTLYDDYELAPAIIAEVNPRDVVLLALVNRNVNPEAKPEWALATRTIVRVGAHERRLGERIPSVAITGRRTVKDQDHWDEISPMPITWGTTDKDIIREAEKTIPHELWAKLEKNRGKLEDVKKTPNNLFKL

SEQ ID NO: 2595 - DNA, 921 bp, Corynebacterium glutamicum
  CDS (101)..(898): RXA02137
gcctactcaccgtccacagatgagtaaacccggaaaaacccgtatttagttattggttttacctgcgtgggctgaaagtcttcacttttaatccttacagatggtcgttctgattcctttcaacgatgaagtgtgcacccctattcccgatttgggaggttttccttgtagcctattgagtgtgaaacttccttgggataaaaataagaacaacgaaggggctgacgctgcaggccaagacgccagctccacccctgagaccgctacgcctgacgctactgagcagaaattgccaaaggggcacacggcaccgaagggccgtcccactccgaagcgtcgtgaagttgagttagagcgaggtgtcgttggcggccagtctttggcgcctactgatacttatgcgcagcagcgccagaagcgtaaagaatttaaagcttctatgaccaaggaagaattcaaggcatacaagcagaaagagcgcgatgcccgagttaagcgtcagcgcgaaacccaagctgcaatggatcgcggcgaagatgcttatttgatggatcgcgataagggcgaggttcgccgttttgcgcgtgactgggtggattcccgcaggttcttgtctaactttgtgatgccagtagctattgctttgctggttgtcatgctgatcggtaacttcaacccatcattcgctgcgacttcttccatggttgccatggttttgatgttgggcttcctgattgagggcatcaccactggtcgtcgtgtgaacaaggctgctcgcacgaggttccctggtaccaccgagactggttttggtctgggttactacgcgtattcccgcaccattcagcctcgtaagtggcgtacccctcgtgcacgcgttgaaattggtgctgaagtctagcgcatgcgcacgttagttct

SEQ ID NO: 2596 - protein, 266 aa, Corynebacterium glutamicum
MVVLIPFNDEVCTPIPDLGGFPCSLLSVKLPWDKNKNNEGADAAGQDASSTPETATPDATEQKLPKGHTAPKGRPTPKRREVELERGVVGGQSLAPTDTYAQQRQKRKEFKASMTKEEFKAYKQKERDARVKRQRETQAAMDRGEDAYLMDRDKGEVRRFARDWVDSRRFLSNFVMPVAIALLVVMLIGNFNPSFAATSSMVAMVLMLGFLIEGITTGRRVNKAARTRFPGTTETGFGLGYYAYSRTIQPRKWRTPRARVEIGAEV

SEQ ID NO: 2597 - DNA, 531 bp, Corynebacterium glutamicum
  CDS (101)..(508): RXA02141
gcccattcgtttccgatcgcaccgcaacccgcgacggcgaaaacactcagagcaacgcttaagaaggagtggcgaaaaaatgaagtcttcagcaaaactcatgtacggcccgaccgtattcatggccgcaatggctgtcatctacatcttcgcaacaatgcacgttagtgatggcggcagcgttaaaggtgttgagtgggtcggttctgtggccctggtcctgtcagcaggtctgacgcttatgctcggtgtctaccttcacttcactgaagtccgcgtagatgttcttccagaggactgggaagaggctgaggttgccgacaaggcaggaaccctcgggttcttcagcccaagctccatttggccggcagctatgtccggtgcggttggattccttgcattcggcgttgtgtacttccactactggatgatcgcagttggtctgatgctcctgatcttcacgatcaccaagctcaaccttcagtacggcgtgccaaaagaaaagcactagtactaaaaccacatatgctc

SEQ ID NO: 2598 - protein, 136 aa, Corynebacterium glutamicum
MYGPTVFMAAMAVIYIFATMHVSDGGSVKGVEWVGSVALVLSAGLTLMLGVYLHFTEVRVDVLPEDWEEAEVADKAGTLGFFSPSSIWPAAMSGAVGFLAFGVVYFHYWMIAVGLMLLIFTITKLNLQYGVPKEKH

SEQ ID NO: 2599 - DNA, 750 bp, Corynebacterium glutamicum
  CDS (101)..(727): RXA02146
ggttctctcgcagagagagaaggagtggggataggggccttccgctccgaacccgacagctaactcggtcagcaaacaggaagaatttggagtttcatcagtgggtaagcaccgtcgcaacaattcaaacgcaactcgcaaggctgtagcagcatctgcagttgcgcttggagcaaccgcagctatcgcctccccagcacaggcagctgaggttgttgttcctggcaccggaatcagcgttgacatcgctggcatcgagaccactccaggtcttaacaacgttccaggaatcgatcagtggatcccttcccttagcagccaggcagctcctactgcttacgcagccgtcattgatgcacctgcagcacaggctgcacctgcagcaagcaccggtcaggcaatcgttgatgcagcgcgcaccaagattggttccccatacggttggggtgctaccggtcctaacgctttcgactgctccggccttacctcatgggcatacagccaggttggcaagtccatcccacgtacctcccaggctcaggctgcacagggcacccctgttgcttactctgaccttcaggctggcgacatcgttgcgttctactccggcgctacccacgttggtatctactccggccacggcaccgttatccacgcactgaacagcagcacccctctgtctgagcactccttggattacatgccattccactctgcagttcgtttctaatctgcataaagtcttaagct

SEQ ID NO: 2600 - protein, 209 aa, Corynebacterium glutamicum
VGKHRRNNSNATRKAVAASAVALGATAAIASPAQAAEVVVPGTGISVDIAGIETTPGLNNVPGIDQWIPSLSSQAAPTAYAAVIDAPAAQAAPAASTGQAIVDAARTKIGSPYGWGATGPNAFDCSGLTSWAYSQVGKSIPRTSQAQAAQGTPVAYSDLQAGDIVAFYSGATHVGIYSGHGTVIHALNSSTPLSEHSLDYMPFHSAVRF

SEQ ID NO: 2601 - DNA, 525 bp, Corynebacterium glutamicum
  CDS (101)..(502): RXA02152
aagccgttaaaagttgagactcgcgctgagaatctcacagaaaactccgaagctcccgctaaggtagctaccggaatcaaatcttagggaaggaaaacatatggctatttaccgtaagcttgcggcttccgctgcagcactggccctgtccgcatcactggtcgcttgtggcgactctgaggacaccaccgaagaaacctcaaccacctcttcttcgaccacttccagctcctccagcagctctagctccagcaccgcggctacttccgaggaatcttccgcagttgaagagccagcagtggaagctcctgtggaagaggctccagtcgaggcacctgttgagcaggcacctgtcgtggagcaagctccagttgagcaggctccggcaccggttcaggaagcacctgcaccagtcgagcaggctccagctccagttcaggaagcacctgcagctgacgcgccacctgcacttccaggtggtggcggcggacacgctggctactaaaaattcatgcttttacccac

SEQ ID NO: 2602 - protein, 134 aa, Corynebacterium glutamicum
MAIYRKLAASAAALALSASLVACGDSEDTTEETSTTSSSTTSSSSSSSSSSTAATSEESSAVEEPAVEAPVEEAPVEAPVEQAPVVEQAPVEQAPAPVQEAPAPVEQAPAPVQEAPAADAPPALPGGGGGHAGY

SEQ ID NO: 2603 - DNA, 876 bp, Corynebacterium glutamicum
  CDS (101)..(853): RXA02163
agcccgtacgatttctgcgttcccatcctctgcaccagctgcgcagaagatctccgaagccaacaccacgacgggccgattcaccccattctattcgcctatggcggtggcaacattcggaaccatcaccgacatgttggaaaccaaggggatcgtgagcaatgtaggcggcaccgacaccatcgatttgggcgcgttgttgaatgaaacccaagccggaacccgctggagcgaacttagccccaactatcagtccaaccgcgtcgtgcagatttctaccaccgatgtgcgcacctctaactcggcggccatgtacctatcaatgatgtcctgggtgaaaaatggcggaaaaacggtgagcagcactgcggaagccgatgccatcatcccagagcttagccaactgttcgtgggccagggctataccgaaagcacctccgccggcccgtttgatgaatacctctcccaaggaatgggttctaaaccaatggtgatgatctacgaagcccagttcctcgcggaacaaaacaaggaaaactcacggatttccggcgatatggaactagtgtatccaagccccaccgtgtacagcacgcatacggtggttagcttgagtgacgtcggcgcggagatcggcgaactcctagaaaccgacgaaaccctgcagcagttggcagtcaaacacggttttaggccaaagaactccgcaatgatcgccgatgctggcatgaccgaccgcatgcccaacaacctcaatgtcattgatccgccggactatgacttcctagaacgactcattgatggcgtgggcgcatcgtacagtgccaccccagcagaagaggacacagatctatgaaaaatcttgtaaaaggtaca

SEQ ID NO: 2604 - protein, 251 aa, Corynebacterium glutamicum
MAVATFGTITDMLETKGIVSNVGGTDTIDLGALLNETQAGTRWSELSPNYQSNRVVQISTTDVRTSNSAAMYLSMMSWVKNGGKTVSSTAEADAIIPELSQLFVGQGYTESTSAGPFDEYLSQGMGSKPMVMIYEAQFLAEQNKENSRISGDMELVYPSPTVYSTHTVVSLSDVGAEIGELLETDETLQQLAVKHGFRPKNSAMIADAGMTDRMPNNLNVIDPPDYDFLERLIDGVGASYSATPAEEDTDL

SEQ ID NO: 2605 - DNA, 1698 bp, Corynebacterium glutamicum
  CDS (101)..(1675): RXA02164
tcaatgtcattgatccgccggactatgacttcctagaacgactcattgatggcgtgggcgcatcgtacagtgccaccccagcagaagaggacacagatctatgaaaaatcttgtaaaaggtacagcgctgggcttgagcttggtgcttctggcaggttgttcaactgtttcggattctatcgatagcctcggcgggggcctgggtggttcctctgagactttgaagattgtggccgccacagagctggaagatctgcagcccgcgatcgagcaagcctccgacgacttgggttttgatattgaactgagctttccaggcggcacactcagcaacagccaagccctcatggatggcgcttttgaccaggactatgatgccacctggtttgccaccaaccgttacgtcgatctgatcggcgcttccaacaagctgggggagaccaccaaaatcgcgacctctcccgtggcgttcggtgtgaaaacttccatggcccaggagctcggctgggatcagcgccagccaacctgggaagagctgggccaggcctcgcagacccaagatttcaccttcggtatgaccgatccggccacttccaactccggattttccgcgctcgttgccatggccacggcatatgctgataccggccaggccttaacaaccaacgacatccccgcgatcgccgagccgatgtccacatccctttccggccaaaccatcacctccggttcctctggctggctcaaagacactttcctggaacagcctgaccgcgcgaatgcgatcatcaactacgagtccgtcctgcacaccatgatcagcgaagacggcgccgatatcaccgtcgtggtgcccgccgatggcgtggtcagcgccgattacccgctctctacgatcacgggctccgaccagggcgagcatgtagcagagctggccggctggttcgctgagcaccccgacgctttaacagatacttatcgacgtccgaccaccgcgaacgcaacgctcccagcggagcttagctcgcagaccatcatcgaagctcccttcccagggagcaagacggtcaccgacgcgcttatcgacgcctacaccaatcaattccgcgtcccaggcgaaaccacctttgtgctcgacgtttccggatccatgctgggccagcgcatcaccttgctcaaagacaccatgtcagacctgatcagcggcggcgcgaccactgaccttgccaacgtgtccctgcgcgaccgcgaaaaagtatcgatcattcctttcagcttcgggccacacgaagtaatcagcgaaaccctcggtgcggtgggcagcccaagccgcaccgatctgcagcagcgcgttgaagccttgcaagcagacggcggaaccggaatttacgacgcagtgctcgccgcctacgcagagtccgctggtggcgactacatcccatccatcgtgctcatgaccgacggcgaactcaccgcaggacgaacctacgatcaattcctcaccgaatggaacgcgcttcctagcaatatccgatcaattccagtgtttgtcatcctttacggtgaagccaatgttgcggatatggaacaattggcagcaacaaccggcggtgagacctttgacgccatcaacggtgacctagacgaagcatttaaggagattcgtgcctaccaataatggaggatccttctttttct

SEQ ID NO: 2606 - protein, 525 aa, Corynebacterium glutamicum
MKNLVKGTALGLSLVLLAGCSTVSDSIDSLGGGLGGSSETLKIVAATELEDLQPAIEQASDDLGFDIELSFPGGTLSNSQALMDGAFDQDYDATWFATNRYVDLIGASNKLGETTKIATSPVAFGVKTSMAQELGWDQRQPTWEELGQASQTQDFTFGMTDPATSNSGFSALVAMATAYADTGQALTTNDIPAIAEPMSTSLSGQTITSGSSGWLKDTFLEQPDRANAIINYESVLHTMISEDGADITVVVPADGVVSADYPLSTITGSDQGEHVAELAGWFAEHPDALTDTYRRPTTANATLPAELSSQTIIEAPFPGSKTVTDALIDAYTNQFRVPGETTFVLDVSGSMLGQRITLLKDTMSDLISGGATTDLANVSLRDREKVSIIPFSFGPHEVISETLGAVGSPSRTDLQQRVEALQADGGTGIYDAVLAAYAESAGGDYIPSIVLMTDGELTAGRTYDQFLTEWNALPSNIRSIPVFVILYGEANVADMEQLAATTGGETFDAINGDLDEAFKEIRAYQ

SEQ ID NO: 2607 - DNA, 735 bp, Corynebacterium glutamicum
  CDS (101)..(712): RXA02165
gaagccaatgttgcggatatggaacaattggcagcaacaaccggcggtgagacctttgacgccatcaacggtgacctagacgaagcatttaaggagattcgtgcctaccaataatggaggatccttctttttctcccgcaagaatctcgcgggtatcgctattgcaacgctgattatcgcgctgcacttagtgatcggactcggagcattttggcctgttgtcgccatcgccggatacggcgctgcggtggcacttacacctaaaaaccctccgaagaaggaactccctccggttcaggcaactcccgaattagatagcccgggtctgcttgcagccaggtctcaagaactcgtgagaactatgtatagccacggtgctgcagcaccagtgatcgaagcgattaagaggctagacagctcactgcaattggtcattggtaactggacaagcctgaccaattttcccgagcaccaagtcaccattcgctcaattatcaaccagtacatcccaggcattatcgacgcttacctgaagatccccacccgcaacgatcctcgggcagtcgaagacctcattgaatccttcgacctcctgaactccgagacgatgaagatcttcaatgcgatccaagaacaaggccttaataaccttgaagatcacggtcgcgcactgcgcatgcaatttggtcaactgccagaagaattccgggaatagccactcaatgcagttaagtt

SEQ ID NO: 2608 - protein, 204 aa, Corynebacterium glutamicum
VPTNNGGSFFFSRKNLAGIAIATLIIALHLVIGLGAFWPVVAIAGYGAAVALTPKNPPKKELPPVQATPELDSPGLLAARSQELVRTMYSHGAAAPVIEAIKRLDSSLQLVIGNWTSLTNFPEHQVTIRSIINQYIPGIIDAYLKIPTRNDPRAVEDLIESFDLLNSETMKIFNAIQEQGLNNLEDHGRALRMQFGQLPEEFRE

SEQ ID NO: 2609 - DNA, 300 bp, Corynebacterium glutamicum
  CDS (101)..(277): RXA02166
cggtcgcgcactgcgcatgcaatttggtcaactgccagaagaattccgggaatagccactcaatgcagttaagtttttcctgcccggtaggatggtccgtatgagtcttgatccacagcttcttgaagtcctggcctgcccaaaggacaagggcccacttcgatatctggagagcgaacagctcttggtcaacgaacgcctcaacctggcctatcgcattgacgacggaattccggtgcttctcatcgacgaagccaccgagtggacccccaacaactagaagtacatcaaggacatttt

SEQ ID NO: 2610 - protein, 59 aa, Corynebacterium glutamicum
MSLDPQLLEVLACPKDKGPLRYLESEQLLVNERLNLAYRIDDGIPVLLIDEATEWTPNN

SEQ ID NO: 2611 - DNA, 2937 bp, Corynebacterium glutamicum
  CDS (101)..(2914): RXA02168
agggtttagtcatctatttcggctacgctcacgtaacctacgcattcgtaagtggtcatgggtccaagaagcccattccaagacttaggagctttatttcgtgagtatttcttcactgacaccgctgcactctttcaaagagccagcaattctgtacgccggtcaggcttctgcctggcagcaggtgatcgctgattccagcgaagaccacatcaccgcaacgcacctgcgcgagctcctgtctcgctcccgtgcaaagactgcacctttcgctcgccaaatcaccgccatcgtgcctggctcacttgctcgtcttgaggaactgacccgcgaagacgcacaaatcggtgcagacatcgacgcacagcctgccgtttccattccaggcattctgctgggacagatcgctgcaacccgtcagctgcgtgacctcggactcgatgtcgcagcagcttcccgccttggacactcccagggcattttgggcgttgaagcagtagacaatgaagaagacgttttagctttcgccatcctgctgggcgcagcagcttcccagttcgctggcaagggcgcacatatgctctctgttcgcggcctgtcccgtgagatcatccaggacaccatcgctggtgtcgatggggtagaggtctccctgcgcaacgctcgtgcacactttgttgtctctggtaagccagaggcactgaagaaggctgctgctgctctacagcgcgcagctgatgtttacaacgaagacatcaacgaaaagcgcaagggtggatccctggcagagcctaagtttgactacttggatgtggccattcctttccaccactcctccatgcaggacgcagccgacttggctgtcgagtgggcaaccacctgtggcctaaacgtcaacgcgcgcgcgttggcagaagcaattctagttaacccagctgactgggttgagcagatcgcaaacctcaaggctgattacgttctttccctcgatgcaggcgtcagccgtttcaccgctccattgctagacggtcgcggaatctctttggttcctgcgttctccgctgcagagcgcgacaacttggctcgccctggcttccacgttcctaccgctgaggattggtccgagttcgctccaaagctggttaagcttccaaacggtgagcacaaggttctcaccgggttctcccgcctgactggttattccccaatcgtcctggctggcatgaccccaaccaccgttgatcctgagatcgttgcagctgcagcgaacgctggacactgggccgaaatggccggtggcggacagtactctgaagaagtcttcaccaagaacaaggaaaagctcgtttccctgctcaaggttggacgctccgcacagttcaactccatgttcttcgaccgctacatgtggaacctgcagttcggtgcacagcgcatcgtttccaaggcacgtgcaaccggtacctccatcaacggtgttgttgtctccgctggtatcccagaggttgaggaagcaactgagctgatcaacgatctgaacgctgatggcttcccatacgttgcattcaagccaggcaccgtggatcagatccgcgcaaccctgaagattgctgatgcaaacccagagaccaagatcatcatccagatcgaggacggacacgctggtggccaccactcctgggtcaacttggacgatctgctcctgaccacctacgcagagctgcgttcccgcaagaacgttgtcgtcatgatcggtggcggcatcggaacccctgcaaaggctgcttactacctgaccggtgaatggtccaccgatttgggcttcccagcaatgccagtggacggcatcctcgtgggtaccgctgccatggcaaccaaggaagcaaccacttctcctcaggtcaagcaggcactggtcgacaccccaggtgttgatccacacgacgctggcggctgggttggccgtggcgatgctcgtggtggcgtgacctctggtctgtcacacctgcacgctgacatgtacgagctggacaacgattctgctgcagcttcccgcctgatctcttccatcgattctgatgattacgcagatcaccgcgaagagctcatcgaggctatcaacaagaccgctaagcctttcttcggcgaggtcgaagagatgacttacgcagagtggatccagcgttgggttgagcttgcttacccaactcaggacccaacctgggatgatcgtttcctcgatttggttcaccgcattgaagctcgtctcaacgaggcagagcacggcgccatcaccacactgttcccagaccatgcgtctgtggaaaatgaggaagaggccgtcgaaaagcttcttgctgcttacccgcaggcccgcgagatccaggtctctgcgcgcgacgccgcgtggtttattggtctgtgccgcaagcaccacaagcctatgccttgggttccagcaatcgatgctgacctagcacgctggtggggccttgacaccctgtggcagtcccagaacgagcgctacggcgcgaactcagtccgcgttatcccaggaccagtctccgtcgccggcatcgaccgtgttgacgagccagttgcagagctgctcggccgcttcgaagctgcctgcgttgacgctctcgacggcgagccagaagagatcttcgctcgcctcaatgagtccaagaacgagcgcgaattcctgctggctaccccacacatcgtgtggcacggcaacctgatcgacaacccagctcacgtcctcaacgagggtgctttcgagctcatcgaggaggatggctactgggtcatccgtatcctggctgattcctacttcgacgatctgccagttgagcagcgcccatacctggttcagcatgttgacatcccagttgagctgggtgacgctggttgaaccggtggtttcccaattgg

SEQ ID NO: 2612 - protein, 938 aa, Corynebacterium glutamicum
VSISSLTPLHSFKEPAILYAGQASAWQQVIADSSEDHITATHLRELLSRSRAKTAPFARQITAIVPGSLARLEELTREDAQIGADIDAQPAVSIPGILLGQIAATRQLRDLGLDVAAASRLGHSQGILGVEAVDNEEDVLAFAILLGAAASQFAGKGAHMLSVRGLSREIIQDTIAGVDGVEVSLRNARAHFVVSGKPEALKKAAAALQRAADVYNEDINEKRKGGSLAEPKFDYLDVAIPFHHSSMQDAADLAVEWATTCGLNVNARALAEAILVNPADWVEQIANLKADYVLSLDAGVSRFTAPLLDGRGISLVPAFSAAERDNLARPGFHVPTAEDWSEFAPKLVKLPNGEHKVLTGFSRLTGYSPIVLAGMTPTTVDPEIVAAAANAGHWAEMAGGGQYSEEVFTKNKEKLVSLLKVGRSAQFNSMFFDRYMWNLQFGAQRIVSKARATGTSINGVVVSAGIPEVEEATELINDLNADGFPYVAFKPGTVDQIRATLKIADANPETKIIIQIEDGHAGGHHSWVNLDDLLLTTYAELRSRKNVVVMIGGGIGTPAKAAYYLTGEWSTDLGFPAMPVDGILVGTAAMATKEATTSPQVKQALVDTPGVDPHDAGGWVGRGDARGGVTSGLSHLHADMYELDNDSAAASRLISSIDSDDYADHREELIEAINKTAKPFFGEVEEMTYAEWIQRWVELAYPTQDPTWDDRFLDLVHRIEARLNEAEHGAITTLFPDHASVENEEEAVEKLLAAYPQAREIQVSARDAAWFIGLCRKHHKPMPWVPAIDADLARWWGLDTLWQSQNERYGANSVRVIPGPVSVAGIDRVDEPVAELLGRFEAACVDALDGEPEEIFARLNESKNEREFLLATPHIVWHGNLIDNPAHVLNEGAFELIEEDGYWVIRILADSYFDDLPVEQRPYLVQHVDIPVELGDAG

SEQ ID NO: 2613 - DNA, 897 bp, Corynebacterium glutamicum
  CDS (101)..(874): RXA02170
atttaaaccgcccactctccagtcggaggatgggcggttttcgcatgcagtactattagtggacgtgtcaagaacttctaaggttcacccgggatggcgggtgtctactgtccttttagcaggagtagttattattggcggaatttttactctccctcagaaggaggaagtaaaggtttccgaattgcagccacaggccagcgctgcatccatcccgtcttcatcttccacagctgggaaagcagtggaagaaagccctctaacgcagtttgtggaaaactcgacaggctcccaaattacgtacatgagcctgaaagacgatttccatactggcacgtctacggaacgttttgcgcgcccagcgttaagtttgtctaagctctacatcgctgaatatgtgctcgagcacggcacgaataatgagaagtctttggcgatggaaatgatcaaagattcctccgacgtatccgccgaaatcttgtatgaggcgtacccagaatcaattgaggagattgcggatcaatacggattgctctccacaaggggagacgcgcactggggatactcggtgacatccacttacgatttggtgaaatttgtcagcgctctcattatcgatgatccagattcaccgatccttgaagcgatgcgtaatgccagcgcagtcgcggctgacggttatccgcaagactgggggacagcggtgcttgatgaggcagaaggatccaaatggggatggtctgatgatctcatgctgcactcctctgtgacctttggcgaagactatgttgtggcagctgctgtgactggatcaaaagaagacctcacccaattggtggaaaaccaattgggtgaggttgtgagtcagcacggctagtttagctagatagggtgcca

SEQ ID NO: 2614 - protein, 258 aa, Corynebacterium glutamicum
VSTVLLAGVVIIGGIFTLPQKEEVKVSELQPQASAASIPSSSSTAGKAVEESPLTQFVENSTGSQITYMSLKDDFHTGTSTERFARPALSLSKLYIAEYVLEHGTNNEKSLAMEMIKDSSDVSAEILYEAYPESIEEIADQYGLLSTRGDAHWGYSVTSTYDLVKFVSALIIDDPDSPILEAMRNASAVAADGYPQDWGTAVLDEAEGSKWGWSDDLMLHSSVTFGEDYVVAAAVTGSKEDLTQLVENQLGEVVSQHG

SEQ ID NO: 2615 - DNA, 462 bp, Corynebacterium glutamicum
  CDS (101)..(439): RXA02172
gagaaacatataagttgctttattttaaagccggcattgcttagagagtggccgatcaccgactcccgctcgagggatatgaaagcgagataagtttccagtgaatgcagaacaaatcacccaggggcgtcgccagccgacggctcaagagtttcgggacatgcaggcgagcccagaatttggagagctccgcagcaagttccgttcctttgctttcccaatgaccgttgccttcttcttgtggtacgtcgtctacgttctggttgcatcctttgcatcagagtggatggcaaccccagttttcggcgcaatcaacattggcctaatcttcggcttccttcagttcgtaaccacattcgtcattacttacatctatgtcatgtttgcgaacaagaacttggagcctcgtcaggctgctattcgccagaagatggaaggttaatcagatatgaattccactat

SEQ ID NO: 2616 - protein, 113 aa, Corynebacterium glutamicum
VNAEQITQGRRQPTAQEFRDMQASPEFGELRSKFRSFAFPMTVAFFLWYVVYVLVASFASEWMATPVFGAINIGLIFGFLQFVTTFVITYIYVMFANKNLEPRQAAIRQKMEG

SEQ ID NO: 2617 - DNA, 1056 bp, Corynebacterium glutamicum
  CDS (101)..(1033): RXA02177
aatacccccactttgaaaaacaccccgtacagttacaccagtacggggtgttttttagttaagcttgggtgatcacttaacccagctagaaggagtcaacatgcgggaaatattcctgatcagcggtgattccaccgaatcatccttggttttcaagacctccgaagaggacggcgctgaggaatttttcattgctgtaacagatgaactccacgccattcttgcaggtcatagcgagattaagagcgccccagaacccgaagaacacaaagaggtcccacctcctgttctagagccggtcgctgcggtagaagagccccgtgaggaaaaagaaattgaccctcgtatcagcgctcccctgacgatgtcaccccgcgaaattcagattcgggttcgctcaggcgccaccatcgaagaattagccgaagaaatcggcgtcaccgaagcccgcgttgagccctatgcccaccccgttttgctggaacgtgcccgcattgccgacttggctaagcaatcacaccccatcagggaaaatggtcctgcaaaactgactctctgggaaattcttgcaacggcgtttgccactcgcggccacgatctcaccacagcacgctgggacgcctacaaagacgccaccaaccagtggatcgtgcgagttgattggaaagcaggactcagcgacaactacgcggagtggacgttaaacctgcacaacaccagcaatcccaccgctgatccgcggaccccagtcgcagccgatttgatcgatcctgaattcattcagccggtacgtaccttgacgtccgtaaactccacccaggaacagtacgacgacgaaaccgatgttttcgacaccgtaccaagccctgacgacgcaccagactcagaatccgatgccgttgctgaaatcaccaacgacaacgaacctgaagtcgatgcggaaggcccacgcaacaggcgtcgaaaagcagtaaccccacactgggaagatgttcttttaggagttcgcgcaaacacaaagcgcccgaagaaataggatgtgctgatgccaagtca

SEQ ID NO: 2618 - protein, 311 aa, Corynebacterium glutamicum
MREIFLISGDSTESSLVFKTSEEDGAEEFFIAVTDELHAILAGHSEIKSAPEPEEHKEVPPPVLEPVAAVEEPREEKEIDPRISAPLTMSPREIQIRVRSGATIEELAEEIGVTEARVEPYAHPVLLERARIADLAKQSHPIRENGPAKLTLWEILATAFATRGHDLTTARWDAYKDATNQWIVRVDWKAGLSDNYAEWTLNLHNTSNPTADPRTPVAADLIDPEFIQPVRTLTSVNSTQEQYDDETDVFDTVPSPDDAPDSESDAVAEITNDNEPEVDAEGPRNRRRKAVTPHWEDVLLGVRANTKRPKK

SEQ ID NO: 2619 - DNA, 993 bp, Corynebacterium glutamicum
  CDS (101)..(970): RXA02178
cccacgcaacaggcgtcgaaaagcagtaaccccacactgggaagatgttcttttaggagttcgcgcaaacacaaagcgcccgaagaaataggatgtgctgatgccaagtcaattgggagaaaacgcggcgatcgtcaccctctggtttgttagcgcatccgatccccaatccatcatccgctcggaacctcgggcggatcgtggatatggccgaaaactgttggcacagctcaacccaacgtggccaattacccccatcgggcagttcgccctcaacagatccgttcctgctagtgccaacgagttctacatcgctggttttcccggcatcaccatcattcaaaccgtgttggaagatgtcacctctttatccaagctgaatcctcggttactgcgcagcgtcccggcaacagatgtctacattttcgccgtcaatgaagaaaccacccttggtggcttcgcacacatctacaacggtgagatcaaacgatccttcatcgcctatgaagagcgcgtcttcgaagacaacggcatccccggcggctttgaaaccccctactgggcaggcaaaaaaggcacccggaaaactgcgctgtcgttgcccttcaaccccatcgaactagtccacgaagcacaacgtgcatggctcggattcgacgccaccacctcccctgacatcaacgtcgttgcctatgccaccgatggtcgccccgagccgcgcatcgctgcaccccgcataattaacagcgaggaagtgacaaggtccgccgtcgaaaagctaggactgcgcgaatccgccttctacgacgactacgaagaatacgaggcacccgatcgagtggtgtccaagcgcattacctcaaacgcgaaaaaagcggccagctcagcacagaaatttggtaaatctctgtggcgagccagccgcgaattcgggtcaaacatggcggaaagactccgccacactgaccgctagcgctactacttagcgctgtt

SEQ ID NO: 2620 - protein, 290 aa, Corynebacterium glutamicum
MPSQLGENAAIVTLWFVSASDPQSIIRSEPRADRGYGRKLLAQLNPTWPITPIGQFALNRSVPASANEFYIAGFPGITIIQTVLEDVTSLSKLNPRLLRSVPATDVYIFAVNEETTLGGFAHIYNGEIKRSFIAYEERVFEDNGIPGGFETPYWAGKKGTRKTALSLPFNPIELVHEAQRAWLGFDATTSPDINVVAYATDGRPEPRIAAPRIINSEEVTRSAVEKLGLRESAFYDDYEEYEAPDRVVSKRITSNAKKAASSAQKFGKSLWRASREFGSNMAERLRHTDR

SEQ ID NO: 2621 - DNA, 801 bp, Corynebacterium glutamicum
  CDS (101)..(778): RXA02181
tttggctagtagggtgataatctcaaataaaatgcactttcaccagctttttcgattccggaaggtctaactacacgtcgtggtgaccacaagttttctcatggttgacggacacatccgcaatcttcagggccacatcgatcgcctcgaggcggcagcccctactgcttcacagttccatgatcgcatcatcactcaattgcgtgaagctccgggcagtgttcaggcagctgtcacgattgaaaataaccactataacgtcgagctgcgcccgccccgcaagttaaattcactggtcacccttgatacccacggccaccgcgatgagcgcctacatccaaagattaaaggccacgatatcgcgtggcagaacacggccaccgcaaacagccgccgccagggcgccgatgatggattgcttgtcgacgagtccggccaggtgatcatggctatcaatgcctctctcttggcgattaagggcgacaccgtgtttcattccacgcaccccaggtcgctgccgtctgttctggaatcaacggtcattgcctacctgcaggaacaaggctgtaatgcaaagcctcgagagcaaggcttcaacatcaatgatttgcgctcttcggaagtgtggctggtggattctttgtccggcatccgtcgcgtcgctgcatggctcgaatacggttccaaattcccagtctcagaaacgcgacctgtggcagctttcgtgccgacgttttctgaagtcaatgactacctatggagcactgcacagcaagtgtaggtcgctcgactgttattctc

SEQ ID NO: 2622 - protein, 226 aa, Corynebacterium glutamicum
MVDGHIRNLQGHIDRLEAAAPTASQFHDRIITQLREAPGSVQAAVTIENNHYNVELRPPRKLNSLVTLDTHGHRDERLHPKIKGHDIAWQNTATANSRRQGADDGLLVDESGQVIMAINASLLAIKGDTVFHSTHPRSLPSVLESTVIAYLQEQGCNAKPREQGFNINDLRSSEVWLVDSLSGIRRVAAWLEYGSKFPVSETRPVAAFVPTFSEVNDYLWSTAQQV

SEQ ID NO: 2623 - DNA, 648 bp, Corynebacterium glutamicum
  CDS (101)..(625): RXA02183
ttgcacatattccggattccgatcgtttttatatcactggtaagcgttggcctgacctctatgaggttagattcgtccctgctgactagaatcaagactcatggcaagccggaagaccaagcgtaaaaacctcattcagattctcagccttatcgttgctgtgttattggtggtgattttgtctgtggtgttccagcaatggtggaacaatcgcccagagccactcccccaagagatctctatctcagcatcttctcccgctggtgaaatcgaggtattcccattcagcatgtgtgaaccaggtgttgaatgcgaagagaacgaggtgccaacgctggaagttggtgctgatgaagagttgcacctgacgattccagaggcaattcatgatcatgactggtacttgttgaccatttatgatgatccggctgcaaatgacgagttctaccacaccagttacgacgccaccgaggcaaccgttcctggttctgtggatccaaccgaagagggtgcggagcgcccacgtctggtcgtagtggaagtgtccgctgtgatgatcggtgaggatgaaaatggtgaggaaagcccttacaccgtcacgtggtcgctatccacgatgaacgagtaactcactcacaaacaataagg

SEQ ID NO: 2624 - protein, 175 aa, Corynebacterium glutamicum
MASRKTKRKNLIQILSLIVAVLLVVILSVVFQQWWNNRPEPLPQEISISASSPAGEIEVFPFSMCEPGVECEENEVPTLEVGADEELHLTIPEAIHDHDWYLLTIYDDPAANDEFYHTSYDATEATVPGSVDPTEEGAERPRLVVVEVSAVMIGEDENGEESPYTVTWSLSTMNE

SEQ ID NO: 2625 - DNA, 2322 bp, Corynebacterium glutamicum
  CDS (101)..(2299): RXA02187
ggatcgacgaagtgcttcttctctacgtttgccatgtcatacattctttcaaactctgggaacaaaagtcacctcaacaaggcttaaacttaacaacatcatgaaaaaagactcccccatccccaccctcaaggggtggttggatactcaaagtgatgatcagctctccacaatccttagaaatcgacccgatacggttctccctttaccacctaatttggcctctcttgctgcgcgtttacagctgagggcgtctgcgattcgcgcggtgttgaaactcaatgcgttggaacttggtgtgttggaggccgtggccaaccttggtggtgaactccacccggttactgcccccgaagtggtggaatatttgcatgtggcgttggcagaggatcttccagcgcaagacacgattggtgcggctcttgccacgctgaaaaatttcgcgttggtttatggcgatgaccagttgatgattgctcaggagacgatggctgcgttgcctgttcattggcggttgcttccggaggtaagtgatcgcgggcagagtgaggaacaggtgagggaaagcgtcgataagctttctgataggcaccgcaaacttttgcacacgcttgcggcctcgggtggcttcggtctgacgcgcgatgcggcgcctgatgcggatccgtcgcggccgattccgcagttgctggcgtcggggttgttggcgcgcgtggatgagcagaccgtgcgcctgccggcgatggtgcggcgtgtgattgagggccgcgagcagctgcccgctcaggtgcgcccaattccgcgcacggcggcgccaggttcgaatgatggcggcattgcagccggccttgaggtggtgcggcacatgcgattgcttatcgacgccctcagccacgttcccgcccccacgctgaaagtcggagccctcggtgtgcgcgtggtgactcgcctgagcaaggaattagaccttgatgagaccgagctggcacgtctactgagtttgggtatggccagcggtctaatccgtaaaggcgtgcccgatccattgcccatggatgatgatggcggcgattacgtcgctcccaccccgctggctgacgaatggatggaatatgatctggcgcaccaattgggcacgttgatgtctggttggtggaagcaaacttacgcgccgtggttggtgggtcgggctgatgataaggacaagccgatccatgttctcagtaaaacaagcatcattgattcgcttcctgatgctcgtgcgaagatcctgtcctctttatctagggttttagtggacaatctgcacgcggatttagcattccattatccccttgcggcgagtcggatgaatcctgacaccatcacacagctggtacaggaagcccagtggatcggagcatattctcaaggcgtgaccgcagcgggtcaggccttaattgatggcgaaaaccctacggaggtaatcaaggctcctgcgccggtggagaatttcatcgtgcaaggcgatttcaccatcatggttccaggaccactaacccctgcgatgcaaaaaaccatggattcgatcgcatcgttggaatcacctggtttggcctcggtgtatcgactcagcgagaaatccatcaggcatgctctggatcttgggctcaccaccccggaaatcttggagtttctcaaagaacattccatgacagatctgccccaatctgtgggctatttgctcagcgatatcgccagaaagcacggcaccctccgaggcggccctgcactgtcctatatccgtagcgacgatcccgctttgctgcattccgcagtggaggcgggcgccgatgtggcgcttcggcagatcgctcccaccgttgcgattgctcaagcacccctgcttcaggtgatcactgtgctgcgtgctgccgggttccaacctgtggcagaagacggcgaaggcgcaagtctgaatatctcgccatcccctgcacgtgtgcccgcagcttccccaccaccagttgttccggcactggatgaaagccgggtacaggcagcagtcaaagcaatccgacgggaaaattcagcatctcaaggaactgtttccacacagccaactctttcggtgctgcaggctgcagtgcgagggcagcgcacggtgacgttggggttcgtcgataagcaaggcgtggccgtgcaccgcgtcgtcaagcctttaaccgtcaacgccgggcaggtggacgctgtggatgaagccacaggtgcggtgcatcgtttcatgttgcacaggatcacagaagtaatagtggataactagcctagaagtgacataatgga

SEQ ID NO: 2626 - protein, 733 aa, Corynebacterium glutamicum
MKKDSPIPTLKGWLDTQSDDQLSTILRNRPDTVLPLPPNLASLAARLQLRASAIRAVLKLNALELGVLEAVANLGGELHPVTAPEVVEYLHVALAEDLPAQDTIGAALATLKNFALVYGDDQLMIAQETMAALPVHWRLLPEVSDRGQSEEQVRESVDKLSDRHRKLLHTLAASGGFGLTRDAAPDADPSRPIPQLLASGLLARVDEQTVRLPAMVRRVIEGREQLPAQVRPIPRTAAPGSNDGGIAAGLEVVRHMRLLIDALSHVPAPTLKVGALGVRVVTRLSKELDLDETELARLLSLGMASGLIRKGVPDPLPMDDDGGDYVAPTPLADEWMEYDLAHQLGTLMSGWWKQTYAPWLVGRADDKDKPIHVLSKTSIIDSLPDARAKILSSLSRVLVDNLHADLAFHYPLAASRMNPDTITQLVQEAQWIGAYSQGVTAAGQALIDGENPTEVIKAPAPVENFIVQGDFTIMVPGPLTPAMQKTMDSIASLESPGLASVYRLSEKSIRHALDLGLTTPEILEFLKEHSMTDLPQSVGYLLSDIARKHGTLRGGPALSYIRSDDPALLHSAVEAGADVALRQIAPTVAIAQAPLLQVITVLRAAGFQPVAEDGEGASLNISPSPARVPAASPPPVVPALDESRVQAAVKAIRRENSASQGTVSTQPTLSVLQAAVRGQRTVTLGFVDKQGVAVHRVVKPLTVNAGQVDAVDEATGAVHRFMLHRITEVIVDN

SEQ ID NO: 2627 - DNA, 693 bp, Corynebacterium glutamicum
  CDS (101)..(670): RXA02199
acagcttagtacggattagacaattcccgaacttttcattcgtagttcattttcaacgccgcctaagcaacacaggcaaagcgccactagtctcggtcgcatgactgactccactccgcaaggctcaacaccaggcatgtcccctgaagctatcctcaacggcaccggaaagccgtgggaagagtggctaaaattgcttgacgacgtaaaagccacctcttggactcacacccacatcgcaaagcacatcgtggacaactttgatgtcagtggctggtgggctcaaggcatcgcgattggttatgaatacgaacgtggcatgcgcaaacccgggatgaccagcgatgggttcgcggccaatgcctccaaaacccttaacctgccggtcgaaaaagtgtggaagctcttcggagacgatgacctgcgggcgcagtggctcgatcccgcactaattgagaaaacctccgcctccgaacctagaacattcaatgccaaatggttggccgatgattctcgagtgagcgtcaacttcacctccaaaggcgacaataaatccagcttcggcatccagcacagacgcctgcctgatcaagacagcatccctgtcatgaaagcattctggaaagaacgcatcgctgcattagttgaggtgtcaaaacaattttcgctttaacattaagttcttagccttca

SEQ ID NO: 2628 - protein, 190 aa, Corynebacterium glutamicum
MTDSTPQGSTPGMSPEAILNGTGKPWEEWLKLLDDVKATSWTHTHIAKHIVDNFDVSGWWAQGIAIGYEYERGMRKPGMTSDGFAANASKTLNLPVEKVWKLFGDDDLRAQWLDPALIEKTSASEPRTFNAKWLADDSRVSVNFTSKGDNKSSFGIQHRRLPDQDSIPVMKAFWKERIAALVEVSKQFSL

SEQ ID NO: 2629 - DNA, 501 bp, Corynebacterium glutamicum
  CDS (101)..(478): RXA02203
cgattcaaaagagttcaccgaggtaggaaacatcgtggtcgcagccattgatgccctcctgggcgtgcagctctaggaaatttcaggaacaatacatctcatgaccattcgcgccactttccagccttccgtagatgaattcatctccactctcgaagagtttgcaacaggttcataccttaaagaggacgaaaaggaattctgggacgaacctttcgatgtcaaggcacttccagatcttcgtttcatcttggaaaactaccttgattccctagataagctcggtgaagcaccagaccttgatgctgttaacgcctccgctcagtccacccttgatgagctggagaagttcaacacaaagcaccacggtgctgttgttgagcctgaagaaaaagaagagatcactaaattgatgtttgatgctgcaaagcagactggtgcagatgatctttctgcagaggctttccctgagtttgagtaaatttcagtagaagtttttta

SEQ ID NO: 2630 - protein, 126 aa, Corynebacterium glutamicum
MTIRATFQPSVDEFISTLEEFATGSYLKEDEKEFWDEPFDVKALPDLRFILENYLDSLDKLGEAPDLDAVNASAQSTLDELEKFNTKHHGAVVEPEEKEEITKLMFDAAKQTGADDLSAEAFPEFE

SEQ ID NO: 2631 - DNA, 1059 bp, Corynebacterium glutamicum
  CDS (101)..(1036): RXA02206
ggcaggatctgctgctgcggctaggagggttatctcttcattcacccgatctaccgtactaccttatgacctcagtagtgtggtgggcgtgaaacagcgaatggtcggttcaagtggtttgcgggtatccaggctcggtttgggcacctcaacatggggctcgggcaccgagctggctgaggcaggcgatatctttaaggcgttcatcaattctggtggcacgcttatcgacgtctcccccaactacaccaccggcgtcgcggaagaaatgctcggcacgatgttggatgcggaagtctctcgttcggctgtcgtcatttcctccagcgcaggtgtcaaccccgctctgccgctcggccgacgtgtggattgctcccgccgcaatttgattgcccaattagatgtcaccctgcgggcattaaacactgactatttggatttgtggtctgtgggctattgggatgagggcaccccaccgcatgaggtggccgatactttggattacgccgtgcgcaccggccgagtccgatatgccggtgtccgaggatattccggttggcagttagcggtcacccacgctgcatccaatcatgcagcggcctccgcccgccccgtggtcgttgcacaaaatgaatacagcctgctggaacgccgcgcagaacaagaactcctccctgccacccaacacctaggtgtcggattctttgctggcgctccgctggggcaaggcgtgctgactgctaaataccgctccgaaattccccatgattccagagctgcatccacaggacgcgacgcagaagtccaaagctacctagataatcgaggccgcatcattgtcgatgctcttgatactgcagccaaaggattaggcattagccccgctgtcacagccaccacctgggtgcgtgatcgtcccggagtgacagctgtcatcgtgggcgctcgcacacatgaacagctgtcacatcttctcaaggcggaatcggtgactttgccaacaccaatcacacaagcccttgatgatgtctccctgtgacttggtccaattacattcac

SEQ ID NO: 2632 - protein, 312 aa, Corynebacterium glutamicum
MVGSSGLRVSRLGLGTSTWGSGTELAEAGDIFKAFINSGGTLIDVSPNYTTGVAEEMLGTMLDAEVSRSAVVISSSAGVNPALPLGRRVDCSRRNLIAQLDVTLRALNTDYLDLWSVGYWDEGTPPHEVADTLDYAVRTGRVRYAGVRGYSGWQLAVTHAASNHAAASARPVVVAQNEYSLLERRAEQELLPATQHLGVGFFAGAPLGQGVLTAKYRSEIPHDSRAASTGRDAEVQSYLDNRGRIIVDALDTAAKGLGISPAVTATTWVRDRPGVTAVIVGARTHEQLSHLLKAESVTLPTPITQALDDVSL

SEQ ID NO: 2633 - DNA, 553 bp, Corynebacterium glutamicum
  CDS (101)..(553): RXA02211
actgtccgaagtattggatctggtcgagggaactgtccgtaaacgcgactaaacgacccctgattcacactttcagactacaagaactagactaagcggtatggtttcagttcttttaattcagccccgtcagggagaagcagtcgccgcagctgagcgacgtgactttttgcaggccaccggtcttaagcctcaagaactgacctcccgaatgttggataccaccacttctcgaattggcagtctggaaggtttcgacggcgtgattgtgggcggaagcccactgaatgccaccaactttgagtacagcgattggcaacgccacgtccaccgcgaattgtccttgctgatcaatcacccactgccaacaatctttgtctgctacggcaatacctttttgaccttcttctctggcggacagattggtcgcacacaccccgaagattccggcgccaccacagtgttgctaactgacgccggcaaacgagacgtactcactcaagacctaccggatagctttacgtcctttactggtcacacggaaaactccgta

SEQ ID NO: 2634 - protein, 151 aa, Corynebacterium glutamicum
MVSVLLIQPRQGEAVAAAERRDFLQATGLKPQELTSRMLDTTTSRIGSLEGFDGVIVGGSPLNATNFEYSDWQRHVHRELSLLINHPLPTIFVCYGNTFLTFFSGGQIGRTHPEDSGATTVLLTDAGKRDVLTQDLPDSFTSFTGHTENSV

SEQ ID NO: 2635 - DNA, 621 bp, Corynebacterium glutamicum
  CDS (101)..(598): RXA02212
gtgatgtgactttctatcacccccttactcacccccattgcttattgagtaaagtcggttcccgctctttcgtgagcccgacactaatgaaggtttttagatgattccagaaaatattgatctcaagcagctcgcttcggagcttggtgatgatgccgtggcaatgggggagcacacaggcaaccagtttccgactttggaaaaagaccttattaatgttgtgacagatgcaaaggaatcagattttggatctttaggggtcgtgattcttgatgaaactccagtgatgacttccaacctgagggatattgcgcaggagctgttgattcaaacggatctggacaccgttgtggtgcgggctccaatgtcggctgcggtggtgagtgatgttcattcgagggcggcgcttgagtcagggcagcatgatttgcttgggaccactgattacgtgctgggaacggagcttttggtacaggatgtaacggaatcgacggtggggaatattgattggggtcaattgctgatttgggggttggttgctttggcaatcgccgtggttgttgcgggtgcgtctgtgcgtcgaaaagcaatatctttataagtaaagttctaaagctttac

SEQ ID NO: 2636 - protein, 166 aa, Corynebacterium glutamicum
MIPENIDLKQLASELGDDAVAMGEHTGNQFPTLEKDLINVVTDAKESDFGSLGVVILDETPVMTSNLRDIAQELLIQTDLDTVVVRAPMSAAVVSDVHSRAALESGQHDLLGTTDYVLGTELLVQDVTESTVGNIDWGQLLIWGLVALAIAVVVAGASVRRKAISL

SEQ ID NO: 2637 - DNA, 329 bp, Corynebacterium glutamicum
  CDS (1)..(306): RXA02216
gtagcgcccgcccctggacacgtggtgttggcaacgggaccaacctgccccatccagatgctgcgcgccaacaagaacacctggtcagttcaattccatgcggatatggatgccgtaggcatgaaaaaccgcatggatttttactccaactaccggttcttctccccagaagattatgaccgcatcattgcagagctaccctctgttgactccatttatgccaacagggtgctccgcaacttcgtggaggtctgcgaaggaattcgtgttgctgatggtgctgagcaccaactcccaaagcttaactaatcgaggagactggtgattcg

SEQ ID NO: 2638 - protein, 102 aa, Corynebacterium glutamicum
VAPAPGHVVLATGPTCPIQMLRANKNTWSVQFHADMDAVGMKNRMDFYSNYRFFSPEDYDRIIAELPSVDSIYANRVLRNFVEVCEGIRVADGAEHQLPKLN

SEQ ID NO: 2639 - DNA, 786 bp, Corynebacterium glutamicum
  CDS (101)..(763): RXA02217
ccaaatgggtatgggcgcttttgaccatcgtcaatggtgttggccccgctgcctactgggctttcggcaggaaaaactaagagttgttagggtggcgctcatgactaataaaacacgagctctactcattggtggccacggcaaggtggccctcctagcaacccccatgcttatcgacgcctcggtgcaggtcacttccatgtaccgcaatccggaccacaggtccgaaattgaggcgctgggcgccacaactttagagcgtgacgtcaccacactcagcgtggaggattgggcagatctgctcaaggacttcgacgtagtggtgtggagcgccggaaacggtggcaagaacggcgcggatgcaacttatgccattgatcgtgatgccgcgatcgcatccattgatggtgcagctagcctaggggagaaggcacctcgctacatcatggtgagctacattggatcctccacgcacaccattgatccttcagcatccttctacccatatgcagaatccaaaaaggccgctgatgagcacctaagctccaccaacctggattaccttatcctcgcaccagcagccttaactctggatgaagtcaatggcgttgaggtgatcgccgataccaacgaagcagccgcaggccgcaccacatcaagagtcctcgttgcggaagttatcaccgagttggtggttcgcgacttcccacaaacccgtgtgctgcctttcgtggatggcgaatcaccagtctcctcgattagttaagctttgggagttggtgctca

SEQ ID NO: 2640 - protein, 221 aa, Corynebacterium glutamicum
MTNKTRALLIGGHGKVALLATPMLIDASVQVTSMYRNPDHRSEIEALGATTLERDVTTLSVEDWADLLKDFDVVVWSAGNGGKNGADATYAIDRDAAIASIDGAASLGEKAPRYIMVSYIGSSTHTIDPSASFYPYAESKKAADEHLSSTNLDYLILAPAALTLDEVNGVEVIADTNEAAAGRTTSRVLVAEVITELVVRDFPQTRVLPFVDGESPVSSIS

SEQ ID NO: 2641 - DNA, 390 bp, Corynebacterium glutamicum
  CDS (101)..(367): RXA02218
caatgatttatatgtcttggacgagcgattaaatagagttggcataccccaaatgatagacccaaagtgtcgtgtccaccgctcgttgtagcatgaacccatgtttgcaatcatgactgtcacagggcaggaccacaccggaattatcgccgcagtttccaccgcgttggctgagctagatgtcaatattcacaacgtttcccaaaccatcatggatcaatggttcaccatgatcttgcacgttggtttcgatgaatcggtcttggatatcgccacagttcaggaacgcatgaagccagtggaaaaggaacagggcttggttattcgtatccagtctgaagccttgttcaacgcggttaatgagatctagggggtgcacatggatgattt

SEQ ID NO: 2642 - protein, 89 aa, Corynebacterium glutamicum
MFAIMTVTGQDHTGIIAAVSTALAELDVNIHNVSQTIMDQWFTMILHVGFDESVLDIATVQERMKPVEKEQGLVIRIQSEALFNAVNEI

SEQ ID NO: 2643 - DNA, 1509 bp, Corynebacterium glutamicum
  CDS (101)..(1486): RXA02219
tcaggaacgcatgaagccagtggaaaaggaacagggcttggttattcgtatccagtctgaagccttgttcaacgcggttaatgagatctagggggtgcacatggatgatttttctgcatcgctaggttttactgaccgttcctcgaggggaattctggacaccatcgagatgattgagaagtatcgtcttgatattcgcaccgtgaccatgggaatcagcctgttggaatgcgcgcgtggctcgatggaagagaccgcgacggctgtttatgatcgcgtgacgtcacaggctgcacgtctggttgaggtttgtgaaggcattgagcgtgaattgggcattcccattgtgaataagcgcatctcggtgactccaattgccctggtgactgctggttgcagtggcgatcccgttgacgttgctcgagccttagataaggcagcaaaagatgtcggagtgaacttcatcggcgggtattcagcactggttgaaaaaggtggaaccacctccgatattcggctgatccgctccattcccgaggcattgagcacaaccgatgtggtgtgtggatccgtcaatgtggcgtcgtctcgcgcgggtatcaacatgaacgcagtcaatgagatgggcaaggtggtcaagcaagcagctgaattgaccaaagatcgctccgccatcgcatgtgcaaagctagtggtctttgccaattctgtgggcgataatccattcatggctggcgctttccacggcattgaggagccggattgtgtggtcagcgttggtgtctcaggaccaggcgtggttagtcgcgcgctgggcaatcttcaaggtgccacccttgatcaagtcgcagaagagatcaagaaagcggccttcaagatcactcgtactggacaactggttggtgcgatggcctcagaacgcctaggagttcctttcggcatcgttgatctttcgctcgctcccactgctgaagtgggcgattccgtggcaaatatccttgaggtcatgggtcttgaccaggtgggcacacatggcaccaccgcggcactcgcactgctcaacgacgcggtgaaaaagggtggcatgatggcctgctcacgtgtcggcggcttgtccggatccttcattccagtttctgaagataaaggcatgatcgatgcggttcgcacaggagcaatttctattgacaagctcgaagcgatgaccgcgatctgctcagttggtttggatatgattgcgatccctggcgacaccccggcggaaactatttcgggcatgatcgcggacgaagcagccatcggtgtgatgaatcataagactacagctgtgcgtgttattcctgttccaggaactgtccctggcgatgaggtagatttcggtggcttgctgggttacgcgccggtcattccagtaaataccgtgggaaatagtgagtttattcaccgcggcggcttcattccagcacccgttcacgggtttagaaactaggagatccggggcctttacct

SEQ ID NO: 2644 - protein, 462 aa, Corynebacterium glutamicum
MDDFSASLGFTDRSSRGILDTIEMIEKYRLDIRTVTMGISLLECARGSMEETATAVYDRVTSQAARLVEVCEGIERELGIPIVNKRISVTPIALVTAGCSGDPVDVARALDKAAKDVGVNFIGGYSALVEKGGTTSDIRLIRSIPEALSTTDVVCGSVNVASSRAGINMNAVNEMGKVVKQAAELTKDRSAIACAKLVVFANSVGDNPFMAGAFHGIEEPDCVVSVGVSGPGVVSRALGNLQGATLDQVAEEIKKAAFKITRTGQLVGAMASERLGVPFGIVDLSLAPTAEVGDSVANILEVMGLDQVGTHGTTAALALLNDAVKKGGMMACSRVGGLSGSFIPVSEDKGMIDAVRTGAISIDKLEAMTAICSVGLDMIAIPGDTPAETISGMIADEAAIGVMNHKTTAVRVIPVPGTVPGDEVDFGGLLGYAPVIPVNTVGNSEFIHRGGFIPAPVHGFRN

SEQ ID NO: 2645 - DNA, 1485 bp, Corynebacterium glutamicum
  CDS (101)..(1462): RXA02221
ttcaatgatatttgctctgatttttggttctcgtctaatttcattattttgtcacgccagccatcacgacttcatacccaccaattgaaagtaaagtccaatgtttaccgcatccattcctacttatgaattagggtctttcagcaagggctcctacgttgagatcaaaggaacttacttctaccctgacacgctaaatactttatttagaaattctggggcaaaagacaacgaagagttctttgtagacgtaactcttgttccagaaccagataatccgcatagcactcgaggccatgccatttcagtccgctggaatgatctcgtaataggacatattgcctcggatatgactgaaaaattccaacaagtgcgacgagttgcagctagtggctacgatgctcgagtctctgctcggatttggacgaatacaaactataagaatgaacgagatttttgggtatctgttaagctccccgatccagatttccttgttcctcttaatgatcctccccatgacgggtttaccctcctcccttatggaacagcaatccaagtcaccaaggaatctgatcacatggacgtgctctcagaattcgtgcctccatctggacaaggtcagattctcgtatcgctacacatcattaacgcaggcgtgagaaaagaatgggatggcattgaagttcggctcgataatcaacggatcggagagcttacaaaggccagttcagaaaaattcgcacccgtagtgcgacatttcgatgacctaggacttagtacactatgtcgtgcgctcatcaaggggtcatcactagctgctgaagtaactctatatggagctcgtgcacatgagctttccgaagaagacttagaacctaaaagctcttccccattgcccaggttggttgaataccagtcaaatccgtttaattatcaagtccccaacaggtggcccggcgagcagaatcaacgtgctcctaagtcgcaaaagtcttcttcatcacctttcgcagcgtatcgcgggccatcgcaacctagtaaatcactcacaccgtttgtagcgcagacacctgcgcctcagcctagtgatcgatttattgattgggattcattgcttcaaccggacggaactccaagagctacgccattccaaagaggagtaacccgcgggttaattggcaagcatttttcgaatcaaaaatctccaagaattgactttgcaacggtggggcaatgtgatgcaattctccgaactttcggagagccgaccgacaagctttataaagacggcaggacttcttggcctttgtggtgggcgctcatggcgatagtcacccttctcgtcatgttgctgaactttattccaggaattggtccgatcttcccacttatcggattgatcgtacttggtcatcacttttggactcgccgaaaacttaacccaccattcggtagatcaaaatagatattctcatcaaatatcgc

SEQ ID NO: 2646 - protein, 454 aa, Corynebacterium glutamicum
MFTASIPTYELGSFSKGSYVEIKGTYFYPDTLNTLFRNSGAKDNEEFFVDVTLVPEPDNPHSTRGHAISVRWNDLVIGHIASDMTEKFQQVRRVAASGYDARVSARIWTNTNYKNERDFWVSVKLPDPDFLVPLNDPPHDGFTLLPYGTAIQVTKESDHMDVLSEFVPPSGQGQILVSLHIINAGVRKEWDGIEVRLDNQRIGELTKASSEKFAPVVRHFDDLGLSTLCRALIKGSSLAAEVTLYGARAHELSEEDLEPKSSSPLPRLVEYQSNPFNYQVPNRWPGEQNQRAPKSQKSSSSPFAAYRGPSQPSKSLTPFVAQTPAPQPSDRFIDWDSLLQPDGTPRATPFQRGVTRGLIGKHFSNQKSPRIDFATVGQCDAILRTFGEPTDKLYKDGRTSWPLWWALMAIVTLLVMLLNFIPGIGPIFPLIGLIVLGHHFWTRRKLNPPFGRSK

SEQ ID NO: 2647 - DNA, 741 bp, Corynebacterium glutamicum
  CDS (101)..(718): RXA02227
accgcgtgccataggaggtgtcagccagatagggtgcactatcttgaaaaaccgcgctcaggagaggtgtttgcccagcaatttcggtgggcaggatagggtggaagacgtgaatgcaacgctgattatcatgcctggaagtccggcgctggtacctgaactggcaccagcggatgctgcgggggcgcgcttgttggcgtcgttacgtgcagtttttgatgcggaactggctaatgatgatcgcccgatcgagttggttggctcccgggatgaggcgtggtttaccaagcatgcgggaaatctgcgggcctggggtgcaccgagcgtgcaggtttctgacggacattatttgccggaaattttgcagcgtgtcgcgctgggtggtttcgaatcgcgtgtaactcatgtgcgcgatcggttgggtagcgtcaacgacaacacggttacggtgcttgcccttgacggccccacgggcttgaccacccgcgcgccgtccgcactcgtgcccggcgcgtccaacatcgacgcctggtgccgctcattgctgtctggaaagcccggggaagtgcccagcaccagcacgcttatcgacgcctccctccgcgaaccacagctctggctcgacttatccgccgtggcaacagaagcgtcaactgctcaacttctcgacagcgacgacacacacggcgtgggacgctacgttgctcgctggactttttaacttaagggagatctagatcg

SEQ ID NO: 2648 - protein, 206 aa, Corynebacterium glutamicum
VEDVNATLIIMPGSPALVPELAPADAAGARLLASLRAVFDAELANDDRPIELVGSRDEAWFTKHAGNLRAWGAPSVQVSDGHYLPEILQRVALGGFESRVTHVRDRLGSVNDNTVTVLALDGPTGLTTRAPSALVPGASNIDAWCRSLLSGKPGEVPSTSTLIDASLREPQLWLDLSAVATEASTAQLLDSDDTHGVGRYVARWTF

SEQ ID NO: 2649 - DNA, 660 bp, Corynebacterium glutamicum
  CDS (101)..(637): RXA02230
catcgcatagaatactggtgcaatcgtttacgttcgctattaatgtgacacgtataagccgacacttttaacgaagcgcagaaggagtgagagcaagaaaatgggagaacaacttccgtttgctaatggttcacgctccaacaaactgccgctcatcgtcatcggtttgtgctgcataatgctgatcctgtggcttaaacttcccggcgtactgcttgccaccatcattggggttgccacgatgagtgtgatgcggatgcgcacctccaccccagaaactgcctcgctggttacttctattcggctgtctgcggaagatatttccgatgtgcaacatgagtggcagcagtttttgacctcccccgaggccgatgcgctggctgatcgcacgcttgtccgtcccgcactggcggatccagattgtggcgataaggctatcgagaaatttcattatgaaatcagcaatgccaatcgcttcttgggcaggttggacgctcgtctgcaacaaaacctcgtggtcagtgagctagaaacacttctcaaagtaacggacgagcgcgcactagagctgcgggaaacgtggctggatgcgcgtaaagcggcccagaaacttgggccgaactacaatcgcgaatcttagatctgcacctcaccgagtgc

SEQ ID NO: 2650 - protein, 179 aa, Corynebacterium glutamicum
MGEQLPFANGSRSNKLPLIVIGLCCIMLILWLKLPGVLLATIIGVATMSVMRMRTSTPETASLVTSIRLSAEDISDVQHEWQQFLTSPEADALADRTLVRPALADPDCGDKAIEKFHYEISNANRFLGRLDARLQQNLVVSELETLLKVTDERALELRETWLDARKAAQKLGPNYNRES

SEQ ID NO: 2651 - DNA, 879 bp, Corynebacterium glutamicum
  CDS (101)..(856): RXA02231
taaacacctaaattgagcgctctattccatcaacgcgggggcaatttctcacgtgtaggaaaagtgactattgcctgttaagggagttagactaatcgccatgactagcgatctgaagacaatcggtatggatttcgccaagtggcaagatgcagtggaagcagcaattgcttcacagcgtctcgaggtaacaggcgaggtccgtggcggccagctcatccagttctcggatgattccggcgcccaaattaacattctggctgtcgagccttttgccaccttcgccggctttaactccgcaacagtcgcttacggccacgtcagcatgatcaatgatgtgctgtccctggtcgatatcatcgatcctttcggcacccctgttgccaccattacctgcaaccttgctcaaggcccactgcttgttgatgaaccagtgcagcgctggcagcagatccgcattactgccctgggcattgatgttgaggtccacgacaatgcagatgcttacatccgcaatggtggcgaaactgtcggcatgctggtttctgaaggtgcagagaagattgccagcggcagcggcgctgtcatcccggacgcatccgcagagttttccgcacgcgtgttgtctgcggagtaccgcaccaacactcttaccggccagcgttttatccacgcaacagttgatggcctcttcgcttttgatgtgtgccttcctgatgcaccagaactacctgcccgtgacagcgtgttgtctggcaaagtcatgctgactgctgccgttatccccactgaggtcaccggctgcggtggctccggtggcggctgtggctcaggtagctgtggctgcggcggacactaaaattctgcacaattttttaa

SEQ ID NO: 2652 - protein, 252 aa, Corynebacterium glutamicum
MTSDLKTIGMDFAKWQDAVEAAIASQRLEVTGEVRGGQLIQFSDDSGAQINILAVEPFATFAGFNSATVAYGHVSMINDVLSLVDIIDPFGTPVATITCNLAQGPLLVDEPVQRWQQIRITALGIDVEVHDNADAYIRNGGETVGMLVSEGAEKIASGSGAVIPDASAEFSARVLSAEYRTNTLTGQRFIHATVDGLFAFDVCLPDAPELPARDSVLSGKVMLTAAVIPTEVTGCGGSGGGCGSGSCGCGGH

SEQ ID NO: 2653 - DNA, 1656 bp, Corynebacterium glutamicum
  CDS (101)..(1633): RXA02244
caccaattgttctgggcaatatccaacccccgggaaagaaaatgatgaatgcagcagactgggcgcgtggtgtccaacttgatcaggaagcgaaattccaatgagcctagaaaaatccggcggattccgctccaggactccaaaagcgcagcaggaacctgctaagcagaagccgcaggcgcgtaaatctccgtcaaagaaggccccggctcgggggcaggggcagagtcaggggcagcgccagggccaaagcagtggcaaaggcggcggaaaccgcaagccccctgcgcaggccagggaagtgagggctctgggcgtcgataagccgagagaaattgcgtttgaggtgcttgatcgtgtgcgtaccggtgaggcgtatgccaacttggtgttgccacgactgctgagcaagcacaatctttctggccgtgacgcggcctttgctacggaaattacctacggcaccttgcgtaatgtcggcttgctggatgaggtcattaaggctgcatctgggcgtgaactgtctgatattgatccagaggttttggacgtgctgcgtttgggcgcgtaccaggtgatgtttacccgcgtggaggatcacgctgcggtcgatacttcagtaaagatggtcggtgggctgaagaaattccaggccactggttttgccaatgcaattttgcgcaacatcacgcgcaaggaaccagagcagtggttgaaggaattggagcccgcggaagagttggctcgcgttgcgttccgtactgcgcacccacgctggattgcgcagagtttctcacaggtgctcccggcagatgagttggaagcagcgcttgctgcggactctgagcgcccagtggtgcacttggtggctcgcccaggtgagatcagtgcagaggaattggcgctgatcaccggtggtgacgagggcaagtattccccatacgcggtgtacctcgagggtggcgacccgggtgatattgagccagtgaaggatggtcttgcagcagtgcaagatgagggttctcagctgattgctcgcgccttggtggaaatccccgtggagggcaccgatgccggccgttggctggatatgtgtgcaggtcctggcggtaaagcggcgctcattggtgcgttggctcgcatggatcgtgccaccgttgatgccgtggaggtctctgatcaccgtgcccgactgattgaaaagtccgtgcgtggtttgcccgtcaaggttcatgtgggcgatggccgcaccatcaacttgaccggtggttacgatcgtgcgctagtcgatgcgccgtgttctggtttgggtgcactgcgtcgtcgccctgaggcgcgttggcgcaagcaggaaagcgacattgttgagctcaacaccctgcagtacgagctgcttgaatccgctgtgaacaaggtgcgttccggtggcgtgattgtgtactccacatgttcacctgatctgcgtgaaacccgcggaatcgtggacaaggcactgggggctctggagatcgaagagcttgaggctgcggagttcatgccaggcatgaccgataccggcgatgagaaatcagtgcagatgtggccacaccgccacggcaccgatgcgatgtttgtggcagtgctgcgaaagaagtagacctgtgagctaagtggggt

SEQ ID NO: 2654 - protein, 511 aa, Corynebacterium glutamicum
MSLEKSGGFRSRTPKAQQEPAKQKPQARKSPSKKAPARGQGQSQGQRQGQSSGKGGGNRKPPAQAREVRALGVDKPREIAFEVLDRVRTGEAYANLVLPRLLSKHNLSGRDAAFATEITYGTLRNVGLLDEVIKAASGRELSDIDPEVLDVLRLGAYQVMFTRVEDHAAVDTSVKMVGGLKKFQATGFANAILRNITRKEPEQWLKELEPAEELARVAFRTAHPRWIAQSFSQVLPADELEAALAADSERPVVHLVARPGEISAEELALITGGDEGKYSPYAVYLEGGDPGDIEPVKDGLAAVQDEGSQLIARALVEIPVEGTDAGRWLDMCAGPGGKAALIGALARMDRATVDAVEVSDHRARLIEKSVRGLPVKVHVGDGRTINLTGGYDRALVDAPCSGLGALRRRPEARWRKQESDIVELNTLQYELLESAVNKVRSGGVIVYSTCSPDLRETRGIVDKALGALEIEELEAAEFMPGMTDTGDEKSVQMWPHRHGTDAMFVAVLRKK

SEQ ID NO: 2655 - DNA, 1059 bp, Corynebacterium glutamicum
  CDS (101)..(1036): RXA02255
gtgtgcagcgttgctggcaagttttgctggagcacgaaagcgttaaggagtaggcgtgtcactgacgagtgatatcaaacaagaattggcgcaggtccatgtggccaaaaacagtgttcgtgctgcggaagtgtctgcaattttaaggtttgctggtgagatgcaagctgtcggcggcaagctggtcatcgaagcaaatttggacagcatgcaagtcggtatgaggcttcaggagtttatccaaggtttgtacaactctcgagtcgatgtgcacaccgtgaacccgactgtgagcaggaaaacgccacggtatttggtgcgcatcattgacaatgccgatgaaattgcgcgacgcaccggactggtcaccaggtctggacatgtggttaaaggtctagcgccttctgtggtcagcggaacaatcagtgacgctgaagctgcatggcgcggtgcgtttctagccaatggatctttaagtgatccaggtcgttcctcttcgttggaggtgttgtgtcctggtcaagaatcagcattggcactggttggatgtgcgcgaagaattgggatcgcggcgaaaacgaaagattctcgaggatttgatcgcgtcaatgttcgtgatgcggaagcaattggggcactgctcactcgaatgggtgcccagaaaactcgcatgttgtgggaagaaaaacgcatcaagcgggaaagtcgaactccgcaaaccgggttggccaacttcgacgatgccaatctgcgcaggtcagcccgagcagcagttgccgctgcagcgagggtagaacgcgccatgaagattcttggtgatgatgttcctgagcatttggctgaggctggacagctgcgtgtgcagcaccgtcaggcatcgttggaggagttgggccggttggctgatcctcaaatgaccaaggatgctgtggccggtcgtattcgtcgtcttttgacgatggcagataagcgcgccgaagatctgaagattcctgatacaaattctgttgtgacggaagatttgttggaagaaatttagatgattgaagcctaaaaacg

SEQ ID NO: 2656 - protein, 312 aa, Corynebacterium glutamicum
VAKNSVRAAEVSAILRFAGEMQAVGGKLVIEANLDSMQVGMRLQEFIQGLYNSRVDVHTVNPTVSRKTPRYLVRIIDNADEIARRTGLVTRSGHVVKGLAPSVVSGTISDAEAAWRGAFLANGSLSDPGRSSSLEVLCPGQESALALVGCARRIGIAAKTKDSRGFDRVNVRDAEAIGALLTRMGAQKTRMLWEEKRIKRESRTPQTGLANFDDANLRRSARAAVAAAARVERAMKILGDDVPEHLAEAGQLRVQHRQASLEELGRLADPQMTKDAVAGRIRRLLTMADKRAEDLKIPDTNSVVTEDLLEEI

SEQ ID NO: 2657 - DNA, 636 bp, Corynebacterium glutamicum
  CDS (101)..(613): RXA02266
gaggaaagtagcgctacatctgcatatctacccccttaaaaatgaagcataaaaccgccgtgtaccggccttttattgattttgacgtaagcttgcaccgatgactcaagatgaacacccccgacaggccgactcccatttcaacatgcttttaccggatggaaatgaaaacgcacaccagctttctgtcgctctaaatcaggtggcacatctgttggcctatgatgcggactcttcaattcatcggcctgatgggctaagtctggcgtcctatagaattctcttttcactgtggactgatggcccgatgagtccactccaggtgactgacaagactggaatgaaaaagtctgcgatttctaacctgttaaagccattgctcgctgaatctctgattgtgcaggtgacggcagaaaatgatcgacgctcaaaggttttaagccttagcgaaaaaggcactacatacattcagaaaacagccacccgccaaaatgctttggaatccgagtggtttggcaccctgaccgacatcgagcaggatttattggagtcgttgctcaggaaactgctcgactccaaccgcgcatccaaggttcgtaaaaaccgatctaactagcgtcgatccttagggatgta

SEQ ID NO: 2658 - protein, 171 aa, Corynebacterium glutamicum
MTQDEHPRQADSHFNMLLPDGNENAHQLSVALNQVAHLLAYDADSSIHRPDGLSLASYRILFSLWTDGPMSPLQVTDKTGMKKSAISNLLKPLLAESLIVQVTAENDRRSKVLSLSEKGTTYIQKTATRQNALESEWFGTLTDIEQDLLESLLRKLLDSNRASKVRKNRSN

SEQ ID NO: 2659 - DNA, 996 bp, Corynebacterium glutamicum
  CDS (101)..(973): RXA02267
tgcgctcggcaagtgttttgcttatcgacgtctccccacataacaatcccaactcgaagcaccaacgattcaagccttatcagttttgtacaggaaaatagtgcaaaaatggggtttaagcttcgtggagaggattgtcatcgtgaacaacgtgcaacagtttcatcgattttttgatgattccgcagtctattatccctgcttcgtcccgcttgaccgagccatcggcgaacactttgatcgtcagaacaaaccgatgtccagattcatcggaacgctcattctgccgttagccaaactggaagaagccgcccaatacaccggcgatgaagtccttcgcgtgtcggcagtaatcagtactgatgggctcgctgatctgcgaagggatttttacgaactccccaacatcgacatcgcctcggtggaaatcaagctggtcggcgcagccctcaccaacaccgcttggttgggagatgtggaaaaactcatccaacaacatcgcaacactttcgtatgggttgagattccgacagccctggtcaccgcagatattgtccgaaaactccgccacatgggagctggcctgaaatacagaactggaggtgatagggaagagctcttcccctcaccgcaggacttggtcactgtgctgcgcaccgccatcgatgctgcattgccgtttaaactcactgcaggcctgcatcgtgctctcaggtatcgtgacgagaaaaccggccgacttcacttcggattcctcaacattgcagccgccgtggcgacacttcgtgctggaaaaggcgaggcagaggcactgaagatccttgaaggcgatgatgccgctccgcttattcacgcactacaaagcggcgaaaactggcgggattccttccgcagcttcagtacctgcaatgttgttgaaccactcaacactctgattgatcttgatgtgttggcggaaggagacgtacatccctaaggatcgacgctagttagatc

SEQ ID NO: 2660 - protein, 291 aa, Corynebacterium glutamicum
VQKWGLSFVERIVIVNNVQQFHRFFDDSAVYYPCFVPLDRAIGEHFDRQNKPMSRFIGTLILPLAKLEEAAQYTGDEVLRVSAVISTDGLADLRRDFYELPNIDIASVEIKLVGAALTNTAWLGDVEKLIQQHRNTFVWVEIPTALVTADIVRKLRHMGAGLKYRTGGDREELFPSPQDLVTVLRTAIDAALPFKLTAGLHRALRYRDEKTGRLHFGFLNIAAAVATLRAGKGEAEALKILEGDDAAPLIHALQSGENWRDSFRSFSTCNVVEPLNTLIDLDVLAEGDVHP

SEQ ID NO: 2661 - DNA, 776 bp, Corynebacterium glutamicum
  CDS (1)..(753): RXA02280
gcggacctggctgaaaccatgttgggtcttctcaccttggagacctcccgtggtcgcatctcgatcggtgagatcaccacgttgtccatcaccgaggatgtgtcgctgcagctggctaccacgttggatgatttcaggcagctcaacaccattgcgcgcccggacaccttgattattaatggcggctacattcacgacagcgatctggctcggctcattcccgttcactacccaccgcttacggtatctactgctgacctgcgcgaatccatggatctgatggagcttccgccgctgcaggacattgagaaagccaaggcactggatgcgcaggtcacggaatcattgaaggattttcagatcaagggcgcaacgagggtttttgaacccgcagatgttcctgccgtggtgatcattgattccaaggcgcaggcctcacgggatcgcaatgaaacacaaagcgcaaccactgatcgttgggctgacattttggcaacggtggataacacgttgagccgtcaaacagccaacattccacaggatcagggactgtcggcgttgtgcttgaattggaacaattcgctggtcaggaaattggcgtccactgatgacaccgccgtggtgtcgcgcacggtgcgtttgctctacgttcaggcattgttgtccagcaagaggccactgcgggtgaaggaacgcgcgctgcttaatgattcgctggcagatctggtttctttgtctttgtcatccgatatctaagacaatcctccgctaatctt

SEQ ID NO: 2662 - protein, 251 aa, Corynebacterium glutamicum
ADLAETMLGLLTLETSRGRISIGEITTLSITEDVSLQLATTLDDFRQLNTIARPDTLIINGGYIHDSDLARLIPVHYPPLTVSTADLRESMDLMELPPLQDIEKAKALDAQVTESLKDFQIKGATRVFEPADVPAVVIIDSKAQASRDRNETQSATTDRWADILATVDNTLSRQTANIPQDQGLSALCLNWNNSLVRKLASTDDTAVVSRTVRLLYVQALLSSKRPLRVKERALLNDSLADLVSLSLSSDI

SEQ ID NO: 2663 - DNA, 672 bp, Corynebacterium glutamicum
  CDS (101)..(649): RXA02286
gcagcgcacacgctttcccctcagcctgctgatacccccgttttgccacctaaaacaacctctcatcttcatttcatattcacttcatagggttgaatacatgaagaacgcaaaacttttcctcgcgctcatatccgctcctcttatcctcgctggctgcagctccaccgatactggaacagcagaatccaccatttccagcgaaactgcttctgcagtagatgccaccacttctacctcctcaagtaccgccacctctgccgtgattgatgacgatccggtattcgacatcatcgacatcgtccttgcccaataccccgacaggatcatcaccgacattgaccgcgaagactcctccgatcaatacgaagtcgatgttgtggttggccaagaagtccttgaacttgatgtcaccaccagtggccagatccataccgacgaccgcgacaacgatgatgatgacgacatccgcgaagctcacgcagccacagtcaccgcagctcaagccattggcctagcgctggatcaatacccagacggaattattgattctgttgaattagacgaagacgacggccagctgaaatggaaaatagacctcgatgacacttccggcaatgatcttgctgacgttgaaatcgcagcagtttaagcacgcgcacggaaagccac

SEQ ID NO: 2664 - protein, 183 aa, Corynebacterium glutamicum
MKNAKLFLALISAPLILAGCSSTDTGTAESTISSETASAVDATTSTSSSTATSAVIDDDPVFDIIDIVLAQYPDRIITDIDREDSSDQYEVDVVVGQEVLELDVTTSGQIHTDDRDNDDDDDIREAHAATVTAAQAIGLALDQYPDGIIDSVELDEDDGQLKWKIDLDDTSGNDLADVEIAAV

SEQ ID NO: 2665 - DNA, 675 bp, Corynebacterium glutamicum
  CDS (101)..(652): RXA02287
ttgaaaaaggaacattagtgccagtaacaagagcccagttgaattcaagcgggcagagacacatctggccctcaaaattttccttttactggagaccactgtgtactcaatttcagaaactatcgcccgaactcttatgccccgcaccgatcacgttttcgacctgatgggcaacggaaacgcctggttcgtcgatgccctagaacgcctcgggcgaggcatcatcaccgtccgccccacagttgaaaccgtggccgccgcggacacctaccaccgcgtcacccgccgcccggcggtcgctaccaccacctatggtgctggtttcaccaacaccatgaccacgcttgccgacgtcgccctctcccgtatcccacttcttttagttgtgggcactgccccgagcgccgggcctcgctgtttcgacattgaccggcaaggactcgcacgtgccgtaggtgtggaaaccttcaccgtgcatgcagatgacgttgctgcggtaactcttcaggcttggaataatacgccggaaaacacacacgtgatcctggaaatcccctatgacctagcagctgccacagccaccgatccaacagtgactacatacctgctgcgccccggatttcagaaactcccgatgtcaccgaccttgtcctagctctacgcaatgcccaaaat

SEQ ID NO: 2666 - protein, 184 aa, Corynebacterium glutamicum
VYSISETIARTLMPRTDHVFDLMGNGNAWFVDALERLGRGIITVRPTVETVAAADTYHRVTRRPAVATTTYGAGFTNTMTTLADVALSRIPLLLVVGTAPSAGPRCFDIDRQGLARAVGVETFTVHADDVAAVTLQAWNNTPENTHVILEIPYDLAAATATDPTVTTYLLRPGFQKLPMSPTLS

SEQ ID NO: 2667 - DNA, 498 bp, Corynebacterium glutamicum
  CDS (101)..(475): RXA02294
tacctcacctggcaacaaatccaaggaatgtagataagtcggggcaaactctaagaaatcatcctggtttgtggcagggaacattcctaggatgggaggcatggcaaagacaaaactagaaagcatctccgagcgcaactcggatgatccgcttagttaccccgacctgactcttgcaccaatatccacaacagtcacagtcgtggtcgccgaagacaccccaaacgataacttctcagaacttctcctcggcgcagcagaatcaacccgtcttttaggactcgacgagctccacatcatcgctccatcagtccacctacccgctctcgcagtagcagccgccgacatcgcacaccatctgccagagaaattccaattctgtgaagccgaaacctgcactcatctccaccccgacgatgacacctatctcacggctgaatccgttgctcaattgggtacgaagctgaagtctgcgtagttgttaggagccaccacaga

SEQ ID NO: 2668 - protein, 125 aa, Corynebacterium glutamicum
MAKTKLESISERNSDDPLSYPDLTLAPISTTVTVVVAEDTPNDNFSELLLGAAESTRLLGLDELHIIAPSVHLPALAVAAADIAHHLPEKFQFCEAETCTHLHPDDDTYLTAESVAQLGTKLKSA

SEQ ID NO: 2669 - DNA, 903 bp, Corynebacterium glutamicum
  CDS (101)..(880): RXA02295
ttcccatgctaatccgcgaaaatggcacttcaacagccatatactttaaacaacacaaatgatgcaagactgataccgggatgtgataggagcgcaccacatggggttggaattagcagctagcgggtggggcatcctcatcgcaggcgccgccgtagccggatggatcgacgcagtaatcggcggtggcggactcgtcctcatcccgctgatcctcgcggtcatgccgcaactcgcacctgtgacagcgctggcctccaacaaactggcagccgtcaccggcacggcatcggcggcattcaccctggtcaggcgcgtcaaacccgacaaaaaactgcttgcgctctacgttctggtggcagctgtgtgctccggtgcaggcgccctggctgcgagtctcattgacaaacaaatcatgcgaccgctgatcatcgtgttgatgctggtcgttggcctgatcgtggtgttcaaaccaaacttcggaaccggcgaaagcaaagccctgcccaccggatggaaacgctgggccgccatcgttgcagtcggactcatcgcagcctacgacggcatcttcggacccggaaccggcatgttcctcatcatggcgttcaccgcactgctctcccaaaatttcctgtcctccgcagccatggcgaaggtcgtaaacaccgcaacaaacctgggtgcgctaattgtattcatcatcggcggccacatgtggtggaccctaggactcgtgctggcagtcgccaatgtcgcaggcgcacaactcggtgcccgaacggtgcttggtggcggtaccaggctaattagatacgcactactaaccctggttgtcgtcatgagcgtctacctcacctggcaacaaatccaaggaatgtagataagtcggggcaaactcta

SEQ ID NO: 2670 - protein, 260 aa, Corynebacterium glutamicum
MGLELAASGWGILIAGAAVAGWIDAVIGGGGLVLIPLILAVMPQLAPVTALASNKLAAVTGTASAAFTLVRRVKPDKKLLALYVLVAAVCSGAGALAASLIDKQIMRPLIIVLMLVVGLIVVFKPNFGTGESKALPTGWKRWAAIVAVGLIAAYDGIFGPGTGMFLIMAFTALLSQNFLSSAAMAKVVNTATNLGALIVFIIGGHMWWTLGLVLAVANVAGAQLGARTVLGGGTRLIRYALLTLVVVMSVYLTWQQIQGM

SEQ ID NO: 2671 - DNA, 1260 bp, Corynebacterium glutamicum
  CDS (101)..(1237): RXA02297
tgctgatcacgcctgactcctatgaagtgttgaccgattccgctgctaaagtgaaagcgacattatgaaataaacgtggatcaaggagtccggtgcccaattgagcgataaagaaccagacccccacgaacaaattccagagaagccatcccgcaaggttattgcacttcgttggtgcatcgtagcgccgctgtcgctagccgtggggtggctttttactatgtggggtgtgccagccgcatggatcctcggggcgatccttgttgccggtgtatgtgcgctgaccacagggcaagatcttccgatggccaagggggtgcatgtttttggtcgctcaatcgtggcgatgctggcggcgctgcctttgattagttcttctggttcggaacttgttcgtttcctcatcccgggtcttgtgatttcctttttcaccatcgcggtaggcatcgttggtggtttgttgctggcaagatccaggccggagattttgccggaaactggtgtgctgtccatgctggcgggtggcgcgtcggtgatgccgattctggcccgagagttgggcgctgatttccgctatgtggcgctgacgcagtacctcaggttgttggttgtgtccatgacgttgccgctggtgacgcactttttcgtccctggcggggcggatttgggatcgccgcctgagaaatggttggacgtgttgagtttgggagagttcgggacgtcgataagcgttttatcgctgctggtgctcttcggtattgtgctggccggcgaacctctcggcaggttgctgcgcttgcctgcccctgcggtgatggggccgctgatcctgaccgtgctggtgagttttgtgattccagatgatctcagcctgcaaccgccaaccgtgtttaagattatcgcgttcatggcgatcggttggatgtgtggcggtcccttgaatatgaccgcgctgaaggtgttttctaagcagcttccggccacgttcttgtttattttcgcgctgcttgcggtgtgcgcaggtgcggcggggctgctcacctggtggttggatatcagcttcttcgaggcttacctagcaaccagccctggagctctggagacggtgttggcgctgtcctcggaaggatctgcaggcccggtggtggtcacgatccagatcattcgactactggcaatcttgaccatcgccggtttgatccccacgctactgcgacgcattttgcgtagggatcgttaaaggccttctagttcagcacc

SEQ ID NO: 2672 - protein, 379 aa, Corynebacterium glutamicum
LSDKEPDPHEQIPEKPSRKVIALRWCIVAPLSLAVGWLFTMWGVPAAWILGAILVAGVCALTTGQDLPMAKGVHVFGRSIVAMLAALPLISSSGSELVRFLIPGLVISFFTIAVGIVGGLLLARSRPEILPETGVLSMLAGGASVMPILARELGADFRYVALTQYLRLLVVSMTLPLVTHFFVPGGADLGSPPEKWLDVLSLGEFGTSISVLSLLVLFGIVLAGEPLGRLLRLPAPAVMGPLILTVLVSFVIPDDLSLQPPTVFKIIAFMAIGWMCGGPLNMTALKVFSKQLPATFLFIFALLAVCAGAAGLLTWWLDISFFEAYLATSPGALETVLALSSEGSAGPVVVTIQIIRLLAILTIAGLIPTLLRRILRRDR

SEQ ID NO: 2673 - DNA, 1782 bp, Corynebacterium glutamicum
  CDS (101)..(1759): RXA02298
aaatcatagcgtgagatgacaaggaaaggaatatttcgatccggcaacaacccccgcgtcaggtgggattatgccgaaaaaatcgctacgatagccacttatgactcttcagagttctgataaacgttctccttcactgttagacgcctcctccgaggtctttgtccatgatttggcagctttgtctcccactgatgccactgcatggggtatctcaggcttcgaaggtgatcttcaggatttctctcctgactattggaatgccatcgccgaacgcaaccgcgacatggttgccgatgttgatgcttttgatgacggcactgatgacaacgatgacgaagaagatttcgatgacgttgaccgcgtcaccgctgatgttctccgtgatcgcgtatgcctggatctggccctgcaccaccagggcgaaaccttagcgaatctcaacaacattgattccccagtccagaccatccgcgataccttcctcatcatgccccgcgagacggacgatgatgtggaaaatctccgcgaacgtctctcccgcgtccccgacgctctccacggatactgtgaatcactcgctgaggctgccagccaaggccatgttgcagcggtccgccaggtggaagaagtggtgtcgcaatgtgaggacctcgctgatgaggactccgttttgcagcaccttggcttggatgaaaatgatccagtagttgtagaggcccaggaagcttttgcacgagttgccggttggttagcagagcaactggctccgcatgctcctcatgtggatgcggttggccgggatcgctatgaaatgttctcccacctgcacgtcggcgagtttgtagatctggatgaggcttaccaatggtccctggaacagctgcgtgacattgatgctcagcagcttcaggtagcccagcagctgtacggccctggcaccacgatccgtgaggccatgaagaagctcaatgctgatgagcgctacctcatccgaggcactgatgctctgcaggagtggatgcaaaagaccgctgatcaggcaatcgctgatctagatggcgtttccttcaacattccagagcaggctcgacaggttgagtgcctcatcgatcctgctggaactggcggcattttctacaccccaccaagcgatgatttctccaggcctggccgcatgtggtggtctgtgcctaaaacccaggaagtcttccacacctggcaagagctcaccaccgtgttccacgagggtgttcctggccaccacctgcagatctcccaaactttggtggaaaaggatctgaacctgtggcgtcgagtcgcttgctggaactctggccacggtgaaggttgggcgctgtacgcagaatctctcatgaaggaattgggataccacgaagatccaggcaacctcatgggctaccttgatgctcagcgactccgtgcagcccgcgtggccattgacatcggaattcacctgaacaagaggaacccagagtgcaccggcctgtgggatgcgtcttatgcgcgcagcttcctgcgtgaaaatacgtccatgaatgaagatgcgctgtactttgagctcaaccgttaccttggttggccaggtcaggccgcatcgtatgccattggtcagcgactctggttgaacctgcgcgatgaggccattagccaggggcaaaccttggcgcaattccacagcaaggcattgtcctatggcagcatcccgatgggcattttgcgcgatcaggtgctgaactagaaggcctttaacgatcccta

SEQ ID NO: 2674 - protein, 553 aa, Corynebacterium glutamicum
MTLQSSDKRSPSLLDASSEVFVHDLAALSPTDATAWGISGFEGDLQDFSPDYWNAIAERNRDMVADVDAFDDGTDDNDDEEDFDDVDRVTADVLRDRVCLDLALHHQGETLANLNNIDSPVQTIRDTFLIMPRETDDDVENLRERLSRVPDALHGYCESLAEAASQGHVAAVRQVEEVVSQCEDLADEDSVLQHLGLDENDPVVVEAQEAFARVAGWLAEQLAPHAPHVDAVGRDRYEMFSHLHVGEFVDLDEAYQWSLEQLRDIDAQQLQVAQQLYGPGTTIREAMKKLNADERYLIRGTDALQEWMQKTADQAIADLDGVSFNIPEQARQVECLIDPAGTGGIFYTPPSDDFSRPGRMWWSVPKTQEVFHTWQELTTVFHEGVPGHHLQISQTLVEKDLNLWRRVACWNSGHGEGWALYAESLMKELGYHEDPGNLMGYLDAQRLRAARVAIDIGIHLNKRNPECTGLWDASYARSFLRENTSMNEDALYFELNRYLGWPGQAASYAIGQRLWLNLRDEAISQGQTLAQFHSKALSYGSIPMGILRDQVLN

SEQ ID NO: 2675 - DNA, 1014 bp, Corynebacterium glutamicum
  CDS (101)..(991): RXA02304
ctagccatcattggtagttcctaattgtttccgtacagtatagctccagcacaacttctgagtgcaagttttttataacagggcagtaacgtttactggtatgaaaactccccgtctgctgaagatcctcagcgcgatggtggctgtcactggacttctcattccaacggtggtccccatggccgccgctgatgctgctgaactgtccgacaacgttcccgatcgcacccaaattgccatcatcaaccctgatggcagcgtgcaagaatctgacaacgccgaagaatcccgcccggcattatccctggccaagctgtatttgggttattatgtgttggctcaaggcgcggaagaagatattgaactagtcccagatatgatccgctactctgatgatttcaccgcggattatttggagagcgaatacccggaagcaattcctgaggttattgatgccttcgatttggaagacaccgaatgggctggtttctggggcaatgcaactaccagtgcggtggatattgcgacgtttgtagcagcactcatcgacgatcccacggcgcagcccttgcttgacgcaatgtctgacaccgctgagtatgcggcggatggctacgcccagaactttggcacttttacattgtccgatgtcaccggtactaaatttggttggtctgattccctcgatgtgcattcatcggtcagctttggccctggttttgtgatcgctgccaacacctacggtgacgccgaaacgctcaccgaagatgtccaagattccgtgtcttcgctgtatccggaggaagtaaccaccgcgatcgaggagcaggtggatcagctgtgtgagtgcgctgcagagactacgcatttgggaatgcacactggcgcggagctgaaagcacagcttgagggcactatttatggaaaaaccctcagctttttacctaattcagccccagcgccagcgtttatttacaacctgctggcacattagcaaacagttttaaggaactc

SEQ ID NO: 2676 - protein, 297 aa, Corynebacterium glutamicum
MKTPRLLKILSAMVAVTGLLIPTVVPMAAADAAELSDNVPDRTQIAIINPDGSVQESDNAEESRPALSLAKLYLGYYVLAQGAEEDIELVPDMIRYSDDFTADYLESEYPEAIPEVIDAFDLEDTEWAGFWGNATTSAVDIATFVAALIDDPTAQPLLDAMSDTAEYAADGYAQNFGTFTLSDVTGTKFGWSDSLDVHSSVSFGPGFVIAANTYGDAETLTEDVQDSVSSLYPEEVTTAIEEQVDQLCECAAETTHLGMHTGAELKAQLEGTIYGKTLSFLPNSAPAPAFIYNLLAH

SEQ ID NO: 2677 - DNA, 552 bp, Corynebacterium glutamicum
  CDS (101)..(529): RXA02308
gggtgagattggaatgatttcggcccgggcgctcgaaaaccgtgatagacacaatgaaccgagcaaatccgccaggaaataaattaagtaaggaatatccatgagtgaaacccagtcgaattcagtgtcagcggtaatgcctgcgcagctccctccagggcctgccgagcgtactgtgtactcctacggtgttcgcgcaggggatcaggtgcacattttaagaatggaggcttttgattctgacgcgaatattgtcggcgaaagggacattgaggcgcatgctgaacaagtctttaagaacctgcaagcagtaatccacgaggcaggaggaacgatcaacaacattgtttccaccactacttatcttgccgatgtcaccgatgctcccgttgttaacgctgctcgctcccgctatttcaccggagaagtattgcccacccacaccgtaattggagttgctgctcttgctcggccacagtttctagtcgagatctcagcggtggcctatttgggggacctttcaaaagactagatacatgattatttttgcat

SEQ ID NO: 2678 - protein, 143 aa, Corynebacterium glutamicum
MSETQSNSVSAVMPAQLPPGPAERTVYSYGVRAGDQVHILRMEAFDSDANIVGERDIEAHAEQVFKNLQAVIHEAGGTINNIVSTTTYLADVTDAPVVNAARSRYFTGEVLPTHTVIGVAALARPQFLVEISAVAYLGDLSKD

SEQ ID NO: 2679 - DNA, 1209 bp, Corynebacterium glutamicum
  CDS (101)..(1186): RXA02324
gaaggtcaaaaaacttgactttattgaaaacaatttccattaagaagtgtacacttgcgtcgactctattgaaaatgattcccaaaaggagggctttcacatggccacaacgaccccagtcaccgtgctatcaggatttctcggctccggaaaaaccacattgctcaaccagatcctccaccaccgaggatcccggaaaatcgcagtcattgtcaacgatttttcagaaatcaacatcgacgcagccctcatcgcatccgaaggccacctcacccgcggcgaagaccgcttcgtggaactgaccaacggatgcatctgctgcaccctgcgcgaagacctcgtggattccgtcggcgaactcgccagcagcgaccgcttcgaccacatcgtcatcgaatccacgggtatctccgaaccaatgccggtagccgccacatttgaatggcagtgggatgacggcacccgcctggctgacaaagcaccgatcgacaccatggtcaccctggtcgatgccacccaattcatcgacctcatccgcaaaaacacctccctcaccgaggctgacatgggcgcaaccgaggacgatgaacgcaccatcgccgacctactcaccgatcaaatcgagttcgccgaccgcatctacatcaccaaatccgacctggtggaccgcactgtcctcgagcaaacccgcgcactaatcgccagcatgagtccacgcgcccgcattgacttactcatcgatggcctcaatgacggctcccccatcaccgacgacatcctcggagctttcctctacgacgaagccaccgcccgcgcctacgagggctacacggaagaactcgaaaacccgcacactcccgaaaccgaggaatacggcatcagttccgtggtattccgctctgaccggccgttcaacaaggatcgcctacttcaggtactgcgttccaccactggactcgttcgctccaaaggctattgctggatcgctgatcacctcaacatcgtccaggtctggcaccaagccggccccaatttgagcattcgcccggccgcctattgggccaattcagagatcacccccggcactgaattggtcctgatcggcatccacatcgacggccccaccttgctcgcactgctacaaggcgcgacgcttaccgatgcggaagtggcggcactggttttgtgagttcctcaagtccgtgaatt

SEQ ID NO: 2680 - protein, 362 aa, Corynebacterium glutamicum
MATTTPVTVLSGFLGSGKTTLLNQILHHRGSRKIAVIVNDFSEINIDAALIASEGHLTRGEDRFVELTNGCICCTLREDLVDSVGELASSDRFDHIVIESTGISEPMPVAATFEWQWDDGTRLADKAPIDTMVTLVDATQFIDLIRKNTSLTEADMGATEDDERTIADLLTDQIEFADRIYITKSDLVDRTVLEQTRALIASMSPRARIDLLIDGLNDGSPITDDILGAFLYDEATARAYEGYTEELENPHTPETEEYGISSVVFRSDRPFNKDRLLQVLRSTTGLVRSKGYCWIADHLNIVQVWHQAGPNLSIRPAAYWANSEITPGTELVLIGIHIDGPTLLALLQGATLTDAEVAALVL

SEQ ID NO: 2681 - DNA, 993 bp, Corynebacterium glutamicum
  CDS (101)..(970): RXA02325
gggcagagatttgaagatggagaccaaggctcaaagggaatccatgccgtcttggtttaatactgcacccgtctaatgaaaatcattactattaggtgtcatgatggaccatgcacacgattcctgctcaccaactctgcgccgtgatttggaggtcactggccagctccaacctgagaaagctgtcgatttagcagcgccgcacgaagggaaggttgccaatataacgaaggtgacctcctcaaatatggagcacaccatcacgcaggcctcaaaagctaaggaggtggtggtgctcattggtcactccctgctgcccacatttcaggatttggaaaaagacattctgcactttcaggcaggtaataaagggcgattttctgtagcgattgttgatcctgatcgcagtgcagatgtggttgccagatttaggccaaaacagattccggtggcatacgtggtgaaagatggcgccagcattgcggagttcaactcgctcaacaaggagccggttgcacaatggcttgatcattttgtgtcgcgggaaacgatccccaatgaaaaagagggggacgtcgataagcaaatagacccgcgcctgtggcgggcagcggaattggtgaacgccggtgattttcgcgcggcgttggcgttgtatgagcagttgccgcaggatgcgacggtgaagcgggcgcacgcggcggtgtcggtattggcgcggatgtctgtggcggatcggggagaggatccgatcgagaagtcgcgccgggatccagacgatgtgaacaaggcgctggcggcggcggatatgtatgtgttgatgaatcagccggacacagcgctcgcgcaccttgcagcactattgccaaaaccggaggctgcccggcggatcgtggagttgctgaacttgtttgatccgctggacctggtcgcattggaaatcagggcgcaggtggggaatgcaatgagctaagaaaacactttaaatattct

SEQ ID NO: 2682 - protein, 290 aa, Corynebacterium glutamicum
MMDHAHDSCSPTLRRDLEVTGQLQPEKAVDLAAPHEGKVANITKVTSSNMEHTITQASKAKEVVVLIGHSLLPTFQDLEKDILHFQAGNKGRFSVAIVDPDRSADVVARFRPKQIPVAYVVKDGASIAEFNSLNKEPVAQWLDHFVSRETIPNEKEGDVDKQIDPRLWRAAELVNAGDFRAALALYEQLPQDATVKRAHAAVSVLARMSVADRGEDPIEKSRRDPDDVNKALAAADMYVLMNQPDTALAHLAALLPKPEAARRIVELLNLFDPLDLVALEIRAQVGNAMS

SEQ ID NO: 2683 - DNA, 489 bp, Corynebacterium glutamicum
  CDS (101)..(466): RXA02331
tgcagcgtgcattcccaccatcgggtcaagaatctatccgcccagcccctgtccaactcctcaactaaaaaggcagcacttaaaaaacactatggaacccatggaactaaacggcggtcgtttctacgcccgcaagctcacctcagataatcggattgatgatgtcccggcgctctcactgatccttgccgatgcagcacagttcatcgcggacgccaccacagcctggcacgaggacaccgaatacacctgggctatctgcgagcagaccagtgttgaactactggcactggcacgccttgatcccaagcagcgcacactcgaggtcgtgcccgcaggtgatcccgccacccaattgcccaatgatccagtgctcgctccgaaaaccatcggcgatgctgtggcggagggccgcgacaccatcaccagatgggcacaaggctatttagaaatcagcctcactgattaggttctctccgaaatgggcac

SEQ ID NO: 2684 - protein, 122 aa, Corynebacterium glutamicum
MELNGGRFYARKLTSDNRIDDVPALSLILADAAQFIADATTAWHEDTEYTWAICEQTSVELLALARLDPKQRTLEVVPAGDPATQLPNDPVLAPKTIGDAVAEGRDTITRWAQGYLEISLTD

SEQ ID NO: 2685 - DNA, 303 bp, Corynebacterium glutamicum
  CDS (101)..(280): RXA02336
caaatccacacgacacaattacacaaattttaccttgtgcattgaaagccgtcagccgattagcgttaaagaaaataaaaaaccacaaggggagcacaccatgaaagacaccaccgagatcaactggcaaggctacgccgatggaaccgcaatccgcgaagcagtcatccactccattgaacgagaagtatcagcgggcgagcagccaaccccaaacgatcttaaatttctcgggctgttccagcaccgcgccgggtatgtgggctcgttgatcaccggttaagtgtggggagcaggctggct

SEQ ID NO: 2686 - protein, 60 aa, Corynebacterium glutamicum
MKDTTEINWQGYADGTAIREAVIHSIEREVSAGEQPTPNDLKFLGLFQHRAGYVGSLITG

SEQ ID NO: 2687 - DNA, 444 bp, Corynebacterium glutamicum
  CDS (101)..(421): RXA02347
acggttggaacagagctgcacctttaatcaggcagttgctggccaactgagttagcctaaaacgatgaagaaaaatcctttggttgaatgggtctgggttatggatgaactcggggttggctggtgccaatgcgagaaagattccatcaccggaaaagcaccacatcccgtgaacaagccactggtcaccaaatccattatcagggctctaggcgatgtccccgatgtcatgagcaaccaggacatcagccttgtggtggtggatttgtggaaattcgataccattactcctccaatcgcagaatccctcatgcgttccgtcaaagctgttaacggtgagatgcacccgcagtatcccaccgcgacagcaatggctgcgatcaagcatttctccaacacttttgatggacagattaacgcttaaaaggcctgttatagactgat

SEQ ID NO: 2688 - protein, 107 aa, Corynebacterium glutamicum
MDELGVGWCQCEKDSITGKAPHPVNKPLVTKSIIRALGDVPDVMSNQDISLVVVDLWKFDTITPPIAESLMRSVKAVNGEMHPQYPTATAMAAIKHFSNTFDGQINA

SEQ ID NO: 2689 - DNA, 490 bp, Corynebacterium glutamicum
  CDS (101)..(490): RXA02349
cttcgagtgctgtggcgaaaaatccgaactccaaagaactagcctaagaactagccccatgagctatccctcaaaaaattactgatagtgaggttttcgcatgtcaactgcatattttattgcgcacggaaacgatacgtaccgcccaacggagcattccagcggtgcgtggcgcgatgatgaactccaccttgcaccggttgccggtttggtgattcaccatatggaacgttggcgcagggaagtggttggcgatgctttggtgttcagccgttttagtttggaggtcttgggccagatcgctcgggatgatgtcaccttgagaacagagatcgttcgtcccgggcgcaccattgaacttattgaaaccgtggctgaaatcaacggcagagtgacgattcgtgcacgcgcctggttgctgaagacctctgatcttgcccatatttctggcgatacttttgaagcgttgccgtcaatgactgaactggca

SEQ ID NO: 2690 - protein, 130 aa, Corynebacterium glutamicum
MSTAYFIAHGNDTYRPTEHSSGAWRDDELHLAPVAGLVIHHMERWRREVVGDALVFSRFSLEVLGQIARDDVTLRTEIVRPGRTIELIETVAEINGRVTIRARAWLLKTSDLAHISGDTFEALPSMTELA

SEQ ID NO: 2691 - DNA, 578 bp, Corynebacterium glutamicum
  CDS (1)..(555): RXA02352
atctacaacacatcgagcacgctcaacggcttcatcgcagacaaagacaactccctgcaatggcttttcgacgtccccggcagcgacggtgcctctgaagacttcggtaatttcctttcaaaagccggcaccatcgtaatgggatccaccacctatgaatggctgctcaaggacctagatttcatcagcgatccccacaagtggaccgatgtgtatggcgatcgccccacgtgggtgttcagcagcaggaacttggaaaccccggaaggaaaacctgtcaaggtagtaaatggagatgtcgccgatgttctccccgccatactggaagagagtccagagaacactgatatttggatcgtcggtggtggcgatctggcgggtcaattctttgatgcgggtgcactcgatcggatcatcttgaccatggcgccagtgtttctcgatgaagggcagccagcgatgccccgccggatcgaaagtaatcgtctccgcaccgtaaatgtccgcgaggttggacaattcaccgagatcaccctggagacgattaaaggggcttaatttgtagagttttgggcaga

SEQ ID NO: 2692 - protein, 185 aa, Corynebacterium glutamicum
IYNTSSTLNGFIADKDNSLQWLFDVPGSDGASEDFGNFLSKAGTIVMGSTTYEWLLKDLDFISDPHKWTDVYGDRPTWVFSSRNLETPEGKPVKVVNGDVADVLPAILEESPENTDIWIVGGGDLAGQFFDAGALDRIILTMAPVFLDEGQPAMPRRIESNRLRTVNVREVGQFTEITLETIKGA

SEQ ID NO: 2693 - DNA, 1119 bp, Corynebacterium glutamicum
  CDS (101)..(1096): RXA02356
ttggcagtagccatgcgttctgctcctgaccttgaacagcggtcccaatttagacccgctaaacccacaatgtgtactggtgctggtaatttagtagaacatggcaacggtcacattcgacaaggtcacaatccggtaccccggcgcggagcgcgcaacagttcatgagcttgatttagatatcgctgatggcgagtttttggtgctcgtcggcccttcgggttgtggtaaatccactacgctgcgtgctttggcggggcttgagggcgtggagtcgggtgtgatcaaaattgatggcaaggatgtcactggtcaggagccggcggatcgcgatatcgcgatggtgttccagaattatgctctgtaccctcacatgacggtggcgaagaatatgggttttgcgctgaagttggctaagctgccgcaggcgcagatcgatgcgaaggtcaatgaggctgcggaaattcttgggttgacggagtttttggatcgcaagcctaaggatttatcgggtggtcagcgtcagcgtgtggcgatgggtcgcgcgttggtgcgtgatccgaaggtgttcctcatggatgagccgctgtccaacctggatgcgaaattgcgcgtgcaaacccgcgcggaggtcgctgctttgcagcgtcgcctgggcaccaccacggtgtatgtcacccacgatcaggttgaggcaatgacgatgggcgatcgggttgcggtgctcaaggacgggttgctgcagcaggtcgcaccgcccagggagctttacgacgccccggtcaacgaattcgttgcgggcttcatcggctcgccgtccatgaacctcttccctgccaacgggcacaagatgggtgtgcgcccggagaagatgctggtcaatgagacccctgagggtttcacaagcattgatgctgtggtggatatcgtcgaggagcttggctccgaatcgtatgtttatgccacttgggagggccaccgcctggtggcccgttgggtggaaggccccgtgccagcccctggcacgcctgtgactttttcctatgatgcggcgcaggcgcatcatttcgatctggagtcgggcgagcgtatcgcttagtttcggacgtggggaggcgt

SEQ ID NO: 2694 - protein, 332 aa, Corynebacterium glutamicum
MATVTFDKVTIRYPGAERATVHELDLDIADGEFLVLVGPSGCGKSTTLRALAGLEGVESGVIKIDGKDVTGQEPADRDIAMVFQNYALYPHMTVAKNMGFALKLAKLPQAQIDAKVNEAAEILGLTEFLDRKPKDLSGGQRQRVAMGRALVRDPKVFLMDEPLSNLDAKLRVQTRAEVAALQRRLGTTTVYVTHDQVEAMTMGDRVAVLKDGLLQQVAPPRELYDAPVNEFVAGFIGSPSMNLFPANGHKMGVRPEKMLVNETPEGFTSIDAVVDIVEELGSESYVYATWEGHRLVARWVEGPVPAPGTPVTFSYDAAQAHHFDLESGERIA

SEQ ID NO: 2695 - DNA, 414 bp, Corynebacterium glutamicum
  CDS (101)..(391): RXA02358
tgaaggttggacgctgctttttgcaaatgacctcgagacctccgatattcccgctgcccttcgtccctagtacacccaaagtttatgaaagataaaaatcatggtttcttatagcgtgcacggcgcactagatatcgacggcagcctcaaaaaactcaccctcgatttcctcaataaactagccaccaatccagcttccccggggcttcatattgagcccatcaaaaacagcatcgactcccgcgtccgcacaggtcgggtcaatgatcaattccgcgcagtgctttttgagcttcacgacgaatttgatcatcactttgtagtgggtgggtttatccccatgatgatgccatcaccaaggcaggaaaaatccgccttgaagtcaactctgtaacggcattactcgactcatcg

SEQ ID NO: 2696 - protein, 97 aa, Corynebacterium glutamicum
MVSYSVHGALDIDGSLKKLTLDFLNKLATNPASPGLHIEPIKNSIDSRVRTGRVNDQFRAVLFELHDEFDHHFVVGGFIPMMMPSPRQEKSALKSTL

SEQ ID NO: 2697 - DNA, 3822 bp, Corynebacterium glutamicum
  CDS (101)..(3799): RXA02362
acaattgttcccattcgcatatctcgtgtccaccagagtcgctacagtaacgagaaacttaattatttgatccgattcttccgttcaaaggcctcattccgtgactatctctcgccgactcaaacaagagcgcagtttcgctgacgatcttcaagatctcaaaactctcaatgatcaactgcggtttacaaacgccaaattgcaagctcgcatcagtggtattggcaatgatggaaagaaaatcacgcgccctaccccactccttgcgctggattttcagctgaccgttgaagaatacgaaacgatcattgcaatcttggtggaagcagttggcggaaatcaatccaagccagcgattcttaaagatctgtttatagaatatccactcgtcttcctggcagcgctttctggaaccgccatgctcgatgctcaagaaggtttctggcctgcgttctggaaacgcactcaggtgtcagttccagagcatgtatacgacgcgatccgtaaagaactagttaatagcatccgcaaaaatggcctagaaactttttctctcgctgacctcaatcgacgcgaatatgtcggactcatccaacttcacagtggcctttctgcaaaagacatgctcgccttggtcaaatttatcgatcacactcgagcagaaaaccaaggatgggattctggtgaggactttgcatcatatgcgaagagtgtcttctcctccggggacaacctattaaccacggagtcgctcaagcaattagtcacccacatccctgcgcgttccgtcgacttcatcgccagagtctatgaactaaccaattggtaccgcgacctcaaagacctcaatgaagtagaagccttcgtaggtactcatgggctgccggaattgtctttcaaatttcttctggagtgtctgagcggcgaagctgaacaaattgccgaaaagacgaaagcagcaccagcaagcctggaaaacctggaacctccgcatctctatctggatccacagagttttgaactcagtcttgttttcccagcgatctctaaaactgcagcacttcagattccagcaccagaatggacagtgatttatgacggaaactccattaaagttcgtcccgaacaggactggtcctacggaggtttcgccgaataccgtttgcctttagacaaaccgctctccagcttgagagtcatcactccaacagagaaatccctaattctgattgaaggatttggccacaagaatcccattatgttctttaagaacaacggtcagccatatgcaaaccaagaaatgctcagtggcaacgctgtcacagctatagtcccagctgcagcaatcattcgtgcacgtatgcgagcttccaagactttcaactatcaagacttgggtcccttgtccggatggaacaagtgggtcattcgttcgatcccactcaaacgagctgaatcgatcacagtctcccacggtggcttcagaaaagaactcccagttcgacgcaaagttgatgttcaatggattactgaggatctcacgatcgagaatcttcaaggtctcgatcatgagcccgttttccacacgagtccccgcatcgaattccccacctctggatcaaactgggtaattcagtattcacagattcttccagatggcagcctcatcgaaatggaagattacccagtcgaacctgaaaacttcggatacgaactagacctcttcgaagaatccgacgacccttgggtcgggcaatttttagtaactctgctcaaggatgaaaaagtctatgaaacccgcaaattcaatctcgcggaaggcctcgatctttccctaacattcagcggaggcggacctgaaaatcgatttaggtaccccagcatcaatcagggacaaactggcttaacaaagactttcgcccgttttagttccaattctgaaaagcacatcaggttcccagatgagatcatcgggcttgatgcattcacctctcaaaaagcgtttaacatcgcaagcggtgatttccctgaggactacaacctcgacgttttcatcacgcctccgcaacttcactaccaagtacctgtcacacacagccaaacaaagtgggaaagcacaaagacgacactagatttcaatgactttgccgatggaaacctccagatcagattccctaatgaagtctatgatccaaacttgaaaatcattaaaatggtggcatacaagaaacctgagtccagtgagcctaaatacttaagcaaaattggttcaagcaaagtgtggtctatccctatggatcgcatcaaggaactcatggatgatgatgcccaattccttttgatcgcggagtggttcgctgaaagtaaagaccagcaccgagagaagatcattagcgaagctaagcgaactggaaaaatctccaatgcagcgcttaagagtgctcgtcctcaacctcaagcaagttcccacattgcaacaattgagaaaaagcccctactagctgcggctgaaattaagctttctaccgtggagttggaacttggtcggcacacttctaagagactggaaggctgggcatggtctgcgctcaacccgcttgatccaccaatcaaagtcgatttccaaggaacctcaggctcacttccagacacccacttcgtcgttggccctttaatcgtggaagtgagagaaaaagagtttctctcccaatggcagccaaaagttccctcagttaaagccgtggttgcaaatgatccctcatttgaattggaccctcaatttgatcctttcctcacacaccgatggatgttcgctccacgaagtgggaaggtcttactcccacaagaaatccgcacagtgtgggacgcccgattcaatatgcgccatgtcttagcgcagcgtgaaaaccttcatgtgaaatcgattcaagattttgacgatgccaccagtacctatctcaccagtgatcctcgggtggcattagatgaattggataagagctcaattccgtctaattcccactttgaatcattcatccgatccggattagctgagctttctttcgaagttgacgacacagccggagatatccatcgcgttccctggatcggcctgatccaggaaatgaacgacctcagaattctgcagatacaaggctatgaaacagaagaacgagccatcgaacgccgaaattcgcagagctacatccgtgagataggaggcagtgaattgtggaatatcctaaaaggaaattcagagggattgtctcttgctcaaaaatgcgcaccacaagccactgagattaatgtgattcgtaattcaggcttggaagctatgcgcaatgggctgggcgccgatcagttcagcgccgagtttatttcagcagactcacgcctacgagctcagcttgaatggttggaaaaccgccgagagctcaatgatctcggccagctcccaacgctcttcgatttcgccgagaaatacgagtacctcatcgatcacttaggtgatgatcgcatcaaggtcactgcacgtgagctgtctactcttgcgtcggaacaccgtcgcggcaacgctgaaaactggctttatgcaccatatgtgtcattcatttacagcttgcttaaccgaatgatcgctcatgaagtaatacgtccgatcgctcagatcaattactcacggcacgattgggcaaacgctgctcggctgattcctcgtctcacaggatttgacctggtgagtgccgaagcgaaagtgctcagcgcaataaacaacaacaatataatcccaactgcaatttaaggatcactatgtccaacgca

SEQ ID NO: 2698 - protein, 1233 aa, Corynebacterium glutamicum
VTISRRLKQERSFADDLQDLKTLNDQLRFTNAKLQARISGIGNDGKKITRPTPLLALDFQLTVEEYETIIAILVEAVGGNQSKPAILKDLFIEYPLVFLAALSGTAMLDAQEGFWPAFWKRTQVSVPEHVYDAIRKELVNSIRKNGLETFSLADLNRREYVGLIQLHSGLSAKDMLALVKFIDHTRAENQGWDSGEDFASYAKSVFSSGDNLLTTESLKQLVTHIPARSVDFIARVYELTNWYRDLKDLNEVEAFVGTHGLPELSFKFLLECLSGEAEQIAEKTKAAPASLENLEPPHLYLDPQSFELSLVFPAISKTAALQIPAPEWTVIYDGNSIKVRPEQDWSYGGFAEYRLPLDKPLSSLRVITPTEKSLILIEGFGHKNPIMFFKNNGQPYANQEMLSGNAVTAIVPAAAIIRARMRASKTFNYQDLGPLSGWNKWVIRSIPLKRAESITVSHGGFRKELPVRRKVDVQWITEDLTIENLQGLDHEPVFHTSPRIEFPTSGSNWVIQYSQILPDGSLIEMEDYPVEPENFGYELDLFEESDDPWVGQFLVTLLKDEKVYETRKFNLAEGLDLSLTFSGGGPENRFRYPSINQGQTGLTKTFARFSSNSEKHIRFPDEIIGLDAFTSQKAFNIASGDFPEDYNLDVFITPPQLHYQVPVTHSQTKWESTKTTLDFNDFADGNLQIRFPNEVYDPNLKIIKMVAYKKPESSEPKYLSKIGSSKVWSIPMDRIKELMDDDAQFLLIAEWFAESKDQHREKIISEAKRTGKISNAALKSARPQPQASSHIATIEKKPLLAAAEIKLSTVELELGRHTSKRLEGWAWSALNPLDPPIKVDFQGTSGSLPDTHFVVGPLIVEVREKEFLSQWQPKVPSVKAVVANDPSFELDPQFDPFLTHRWMFAPRSGKVLLPQEIRTVWDARFNMRHVLAQRENLHVKSIQDFDDATSTYLTSDPRVALDELDKSSIPSNSHFESFIRSGLAELSFEVDDTAGDIHRVPWIGLIQEMNDLRILQIQGYETEERAIERRNSQSYIREIGGSELWNILKGNSEGLSLAQKCAPQATEINVIRNSGLEAMRNGLGADQFSAEFISADSRLRAQLEWLENRRELNDLGQLPTLFDFAEKYEYLIDHLGDDRIKVTARELSTLASEHRRGNAENWLYAPYVSFIYSLLNRMIAHEVIRPIAQINYSRHDWANAARLIPRLTGFDLVSAEAKVLSAINNNNIIPTAI

SEQ ID NO: 2699 - DNA, 744 bp, Corynebacterium glutamicum
  CDS (101)..(721): RXA02374
acccacaacagacatattttctccttgatgcgcaccaaaatgcgccttaggttgagatgaattggatagcccaccgtacgcctatctacactgaattaccatgagctatgactttgtcctctttgaaaccgatggcgacccaggtagcgcccgtatttccaaaaccccactgaccgaacgcatcgatttcgccacgccatctacaacccctgtgttggaatctctttcggcagggcttgccgaaacggtgccagacaccgtcaagcttgaagaagacgccatccacttatccggtgatcgttgcctttacgttgtgaccaactacaactccgccgaagaagcagccgaatggctcaccgccatcgctttcgattacggactgggccttgccgacatgaacgcggacaccatcctgcttttcggcgatgaagattccgacgctgtcgtccaaatcgatgactggttctcccccgctttctctgcgtacggccttccccacctcctggtggaagtcatgcgcctgaaggattccaaaaccccttatcttcgagtcacacttgctgcagatgactcgaaatttatccaaaccctttacgaaaccgacaacaaacaatggttggtggaaacctcttcctccacaggcacggacgaaacccacgtgaagaccattaatgatgtgctggaacgcatcgagacatggttcaaccaggagactgctgtctaaaccttttgtcgtgttctggg

SEQ ID NO: 2700 - protein, 207 aa, Corynebacterium glutamicum
MSYDFVLFETDGDPGSARISKTPLTERIDFATPSTTPVLESLSAGLAETVPDTVKLEEDAIHLSGDRCLYVVTNYNSAEEAAEWLTAIAFDYGLGLADMNADTILLFGDEDSDAVVQIDDWFSPAFSAYGLPHLLVEVMRLKDSKTPYLRVTLAADDSKFIQTLYETDNKQWLVETSSSTGTDETHVKTINDVLERIETWFNQETAV

SEQ ID NO: 2701 - DNA, 792 bp, Corynebacterium glutamicum
  CDS (101)..(769): RXA02390
gctggtggtgctgacccatacgctggaactccaactgctgttgataccgccaagatgtttggccgcgaggatctcgtagctcgcttcgagtcataggccggtggagtggaccgcttttggcaccctgattctgctcaatttggtgggcagtttatccccggggcctgatacctttttcctcctccgcttagccacccgctccagagcgcacgcgatcgctggcgtcgccggcatcgtcaccggactcacggtgtgggtgacgctgacggtcgtgggagcagcggcgctgctcaccacttatccgtcgattctcggaatcatccagctcgtcggcggcacgtacctaagcttcattgggtacaagttgctgcgctcggcgtcgagagagcttatcgacgcccgccagttccgtttcaacgccgatgcccgacctatcccggatgcggtagaagcactgggaacccgcactcaggtatatcgacaaggtttggccaccaacctgtcaaaccctaaagttgtcatgtacttcgcggcaattctggctccgttgatgccagcgcacccatcaccggtgctggcgttctctatcatcgtggcgattttagtgcagacctttgttaccttctctgctgtgtgcctcattgtctctacggagcgtgtgcgcaaagcaatgctgcgtgcaggtccctggtttgacctgcttgctggcgttgtcttcctcgttgtgggtgtgactctgctgtatgaaggcctgaccggtttactcgggtaaaggcataaaaaatggcttcc

SEQ ID NO: 2702 - protein, 223 aa, Corynebacterium glutamicum
VEWTAFGTLILLNLVGSLSPGPDTFFLLRLATRSRAHAIAGVAGIVTGLTVWVTLTVVGAAALLTTYPSILGIIQLVGGTYLSFIGYKLLRSASRELIDARQFRFNADARPIPDAVEALGTRTQVYRQGLATNLSNPKVVMYFAAILAPLMPAHPSPVLAFSIIVAILVQTFVTFSAVCLIVSTERVRKAMLRAGPWFDLLAGVVFLVVGVTLLYEGLTGLLG

SEQ ID NO: 2703 - DNA, 405 bp, Corynebacterium glutamicum
  CDS (101)..(382): RXA02393
  misc_feature 17,20,24,26,39,41,58,67,68,82,85: n = a, t, c, or g
gccaccttcatttttcncangccncngcaaatcagaacncnaccttctggcactcccngctcaaatnngggacgtccatgcngangttttagacatcttcatggcggaatctttagtgattatcaacatcgacgagaaaagcgccaagctgcttatcgacgccgcccgccaccacatccccacccgcttcaccgggcccaacgcccggccgctcagcgtcatccccatcgaggatccccgctcacgcccgacgctccacccagatcatggttggatgatgccgctaagcccaccagtggtggatgaactgcttggcggtggcttgaaaattggagaaacagaactagaaagcaccaacattgcgttcattgttgatgcttcctaaaaatcctgtgccgtgaggtt

SEQ ID NO: 2704 - protein, 94 aa, Corynebacterium glutamicum
MAESLVIINIDEKSAKLLIDAARHHIPTRFTGPNARPLSVIPIEDPRSRPTLHPDHGWMMPLSPPVVDELLGGGLKIGETELESTNIAFIVDAS

SEQ ID NO: 2705 - DNA, 755 bp, Corynebacterium glutamicum
  CDS (1)..(732): RXA02395
ctcatcaccatggctatcccctccttcattttgatcctggcgttcaccattttcggtggaactgccatcacgatgaaccgcgagaacgtagatggttttgacggcagttcatccaaggaacaggtgctgtttgatatgttcagcaaccttccgctgtactcgatcacaccgttcattttgatctttgtgctggcagtattctttgttacctctgccgattccgcctccgtggtgatgggaacgatgagctcccaaggtaaccctgcaccaaacaaattaatcgtggtgttctggggactgtgcatgatgggcatcgcggtggtcatgctgcttactggtggcgaatccgcgctgactggtctgcagaacctcaccattttgatcgccattccgtttgcgctggtgttgatcgtgatggctattgcctttattaaggacttatccacagacccagccgctattcgacaacgctatgcaaaggcagccatctctaacgcggtggttcgtggcttggaagaacacggcgacgacttcgagctctccatcgaacctgcagaggaaggtcgtggagcgggtgctaccttcgattccaccgctgatcacatcaccgactggtatcagcgcaccgacgaagaaggcaatgatgttgattatgacttcaccaccggcaaatgggccgatggttggacaccggaatcgaccgaagaaggcgaagtggacgcgaaaaaggattaaaaaataacgactggctggga

SEQ ID NO: 2706 - protein, 244 aa, Corynebacterium glutamicum
LITMAIPSFILILAFTIFGGTAITMNRENVDGFDGSSSKEQVLFDMFSNLPLYSITPFILIFVLAVFFVTSADSASVVMGTMSSQGNPAPNKLIVVFWGLCMMGIAVVMLLTGGESALTGLQNLTILIAIPFALVLIVMAIAFIKDLSTDPAAIRQRYAKAAISNAVVRGLEEHGDDFELSIEPAEEGRGAGATFDSTADHITDWYQRTDEEGNDVDYDFTTGKWADGWTPESTEEGEVDAKKD

SEQ ID NO: 2707 - DNA, 402 bp, Corynebacterium glutamicum
  CDS (101)..(379): RXA02396
gagtgcttgtaggttgatagaaagtaaactaaagtaaacatcaggttaacagccgggggttcaagtattaactccctcggaaacagaaaggaacacgacaatggctaccacagcttccaagatctccacgatccgtccagcacagcaagatgctctttggagcgtacgtgaggatcttcacgctcgcttcgatggcctggtcgatcctgtccaggtagacgcaattttggaccatgtcgcatctaaccgcgaagccaagatcaccgtcttcagcaagattttcatcgctcgcgaggcaaccgctgcacttcagcagattgctggcaacgttaacgcagacctgcttgacttcattgccctcaaccgtggcatggcagcataagttttagctgcccataaatt

SEQ ID NO: 2708 - protein, 93 aa, Corynebacterium glutamicum
MATTASKISTIRPAQQDALWSVREDLHARFDGLVDPVQVDAILDHVASNREAKITVFSKIFIAREATAALQQIAGNVNADLLDFIALNRGMAA

SEQ ID NO: 2709 - DNA, 888 bp, Corynebacterium glutamicum
  CDS (101)..(865): RXA02403
gcacagaattaaatcgctggtgtgcgaactttcataccttaacgcagtagtgatgcttaaggcacaacgtgggggcaattccggcctatactttggaagtatgactacttttattacctccggtggcttggaaatctcccccgctggcgctcatattgttcacgccgaatcacctgaaggtgagctgttgtttgttagctccgcttcccaatatggggagggaaatgcaattaggggtggtgtgcccatcattgctccatggtttggtggactgcttggtttggaccctgcacatggttgggcgaagcgttccgcgtgggacgtgactgaacatgacggccaaattcacgctgaatatggccgcgatggtttactgctggatattcgtgcgaacagcactaagaatggttttgagatcaccctgcgcgcttacaacgacaccgatgaggcacgcactgtgcagttggccttccacccttatttcaaggtggatgatgtagaaaagatcgaggtccgtggccttgatggggtggacattctcaatcgcctgaacaatgaggtggagacccaagatggtcccgttacttttgatggcgagttcgatcgcattgcgctagggactccggttgtgaggatttttgataccgatcgcatcatcaccattgagggcgatggtcatgattccactgtggtgtggaatccaggcgaaagtcgcgcctccaccgtggccgatattggcgaaggtgaatggcgcgactttgtgtgtgttgaaccggcgcttttgggtgctgaccaaaaaggagtgagggtggctccggggcagtcagtcaccgttgggatgcaggtaagcgtcgaaaagcgtgcttagttttttgctttgaactcgcg

SEQ ID NO: 2710 - protein, 255 aa, Corynebacterium glutamicum
MTTFITSGGLEISPAGAHIVHAESPEGELLFVSSASQYGEGNAIRGGVPIIAPWFGGLLGLDPAHGWAKRSAWDVTEHDGQIHAEYGRDGLLLDIRANSTKNGFEITLRAYNDTDEARTVQLAFHPYFKVDDVEKIEVRGLDGVDILNRLNNEVETQDGPVTFDGEFDRIALGTPVVRIFDTDRIITIEGDGHDSTVVWNPGESRASTVADIGEGEWRDFVCVEPALLGADQKGVRVAPGQSVTVGMQVSVEKRA

SEQ ID NO: 2711 - DNA, 603 bp, Corynebacterium glutamicum
  CDS (101)..(580): RXA02412
tgcggtgcgagcaacttcggagactattggctctcctacagctgtggcatccgcgaaacgttcacccaaaggcagtctcattgggttgatcttgatcttggtggccatcatcgtgattgcgtttgtcttgttgttcaacagcctcgttgcaccaaataattcctcgagccctgtggcaagtccaagcacctctgaatctgtggagcaaactatttcggaatcccctgagtcaccgagcgcgacagaggatcagcccccaagcagtgcaacggaaactccccgaaaccgccctgcgcaaccatcacttcctgcgggagcatcaccagccaatgatgctgctgccacccagaccgatgccggcaatttaaacaatgtgtacaccgggtcagcgtccacctcagcaggttttgctcaagccgtccgagatgcttttgtaaaccactatttagacaccaatgaactatccggcagggtgacagccaccagccctgtcactggcggaaactacaccatgaactgcgaagacaacggcgagtacgtcacctgcacaggtggcaacaacgccgttgtctacatttcttaaaacttctaactacacccggg

SEQ ID NO: 2712 - protein, 160 aa, Corynebacterium glutamicum
VAIIVIAFVLLFNSLVAPNNSSSPVASPSTSESVEQTISESPESPSATEDQPPSSATETPRNRPAQPSLPAGASPANDAAATQTDAGNLNNVYTGSASTSAGFAQAVRDAFVNHYLDTNELSGRVTATSPVTGGNYTMNCEDNGEYVTCTGGNNAVVYIS

SEQ ID NO: 2713 - DNA, 2247 bp, Corynebacterium glutamicum
  CDS (101)..(2224): RXA02417
cgctgttcagaggacttccgcgggggtcgacagtataacgaattagcgtcactagaataatcgggctgtttagttcttcacaccaacataatcttatgtaatggacatgaactcttctgaccgattggctctacgcaccgcgttagagaaattgtcggcatcggctaccgccatggcgtcagcgagcaatgacatcaaagatctcgttgcacgccttgatgcccaagagatgtcgcttatcgacgcaaacccggctcccaccccagcgcccactgccccacccgaggctcagcttgagccccaaccactggtgtatgcaaccgcctcaacggcgcctgcactggcggatgtttccgggaccaaccgtattccacgtttcgttcggcatcgcgccctggatccagcgagcgaaggctggccacttggcgtcgagaagcaaaaagtgcaggctcctgcgtacccgcaccccgtccggccagctcgtccggcaaagccgccgatgacgtcggaggaaaagatcatgcgtggcgtggcgatcggcggtggtgtgatcaccgtggccggcgtgattttgctggtgtcggtggcgattcaacgcggttggcttggtccgctgggtcgtgtgattggtgcgtacctgctggcggtgctgcttcttggcgccgcacattatgtgcgcaagcgcggaacccgtgtggaagcactcgttgcgttgacggttacctcccagattgcgtttcttgccacaacgagtgcaatcatcttcattttggaatggtggccgcctggattgggctcgctggtggcattaataggcaatattgggttcttaatcgttggtcgattgtggagcctatccaaaaccgagaagtccgcggccgaaggccacacagtatttgtgggagccatcgccgtttcaggattctccgcgatactcttcgcgctctccgccgatgcctggtggccaattttctccattgttgcggcattgttgctgtcgtaccgcatctccacgaatatcatccgagcgagcatggcggcattcgcggtcattctgcagtttgttttgtcggcatcctggcaaaccatggaatggccagcaacaatcgtcggcacaattactgcagtcctactcgtagccttgacattgtgggatccgtttaagatcaccgccaccgacagccacgacatcgcgttggaggaatactggcgcagctttgaaaccaaccctgtttccacgtgggtgggtgctgtttctccggtgctcatcgtgttcatcaccaccagcatgttcattgcagtcgactggccatggcttgccctgataccagcgtgtgcggtggcagctctcggaattttcgcgctgcgctcatcagacaccgcgtccattgaaaatcaacgcatgtctcgcctcattgctgttgttggccttgcgttgattgctgaaacttttgtccagctgttctacggcgatctccccaccaacccgcttctcgtcatggtgttcctcatcgccggagctgcactatttatgtggttgcggatgcttccaccgcagcgtcaattaggtgtcgtcccatgggtcgcttggctgattgccgccgtggcgatgaccggcgtgctactgcgcaatgtcgtttcaatttctccactgtggctcaccgatacccaagcgctcatccaagcattgctgatcttggtgttcattgccgccacaatccaagtccgccgcagcttctacggacacaaactgtggctgcaaattttggtcggcttgacgcttctcacgctgtccgcaatttccatcgtgaccatcacaaccttcatcggtcgcctcatcgcaggaaatgccggcatgatgctcggattcctcatcggccacgccacggtttctatcctgtggatggtcatcgccgcagcactgatgcttaataggaagcttctcgacgcgcccggcgccctttggaccggcgttggcttggcggttgcgggcaccttcaagctggtgttctttgacctggtcgcgctgtccggagttccccgcgcaattgccttcctgctctccggtatcgcactgctgacaatcgctgctatgaggggccggagaacctcagaaaacaaggccgacgtagctagacctcaggtggctagacatggggcgactagccataaaaatgaggagccttcccatgaaagcccctcatcttctcctacaacaactctttaaggaattggccggtgtaggaa

SEQ ID NO: 2714 - protein, 708 aa, Corynebacterium glutamicum
MDMNSSDRLALRTALEKLSASATAMASASNDIKDLVARLDAQEMSLIDANPAPTPAPTAPPEAQLEPQPLVYATASTAPALADVSGTNRIPRFVRHRALDPASEGWPLGVEKQKVQAPAYPHPVRPARPAKPPMTSEEKIMRGVAIGGGVITVAGVILLVSVAIQRGWLGPLGRVIGAYLLAVLLLGAAHYVRKRGTRVEALVALTVTSQIAFLATTSAIIFILEWWPPGLGSLVALIGNIGFLIVGRLWSLSKTEKSAAEGHTVFVGAIAVSGFSAILFALSADAWWPIFSIVAALLLSYRISTNIIRASMAAFAVILQFVLSASWQTMEWPATIVGTITAVLLVALTLWDPFKITATDSHDIALEEYWRSFETNPVSTWVGAVSPVLIVFITTSMFIAVDWPWLALIPACAVAALGIFALRSSDTASIENQRMSRLIAVVGLALIAETFVQLFYGDLPTNPLLVMVFLIAGAALFMWLRMLPPQRQLGVVPWVAWLIAAVAMTGVLLRNVVSISPLWLTDTQALIQALLILVFIAATIQVRRSFYGHKLWLQILVGLTLLTLSAISIVTITTFIGRLIAGNAGMMLGFLIGHATVSILWMVIAAALMLNRKLLDAPGALWTGVGLAVAGTFKLVFFDLVALSGVPRAIAFLLSGIALLTIAAMRGRRTSENKADVARPQVARHGATSHKNEEPSHESPSSSPTTTL

SEQ ID NO: 2715 - DNA, 933 bp, Corynebacterium glutamicum
  CDS (101)..(910): RXA02421
cggtgtactttagcaacaaggaaaaataactatctacggcctgttaatagttcaacctacaggccaaacccgccttcattaatgaattgtgagatcgaccatgacattgctcttgaagccaattttgcaggctgcgggaatcaatcctgaagatgcgttagcaatgcgtcatgtatttatttcgatccacgaggacaccaattccaatggtattacccgtgaatctaaagacgaagagattctcgcctacacagctagccagtcaagtgatccgcgtagattcccactgaatccgccacgcttttggatggtgttcatccgagaaggtggctcgcaggctcgactatggaaagtggtggaaaaccacggcgaagtcaccaatgatggcgtacgcagagtcttcaaccttactgagattgaactcatggatgaccttgcaggcagactcgttattcgttggaattcaccacgcaagtggtggattaagggcactactgctgccctatacaccgtggatactattgccgatgcggagcctattccgtttccaggtttcgacaatcttgtcctgagctacccatttcttcaagaagtgatgcgtgaacctgcctatgcttcgtggcgcacagctcttggtgctgtcaaaggtatttacctcattaccgatacccgtactggccgccactatgtcggcaaagctgaaggactagaaaacatacgccaacgctggaacagctacgccaccaatggacatggcggaaacgtaaaactcaaacagcttaagcccgacacatttcgtttttcgttgcttcgggtctttgatcccgcaactccaactagcattattaacgctgctgaaagccactttaaaattgctctcgacacgatcaagcacggattaaacgcaaactaatcgcagctccccaaccccaa

SEQ ID NO: 2716 - protein, 270 aa, Corynebacterium glutamicum
MTLLLKPILQAAGINPEDALAMRHVFISIHEDTNSNGITRESKDEEILAYTASQSSDPRRFPLNPPRFWMVFIREGGSQARLWKVVENHGEVTNDGVRRVFNLTEIELMDDLAGRLVIRWNSPRKWWIKGTTAALYTVDTIADAEPIPFPGFDNLVLSYPFLQEVMREPAYASWRTALGAVKGIYLITDTRTGRHYVGKAEGLENIRQRWNSYATNGHGGNVKLKQLKPDTFRFSLLRVFDPATPTSIINAAESHFKIALDTIKHGLNAN

SEQ ID NO: 2717 - DNA, 653 bp, Corynebacterium glutamicum
  CDS (1)..(630): RXA02425
cccggcgcctttgatgaattaaccagtgtttggggagaaaaaggcggaagttgggccgctgttatcggcttcttcggtggcatcgcgctgatcgccatcatcgaccgcttagtccccacggcgattaacccccacgagccctccaccgtgggaggcgccgttgaaggattcgagcgccgcaaccgcatgatgaaaatgggtgtgctcactgcgctggccatcgcgatccacaactttcccgaaggtttcgctacattcttggccggattgtccgatccaatgatcgcgatccctgtggccgtggcaattgccattcacaatattccagagggcattgcggtgccggtgccactgagggaagctacagggtcacgtcgaaaagcattaggttgggcgaccctctccggccttgctgagcccgccggcgccctcatcggattcctgctgctcatgccctttatcggaccagaagcactcggcctgtgcttcgccgcagttgccggcgtgatggtgttcatcagcgtcgatgaactactgcccactgccatctccagcggcaaacaccacaccgccatctacggactcatcgctggcatggcagtcatggcgatcagcctgctgctgtttatctagcgttcagccgcaacaagcat

SEQ ID NO: 2718 - protein, 210 aa, Corynebacterium glutamicum
PGAFDELTSVWGEKGGSWAAVIGFFGGIALIAIIDRLVPTAINPHEPSTVGGAVEGFERRNRMMKMGVLTALAIAIHNFPEGFATFLAGLSDPMIAIPVAVAIAIHNIPEGIAVPVPLREATGSRRKALGWATLSGLAEPAGALIGFLLLMPFIGPEALGLCFAAVAGVMVFISVDELLPTAISSGKHHTAIYGLIAGMAVMAISLLLFI

SEQ ID NO: 2719 - DNA, 510 bp, Corynebacterium glutamicum
  CDS (101)..(487): RXA02427
agcgatgctgacagtgcttcacttcgggccgcatctaattcctgctcgattacccaactgctcgcgcagggaatcgtcatcgacgacgaggtgaactagcgtggattttgagttgggtaaacgctgcccctgcggaactggccttacctacggtgagtgctgctaccgctttcactccggcgaatgggtggcccccaccgctgaagcgctcatgcgatctcggttcaccgcctttgctgttggaaattcccagtaccttcttgacacttgggatccagaaacccggccaagcgaactcggcctcgatatgggaattgatttctaccgcctcgacatcctcgagaccaccggcggtggacccttcgattccaccggcaccgtaaaattccaagccttctacaaggggctcgcctccggcgtccaagaagaagactccacattccgcaaggtcaacggcgcgtgggtctattccacaggagatgtcgactagtttccccacacgtgcaatag

SEQ ID NO: 2720 - protein, 129 aa, Corynebacterium glutamicum
VDFELGKRCPCGTGLTYGECCYRFHSGEWVAPTAEALMRSRFTAFAVGNSQYLLDTWDPETRPSELGLDMGIDFYRLDILETTGGGPFDSTGTVKFQAFYKGLASGVQEEDSTFRKVNGAWVYSTGDVD

SEQ ID NO: 2721 - DNA, 309 bp, Corynebacterium glutamicum
  CDS (101)..(286): RXA02430
cttgtagtcaagcgtggaccaaatgcaggcgctcgattccttctggaccagccaaccacgaccgctggtcgtcacccagaaagtgacatcttccttgatgatgtcacccgtttcacgtcgccacgcagagttccgcatcaatgaaggtgaatttgaagtcgtggacgtagggtccctcaacggaacctacgttaaccgcgagccacgcaacgctcaggtcatgcagaccggtgatgagatccagattggcaagttccgcctggttttcctcgcaggccctgctgagtaaaaacacttcctaggaaagtt

SEQ ID NO: 2722 - protein, 62 aa, Corynebacterium glutamicum
MSPVSRRHAEFRINEGEFEVVDVGSLNGTYVNREPRNAQVMQTGDEIQIGKFRLVFLAGPAE

SEQ ID NO: 2723 - DNA, 723 bp, Corynebacterium glutamicum
  CDS (101)..(700): RXA02433
aggcacgagatcatccatcgtcggttccatagaatgggtagctgtcgaatgctgatagatatttggtgaccagagattagagcaaaggatcattttcatcgtgaagcttttcaaggcaaccgcagttacttttactgttgcagcagcattggcgctcagcgcgtgctccagcagtgatgattcctcttcggagtcaagcacctcttcttccacctcttcggctgcgtctgatgctgcgactcagtacccaactgctgaggaactgaatgcaattttggctgtggcaaccgaccctgaggcaccaatcgaggagaaggtgaagactgttcagggttctgagaacgctcctgagctgtttgagaccatgactcaggcaaaggtggagtcgggtgctgagttccaggttgttggttctgtgcttcctggctatgacccaacctctgaggttctgaccaccgtcatgttccagcttccggaccgcgctgagcaggaagctgaaggcgtggagtttgtgaacactgatggtaattggcagctgtcccaggattgggcttgtatcttgatcaccaatactgttgctcctgagcaggttcctgcaatgtgtgttggaactgatgcttcttccgctggtattgaagaggccccagctgaagagggtgctgttgttgaggaagcccctgttgaagaggttcctgttcagtagggtttaacggctcaggctga

SEQ ID NO: 2724 - protein, 200 aa, Corynebacterium glutamicum
VKLFKATAVTFTVAAALALSACSSSDDSSSESSTSSSTSSAASDAATQYPTAEELNAILAVATDPEAPIEEKVKTVQGSENAPELFETMTQAKVESGAEFQVVGSVLPGYDPTSEVLTTVMFQLPDRAEQEAEGVEFVNTDGNWQLSQDWACILITNTVAPEQVPAMCVGTDASSAGIEEAPAEEGAVVEEAPVEEVPVQ

SEQ ID NO: 2725 - DNA, 933 bp, Corynebacterium glutamicum
  CDS (101)..(910): RXA02437
gcccatcataactacatcgagcgaaatgccaaccacatgtcccatgcttttactaatgtggggtcttagaagaacgcgaccaatttaaggagagttgaatatgagcacgattggcaacctcaagttagtagtggatggcgcacgtaaagcttatggaacttatgcggattaccgcgaccgcaaggtgtctgagacttatgatgcgttgtcccaagctgctggtgaatatgcaccaaaagctgagcaggctgtagagactgcgcgggaatcagcgaaggaattttatactgagtcgcgcgataaggctggaaatgtcaccaaggctgctcgtgctcgtctggaaaaggcgctcgctgaggctgacaagcagggcacttctgcgttgaaggacgcacgtgaatcgggcaagaaattgaaccggaaggcgcgtcgaaaagcagacaaggccgctaaggcagcccgcaaggcgactgaaaagaaggagtcgcactgggtgcgcaatctgtcgttggcggcgctagcgacctccggcatcgtcgcggtggcctacgcgtttttgaacaagaccaagaaggaaaccccaggcacccagcctccacgggttgaggttcagttgaagaaggccgtggagcaggatgagcctgaggttgtggctgaggctgctgtggaggagccagagttggtgtactccacagaaagcccagaaaccactgaagccccagctgaggccaccgaaactccagcagaaaccaccgaagaagaagccaaaaccgaagctgaactagaggcagagctcgaggctgaggccgatgcggagcaggaagcggcagaagaggcggaagctgaggccattcaggctgagtttgataagaagaatgcacctcagcgcacccagagcgaaaagaagaagtaggttaacgcttcaattcgtgg

SEQ ID NO: 2726 - protein, 270 aa, Corynebacterium glutamicum
MSTIGNLKLVVDGARKAYGTYADYRDRKVSETYDALSQAAGEYAPKAEQAVETARESAKEFYTESRDKAGNVTKAARARLEKALAEADKQGTSALKDARESGKKLNRKARRKADKAAKAARKATEKKESHWVRNLSLAALATSGIVAVAYAFLNKTKKETPGTQPPRVEVQLKKAVEQDEPEVVAEAAVEEPELVYSTESPETTEAPAEATETPAETTEEEAKTEAELEAELEAEADAEQEAAEEAEAEAIQAEFDKKNAPQRTQSEKKK

SEQ ID NO: 2727 - DNA, 1077 bp, Corynebacterium glutamicum
  CDS (101)..(1054): RXA02443
caagcactgccgcgggagccactatcactttgttaagtgctgcgatattttttgccaccttattgacaaagagtgccattagtaggttaaacttcaccgcgtgatactgaaagacattttcaataatggggagctctttggggcttcctccgcgaaaaatttccgaaaactactagctgttccagccgttgccgcctcactagcttttggtatcaccgcctgttccgctgtagatgacacccctgacattgtggtcaccaccaacatcctgggtgatgttgtaagccatatcgtgggagattccgcagatgtccaagtactcatgaaacccaacgcagatccacattccttcggagtctcagcacaagacgccgctgccatggaacatgccgatctcatcgtggccaatggactaggacttgaagagggccttcaatccaatgtggacaatgccaaaagccaaggggttcccgtcttggaagtcggcgaacacatcgatgtcattgactactcccccggcgttccagatcctcacttttggacagacccggcgcgcatgatcgccgccacggaagttatagaagctgaactgatcaaagaactcgatccttccctgactgaatcgatcacacaatcagcccagcactaccgtgaggaacttgttgcccttgatgaggaagtcaccgaattgctcagcggcgtggccccagaaaaccgcaagctggtaaccaatcacaatgtttttggatacctggccagccggtttaactacaccgtcattgacaccatcatcccaggtggaagcacattggcggcgccttcagcatctgacctcaatgacatctccaccgccatcgaagacaacaatgttcccgcaatcttcaccgatacctcaagcccacaacggttagctgaagtgttggccagcaacgctggcattgatgttcaagtggtgtccattttcacggaatcactcaccgatgcagatggtgaagcacccacctacatcagcatgcaaaaaatcaatgccgagcgcattgcaagcactttgtcctaaacagtcctaaacagtcttaa

SEQ ID NO: 2728 - protein, 318 aa, Corynebacterium glutamicum
VILKDIFNNGELFGASSAKNFRKLLAVPAVAASLAFGITACSAVDDTPDIVVTTNILGDVVSHIVGDSADVQVLMKPNADPHSFGVSAQDAAAMEHADLIVANGLGLEEGLQSNVDNAKSQGVPVLEVGEHIDVIDYSPGVPDPHFWTDPARMIAATEVIEAELIKELDPSLTESITQSAQHYREELVALDEEVTELLSGVAPENRKLVTNHNVFGYLASRFNYTVIDTIIPGGSTLAAPSASDLNDISTAIEDNNVPAIFTDTSSPQRLAEVLASNAGIDVQVVSIFTESLTDADGEAPTYISMQKINAERIASTLS

SEQ ID NO: 2729 - DNA, 1401 bp, Corynebacterium glutamicum
  CDS (101)..(1378): RXA02444
aaaatcaatgccgagcgcattgcaagcactttgtcctaaacagtcctaaacagtcttaaacagtccccgttttactaaatgttttactaaaaggagaaccatgaaaaactccaagctacttcttattgctgcggtatccaccgcatctatcctgctggcaagctgtggcactgacagctctgcagatactgcaactgcgtctagctctgcaacagcaagctccgaggcacacgatcatgatggccacgaagccgaaggcagcagcactgccgttgaggtgtcctccccgcaggcccgcatcgtcaccacctacgacggtggcatcattaccctcgacgccaacactctggaaatcctggaagacaccgaactagcaggttttaaccgcctcaacagtgcaggagacggacgccacgtatttgtctccacaggtggcggcttccagctctttgataccggcgcatggaccgaaccacacggcgatcacacccacagctacaccgccaccccagaactcaccgacatcacctactccaccgataagcctggtcatgtagtgaaccacgccggcaagaccgtgctgttcggcgatggtgacggcaaaatccagatcttcgacaccgcttccctcctcaagggcgatgaagtagaacctgagatcaaaaacgccctcaaagcccaccacggcgtggcagtagtcctcgaaaacggcgacctgctgcacactttgggcgatgaggattcccgcaacggcgccgtcgtattcaacgcagccggtgaagaaatcgcccgcaacgaacagtgccccggcgttcacggtgaaagcgcagcactcggtgacgccatcgcagttggctgtgaagacggtgtactgatctacaaggacggcgagttcaccaaggtccaggcacctgattcctacggtcgcatcggcaaccaatcaggcagcgacgtctctcctgtcgtcctcggcgattacaaggtagataaagacgccgacttggagcgcccagagcgcgtttccctcaccaacaccgagaccggcgagctcaccctcgttgacctcggcacctcctactccttccgctcacttggccgtggccctgcaggcgaagcagtagttctaggcaccgacggcgcactccacatcatcgatgccaacaccggcgccatcaccaacacctaccccgtcatcgatgcctggaccgaaccagaagtatggcaagaagcacgcccaaccctgttcatcaacaaggaccgcgcatacgtctccgacccatcaaacaacgaactccatgttgttgacctggccaacggcaacatccttgccagcgccaccctgccaggaacccccaacgagctcaccggagtgagcggctaaaaagaaattgcttttcgacg

SEQ ID NO: 2730 - protein, 426 aa, Corynebacterium glutamicum
MKNSKLLLIAAVSTASILLASCGTDSSADTATASSSATASSEAHDHDGHEAEGSSTAVEVSSPQARIVTTYDGGIITLDANTLEILEDTELAGFNRLNSAGDGRHVFVSTGGGFQLFDTGAWTEPHGDHTHSYTATPELTDITYSTDKPGHVVNHAGKTVLFGDGDGKIQIFDTASLLKGDEVEPEIKNALKAHHGVAVVLENGDLLHTLGDEDSRNGAVVFNAAGEEIARNEQCPGVHGESAALGDAIAVGCEDGVLIYKDGEFTKVQAPDSYGRIGNQSGSDVSPVVLGDYKVDKDADLERPERVSLTNTETGELTLVDLGTSYSFRSLGRGPAGEAVVLGTDGALHIIDANTGAITNTYPVIDAWTEPEVWQEARPTLFINKDRAYVSDPSNNELHVVDLANGNILASATLPGTPNELTGVSG

SEQ ID NO: 2731 - DNA, 303 bp, Corynebacterium glutamicum
  CDS (101)..(280): RXA02452
tttgcgcgactaatcgccggataaatgaattgattattttaggctcccagggattaagtctagggtggaatgcagaaatatttcctacggaaggtccgttatgacgcctgcaggtccagcacaattactcattgttgctcttgtagtaattgtcctctttggttccaataagttgcctgatgttgctcggtccgttggccgttcgatgcgcattttcaaatctgagatcaaagagatgaacaaggatcagatcgaaagctccgatcagaccttgaagaactaaggttcctcgcatctaaaaac

SEQ ID NO: 2732 - protein, 60 aa, Corynebacterium glutamicum
MTPAGPAQLLIVALVVIVLFGSNKLPDVARSVGRSMRIFKSEIKEMNKDQIESSDQTLKN

SEQ ID NO: 2733 - DNA, 858 bp, Corynebacterium glutamicum
  CDS (101)..(835): RXA02459
ggtgcgatcattggcctcgcggttgatggcgttcaggttgaagacattaagaccacttccaaaactttccctggttttgaaaatgtttgggaggagatggttggctagacgcagctatgacgaatccgatgttcgtgttcgcccaggtaaaggtacccgccctcgtacgaaggatcggccatcgcatgagaatgctctagtgggcatggttgtgacgaaggatcgtggtcgttggggtgttgttctcgatggtcgtcaagatgccattgtgacgatgcgtgcccgtgagttggggcgtacggctatcgaagtgggtgatcgtgtcggagttgtcggcgatacgtctggccgtccgggctcgttggctcgaattgtccgccttgaggagcgcacgagtgtgttgcgtcgtacggctgatgacacggacccgtttgagcggattgtggtggctaatgcggatcagttgttgattgtttctgctgtcgccgatccgccgcctcgggcgggttttgtggagcgtgctctaattgctgcgtttgttggtaatttgcagccggtgttgtgtttgacgaagtctgatttggcggatcctgcggagttcgctgcggagtttgaggctttggaagtgccggttgttgtttgtggtgttgatgatcctcttgatcctgttttggaggtcgtggaaggccatattacggcgcttattgggcaatctggtgtgggtaagtcgacgttggttaatcgtttggtgccggaatgccgatcgttaaactggtgtcgtgtcgggggttggcaagggtcggcatacgtcgacgcagtcggtcgctcttgccattgataatggttggattatcgaaa

SEQ ID NO: 2734 - protein, 245 aa, Corynebacterium glutamicum
LARRSYDESDVRVRPGKGTRPRTKDRPSHENALVGMVVTKDRGRWGVVLDGRQDAIVTMRARELGRTAIEVGDRVGVVGDTSGRPGSLARIVRLEERTSVLRRTADDTDPFERIVVANADQLLIVSAVADPPPRAGFVERALIAAFVGNLQPVLCLTKSDLADPAEFAAEFEALEVPVVVCGVDDPLDPVLEVVEGHITALIGQSGVGKSTLVNRLVPECRSLNWCRVGGWQGSAYVDAVGRSCH

SEQ ID NO: 2735 - DNA, 531 bp, Corynebacterium glutamicum
  CDS (101)..(508): RXA02461
agaaaatctcaaggcaaaaaacaagccaccccaatctgtgcgacaatcaaaccacagactacgactattatgtcacgaagaaaccaaagaaagggaaataatgcgcggactaattgttgactacgctggagtactagacggaaccgatgaggaccagcgtcgctggcgcaacctgctcgccgcagcaaagaaaaatggcgtcggaaccgtgatcctcagcaacgatccaggtgggctcggcgcagcgccgatccgggaactcgaaacaaacggggtagtcgataaggtgctgctgtcgggagaacttggcgtcgaaaagccagaggaagcagctttccaggccgccgcagacgccatcgacctgcccatgcgtgactgcgtgcttgtcgacgactcgatcctcaacgtgcgcggcgccgtcgaagccggactcgtaggcgtctactaccagcaatttgaccgtgcagtcgtcgaaatcgtcggactgttcgggctagaaggagaattctaatcttgcgcgtctacatccca

SEQ ID NO: 2736 - protein, 136 aa, Corynebacterium glutamicum
MRGLIVDYAGVLDGTDEDQRRWRNLLAAAKKNGVGTVILSNDPGGLGAAPIRELETNGVVDKVLLSGELGVEKPEEAAFQAAADAIDLPMRDCVLVDDSILNVRGAVEAGLVGVYYQQFDRAVVEIVGLFGLEGEF

SEQ ID NO: 2737 - DNA, 348 bp, Corynebacterium glutamicum
  CDS (101)..(325): RXA02467
gtgaacgtaggtctggggctttcagaagacacaacttagatactatcgttgcacggttacaatagggtcattccaatacaacgattcttttaggagagctatggatatcaagatcggatttgccgatactgcccgtgaactggtcatttcttctgctttgcagcaggatgaggccgctgcgaaggtgtcggaggctttggctaatgattctggcgttttagatttgagcgatgaaaagggtcgccgttacattattcgtaatagccgaatcgcttatgttgaggtcggcacgagtgctcctcgtactgtcggcttcgctggcgcataggggcttttagacacgtgtcg

SEQ ID NO: 2738 - protein, 75 aa, Corynebacterium glutamicum
MDIKIGFADTARELVISSALQQDEAAAKVSEALANDSGVLDLSDEKGRRYIIRNSRIAYVEVGTSAPRTVGFAGA

SEQ ID NO: 2739 - DNA, 414 bp, Corynebacterium glutamicum
  CDS (101)..(391): RXA02472
atgattctcataaggctataaacaatgtagttaggttacactaatggtgtccggttgtgaatagtgcagcggacggggttccgctgcggaggaggtcatcatgtcatttgttaacatcacggctcttacgttccctgcaggggctgaaaaagaaatcgaacaacgcttcgcggctcgtaagaaggctgtagatacggccaaaggattccaagaatttgagttgttgcgtccacaatttggtgaggatcgctacttcgtagttactcgttgggattcccgcgaagactatcaagcatggtcggatgcccgccctgccggtaaccatgctgatgatgaacaacgtggcatgagcgtggaagttcttggtttcgatgtggttcctttggaaggctaaaagtccttggcgtggcatag

SEQ ID NO: 2740 - protein, 97 aa, Corynebacterium glutamicum
MSFVNITALTFPAGAEKEIEQRFAARKKAVDTAKGFQEFELLRPQFGEDRYFVVTRWDSREDYQAWSDARPAGNHADDEQRGMSVEVLGFDVVPLEG

SEQ ID NO: 2741 - DNA, 864 bp, Corynebacterium glutamicum
  CDS (101)..(841): RXA02473
tgcagttatgattaaactaactcctagcagtggccaactacatgtctggcttaatagcctatgaacgcctaagcctggagccacaacaaccacattccgaatggtcgcagagtaccctgacggatcctcggaaatattcccggtaacgttaaatttaattccggaagataccctcgtttatgacgccgtctacaaattcaaaagcatccgaactggttccgaagatcaaataaccccatttgtatcaaaccaacctgatgtgcctttccctgcaggaacatcgttcacattaactggatattatgaaattgatcagctgagaagtgcaggatggaaatttgagcttaatcctgtaacaggtgaactttcagtcacagttcctatctctgtaatttaccctgatgggtctcgtgataacacaatcgcgaccatggaatccgtaggccctgatgattctgagcttttcaaaccagactttgatttaatcccaataaaatcaggtgactatatagagataggtgtactcgcaccagggcttcctgctggtacggaattccatctcgattactacgcacttccggatcgattctttgacttaggcggttctacaagcctttcaggcaacggtaagttctctcttggagttccacttacctggaatgatgatctccagctcccgatctcgattacttttcctgacggaagccacacagttgagaatttgcatgttgacgtaacccccgcaaactttgctggcaaccccattgacgagcctaaggacgatgacaaggatcatccacaaccggctcctaaaccaagtggcagctcatttggttctagctagttcctactaaacagttcaaa

SEQ ID NO: 2742 - protein, 247 aa, Corynebacterium glutamicum
MVAEYPDGSSEIFPVTLNLIPEDTLVYDAVYKFKSIRTGSEDQITPFVSNQPDVPFPAGTSFTLTGYYEIDQLRSAGWKFELNPVTGELSVTVPISVIYPDGSRDNTIATMESVGPDDSELFKPDFDLIPIKSGDYIEIGVLAPGLPAGTEFHLDYYALPDRFFDLGGSTSLSGNGKFSLGVPLTWNDDLQLPISITFPDGSHTVENLHVDVTPANFAGNPIDEPKDDDKDHPQPAPKPSGSSFGSS

SEQ ID NO: 2743 - DNA, 1278 bp, Corynebacterium glutamicum
  CDS (101)..(1255): RXA02475
tcgctcattgaggacggactcgcggaacaaaatgaggcgggttatttccacctgccacggtaaaccactgcgcgcctgcaaaaaacagtaggtttaagtaatgcttggtctctctcgtcgtaagtttgccatgctcgctgccttaactgcgggaatcgttggcgttgttgccactggttgtagtacgcccgcagaacctgaaacgatcgataatccggtgttcattggtatctccatcgatccaattaaaaacctaagtccgaatcacgctgcaaacctcttcgctttatctgcagatggctcgggaggaattttccaagaactcgctcccacatactttccgtcgatccatcgattaggaaacggattcatcgcacccgatagagattctttggtagttgtcgacgcttctctaaaggaagtttatcgacacgaagtggccaggcttggtgttggaatgcaaactcaatcagctaggtctccactgcataaatcagttgccttctccttcaatgaaggaacagctgaagccccatatagacaccgcatcgtctccgcaactgagaaaacatcagcttccgcaatgacagatcagcggcacttcgcgcttactgcatgcgatgacggatccacacggtgggtcgaatattcccctgaccgcggaatggaagatccaatgggccccggctcagcacgcatcgtgactctccaggccgacggagaactcagtgaaattgacgttgagtggaatttcccggatcggccctccgccccaattattctgtcttgcgaagatccaagcgcttatatagtttcagaagaagacatcatctatgtaaaagacgaggtaagccctgccgaatccataggaaaattacctgcatatgaaattccggaccgcgcccgattcgatacagtttccggcgaagactacttcgcttttacgtcaactgggatgctgacacgcatcaatattccccaagcaaaaatcgtctacgcacaatccattgacctctacggcaagcatccggtttccataactttcgattccgaccgtgcatacgtggttacttccggggattccggggaaagccttcttgaaatcgacttgaatgatccaacatgcacttcagatcagctctcgctcactggtttcaacaaattactcacagctcggaaacctaagccagaaccgtcgatcatcatcgaaaccatcttgccaattgacccaaactactcactgggttgtaagagttagattttggacggaagtgtgta

SEQ ID NO: 2744 - protein, 385 aa, Corynebacterium glutamicum
MLGLSRRKFAMLAALTAGIVGVVATGCSTPAEPETIDNPVFIGISIDPIKNLSPNHAANLFALSADGSGGIFQELAPTYFPSIHRLGNGFIAPDRDSLVVVDASLKEVYRHEVARLGVGMQTQSARSPLHKSVAFSFNEGTAEAPYRHRIVSATEKTSASAMTDQRHFALTACDDGSTRWVEYSPDRGMEDPMGPGSARIVTLQADGELSEIDVEWNFPDRPSAPIILSCEDPSAYIVSEEDIIYVKDEVSPAESIGKLPAYEIPDRARFDTVSGEDYFAFTSTGMLTRINIPQAKIVYAQSIDLYGKHPVSITFDSDRAYVVTSGDSGESLLEIDLNDPTCTSDQLSLTGFNKLLTARKPKPEPSIIIETILPIDPNYSLGCKS

SEQ ID NO: 2745 - DNA, 1345 bp, Corynebacterium glutamicum
  CDS (101)..(1336): RXA02478
gacatcgtcgaagcgctctccagcggcaacatcgacgattatcgcagcgccgtgctcgctcactacgcgccgtttcgccgcatgatttccaacatgctcgatgcgcactagcctcattgcgcgcgggttgtaccgcattcccgcgctggtctgggatcagggtcttttaacgcttttcgacgcccgcctcagtgttgacgacctccccgcacccatcgacgtggtgtcagcgcgatcctcagacggcatcacctggaccaccccagaaccagcaatcgtcgaaactgaacaccgcggtgtgggcgatgtctgccttgtcacgggcgatctgtgcttccacggattgtccaacctcgcaggattttttgaggatcccaccgaccttgaaccccggctggcgcgccgggatgtgagtgggtggacgtcgataagcatggcccactattttgcggatgttgatgccgcgttcgcctcgtcggggacgggacttgtcctggcggatgggcggtggattcagagttttgtggtgcggcgcgggcgcgagatttcgcttcggattctgcgcagcgatggccacatcaccgatattgccggcggtaacgaatccgcgatgacgcagctgccgagcggtcggattgtgctgcattccaggggggtgggacaccgtctgagcagtgtgtccgatgatttcggggagacattcactccgctggagcctgtgcctgaactaatcgaccccggctgcaacggccacgtgttctactggaaagcggctggaatgctcgccgcaacgcacctggcggaccctgatctgcgacgccacttggtggttgatttatccagcgacgaaggagcgacctgggcgcatcgcatcaccatcgagcgcgaagaagccgcctattcaaccgctgcggaaatgcccaacggagatgttgccgtggtgtgggaagcagagggaacgcgcgcgataaaatgcacggtgatcagcgtaaatgatatttcgctgcggatcgatgagcccatttccgatgccatatccctccgccatgtggtgatcaacgatgaccatgacggcatcgaagtcgcactgcctgacgcatcgcaatggggtgaaggtgtattcaaaattgtgtccaatccagacgcgagcacccaaaaaatccgcactcgaggcaagcccgcgcgacagaccctggaaattggggatgaattggtttttgatatccgcaagggtggagaagtggcttacggcgtcacggttccttatgatggtcgctcgttggggaagttaaacaggattttggagtggggctgtagaggccgatttgcggtcctttaattgcgg

SEQ ID NO: 2746 - protein, 412 aa, Corynebacterium glutamicum
MRTSLIARGLYRIPALVWDQGLLTLFDARLSVDDLPAPIDVVSARSSDGITWTTPEPAIVETEHRGVGDVCLVTGDLCFHGLSNLAGFFEDPTDLEPRLARRDVSGWTSISMAHYFADVDAAFASSGTGLVLADGRWIQSFVVRRGREISLRILRSDGHITDIAGGNESAMTQLPSGRIVLHSRGVGHRLSSVSDDFGETFTPLEPVPELIDPGCNGHVFYWKAAGMLAATHLADPDLRRHLVVDLSSDEGATWAHRITIEREEAAYSTAAEMPNGDVAVVWEAEGTRAIKCTVISVNDISLRIDEPISDAISLRHVVINDDHDGIEVALPDASQWGEGVFKIVSNPDASTQKIRTRGKPARQTLEIGDELVFDIRKGGEVAYGVTVPYDGRSLGKLNRILEWGCRGRFAVL

SEQ ID NO: 2747 - DNA, 933 bp, Corynebacterium glutamicum
  CDS (101)..(910): RXA02482
aaacggtggcgccttaattgttttacgcgtgctgacaggaaccttttaggtgattaacctggtttgcaactttccaacctcagccggataaggaacactagtgggcgtggctaaatcaaagaaatctgctttacctaaagtcctgctcaccatcgtggtgatcctgctcctgctcgtgctggtagcagaattcgggctgcgcttcatgatcggaaaacaactgaaagatgagttccaagctcaggcttcctcacaaggaatctctgcaactgaagagccctccatcagcttcggcgcatccccactcctgttaggcatcgctcggggaagcatcaatgaagtcacaatcgacacccccgactccgtatccatcactaaccaagacggtgtcccctccatcagtggcacaccagagtcaactatccaactccaagggcttgatatcggtgaccgcgacaacccagtcgcagaccacctcaccttaaccacattggcaaccgacgatttcatcctggcaaccatccaacagcagatggccgaagcaaccggcgggaacagcacctcccaaggattcgcagaacagcttatccaggaactcatcaaagtcaccgacattacttccgatgcagctaatcaaaccatcgaagttgaattcaccgacggcgccgcccgagcctcactgcaccccatcgtaacgaacggccaactcggctttgagatcgtagattcccaactcttcggattcggcctccccgatgaaatctcccaaatgctcaccgacgcactgcaatcatcaatcaatgaagtagccggtggcctgcaaatccaaagcctcgaagttgtcgacgctggcatcaacgtcaccctgaccggagacaacatcaacatccagaccctagaagccgcacagtaaagagcgctttcgcgtctgtg

SEQ ID NO: 2748 - protein, 270 aa, Corynebacterium glutamicum
VGVAKSKKSALPKVLLTIVVILLLLVLVAEFGLRFMIGKQLKDEFQAQASSQGISATEEPSISFGASPLLLGIARGSINEVTIDTPDSVSITNQDGVPSISGTPESTIQLQGLDIGDRDNPVADHLTLTTLATDDFILATIQQQMAEATGGNSTSQGFAEQLIQELIKVTDITSDAANQTIEVEFTDGAARASLHPIVTNGQLGFEIVDSQLFGFGLPDEISQMLTDALQSSINEVAGGLQIQSLEVVDAGINVTLTGDNINIQTLEAAQ

SEQ ID NO: 2749 - DNA, 936 bp, Corynebacterium glutamicum
  CDS (101)..(913): RXA02483
catgggccctgcaatcgagcctaaggttgccgacgcactcggcgagctcttcgcaaacgaaggcgctctgaccgaaaagtggatctccgagaacctctaaatggctgatcacgcccacaatctgcgcgcctctttccgcaagggtgcaaacggaaagcagaagccaatcggcgtgatcacccgcggcaccaccggtgtgaaccgcctacggcgcttcgatcggtggtgctttcatcatcccaaaatacgttcgcttctcgacgccacttccctggcgttagatgtcgggtacggcgccagccacacaaccaccgtcgaatggggacgttggctccaccgcctccaacccgacatggatgtcatcggcctagaaatcaaccccgaacgagtcctcgaaccccaaaacggcgtgtcctttgaactcggcggattcgaacttgccggctacaccccacaactcgtgcgcgccttcaacgtgctgcgccaatacgacgtggaccaagtcgaagccgcatgggaaaccgtcacctccagacttgccccaggcggactgtttttcgaaggcacctgcgatgaaatcggcaaacgctgcacctggatcacacttaactcagacggcccacaagaactcacccttgcatgggatccttggggaatctccaccccctccgatgtggccgaacgactgcccaaaatgctcatccaccgcaacattcctggtgaaaagattcacgcactgctagcagccgctgatttagcctgggactactgcgccggctgggaaccccacggaccgcgcgtgcgctgggaaaaagcccgcgagatgctcatcgaccaaggttggcccatcgcagtgtccaggcgacgcgtgggcgatagcctgctgactgtaccgtgggaaacggtggcgccttaattgttttacgcgtgctgaca

SEQ ID NO: 2750 - protein, 271 aa, Corynebacterium glutamicum
MADHAHNLRASFRKGANGKQKPIGVITRGTTGVNRLRRFDRWCFHHPKIRSLLDATSLALDVGYGASHTTTVEWGRWLHRLQPDMDVIGLEINPERVLEPQNGVSFELGGFELAGYTPQLVRAFNVLRQYDVDQVEAAWETVTSRLAPGGLFFEGTCDEIGKRCTWITLNSDGPQELTLAWDPWGISTPSDVAERLPKMLIHRNIPGEKIHALLAAADLAWDYCAGWEPHGPRVRWEKAREMLIDQGWPIAVSRRRVGDSLLTVPWETVAP

SEQ ID NO: 2751 - DNA, 624 bp, Corynebacterium glutamicum
  CDS (101)..(601): RXA02484
cggcgaaagtgacttccgaatcgagttcgacgccgtcgatcgcggcgatttcctgggctagcgatgaatccaacaccccactaacggtagtcttatcctcatggcaacgcgtacagaaaacaccattacgatcaatcagcccgtcggcaaggtgcaccaagcactgaccaccgaagcctactgggcatacatcgcagagaacctctcccccgaagctggcgaggtcaacgagttcaccgcagctgacggtggcgcaaccgcaaccctttttgaggtcctcccactcgaggtcctcccagaggcagttcgcgcaatgatcagccaggcactgaaggtcaagcgagtcctcacggttcctgcactgaccaacaacgccacaaccgtcgagtacaacgctgacgtcaagggcacccctgttgatttcaagggcaccatcgccatcaacggcgacgacgcagcaaccaccttcgactacagcaacgaagtgtccgtgaacatcccattcatgggccctgcaatcgagcctaaggttgccgacgcactcggcgagctcttcgcaaacgaaggcgctctgaccgaaaagtggatctccgagaacctctaaatggctgatcacgcccacaa

SEQ ID NO: 2752 - protein, 167 aa, Corynebacterium glutamicum
MATRTENTITINQPVGKVHQALTTEAYWAYIAENLSPEAGEVNEFTAADGGATATLFEVLPLEVLPEAVRAMISQALKVKRVLTVPALTNNATTVEYNADVKGTPVDFKGTIAINGDDAATTFDYSNEVSVNIPFMGPAIEPKVADALGELFANEGALTEKWISENL

SEQ ID NO: 2753 - DNA, 759 bp, Corynebacterium glutamicum
  CDS (101)..(736): RXA02486
tccgacctcgtcgcattagccaaagaaatccgcgacggagtcctcgaaaccttcggcgtcaccctcgtcccagaacccgtctggattggaatcagcatcgatgactgaattttccgacgtccctggcaccgccgccccactgcacagggcgttggaaaatgccggatactccactttagaatccctcgacggtgttccctacaagacgttgattgccctgcatggtgtcggaaaaactggcctcggcaggatccaggcagcattgttggaacgtggcctttccctgggggaagaaacaaaaggcgccaccatcaccccaggtcacaccggtaaagtggcctcagatatcaaaactcacatcacttccgtggatcccgtcgcatacgtcgatggtctagaggggcgtcgggttgctcacgggcaccaattgctatcgatcttcggtcgcgtcaccggcgcggaacccaaaatgtggggaccctccatgatcggatacggctcagtccactacgtttcccacaccggaagggaaggcgattggtttcagtgtggtttcagcccggcgaagtccaaaatctgcctgtatggcctgaaggattcgcctcgcggtgaggaattgctgcagaaacttggaaaatacaccgaaggccgcggatgcgtgtacatcaataaaccggaagacatcgatttggatgttttagaggccatgatcagcgagtcatgggccggccaaggctaggttgcaaatccccaccacaa

SEQ ID NO: 2754 - protein, 212 aa, Corynebacterium glutamicum
MTEFSDVPGTAAPLHRALENAGYSTLESLDGVPYKTLIALHGVGKTGLGRIQAALLERGLSLGEETKGATITPGHTGKVASDIKTHITSVDPVAYVDGLEGRRVAHGHQLLSIFGRVTGAEPKMWGPSMIGYGSVHYVSHTGREGDWFQCGFSPAKSKICLYGLKDSPRGEELLQKLGKYTEGRGCVYINKPEDIDLDVLEAMISESWAGQG

SEQ ID NO: 2755 - DNA, 392 bp, Corynebacterium glutamicum
  CDS (1)..(369): RXA02488
aagctgactgcaactggtgtcgatgtcatgggcaccttctacccagaaggtgaagcacttgcgccaatcactttgaacctcaccaacgaagttgtatgcgacgagcctgaaacccccgttgagcctgaggttcctgtagagcctgagactccagtagatccggaaacctcggtcgacccagagactccagtagatccggaaacctcggtcgacccagaaaagcctggcgatgacaacaaggatgacggaagcaacagcagcagcaacggcgatatcctcggaatcttgggcatcctcgcagcgcttggtggcgttggtgcacttgtgtacaacttcctggtagctagcggattccttgcagcgtttaagtaaatgaatcgttttcctagtgc

SEQ ID NO: 2756 - protein, 123 aa, Corynebacterium glutamicum
KLTATGVDVMGTFYPEGEALAPITLNLTNEVVCDEPETPVEPEVPVEPETPVDPETSVDPETPVDPETSVDPEKPGDDNKDDGSNSSSNGDILGILGILAALGGVGALVYNFLVASGFLAAFK

SEQ ID NO: 2757 - DNA, 724 bp, Corynebacterium glutamicum
  CDS (101)..(724): RXA02489
tatcctcggaatcttgggcatcctcgcagcgcttggtggcgttggtgcacttgtgtacaacttcctggtagctagcggattccttgcagcgtttaagtaaatgaatcgttttcctagtgccttattagcagcctctgtcgcgggggctgcgttggccattccagcgacctctgcacatgcagcagaatctatttgtacattcaccggcgatgttgggtggaatgtgcgcgattctttcaacagttatcttttgggaaacatcgcaaatggtagtgcttataaatataagggcgggttggacgttcgtgacggcgtccagaccgacggtaacggcaaaactccagcactgacctggccagttgattcggtgacgtcttcgaagatttccacttccggaggcgcgcactggaccggacacaacctgtaccccggtgatgacctcgcggaagtccctaacaatttcacgttggatcttgatttttccaacatcactgtggagctgagtggttctacaggtcggttgttggtggattacacatctcgggaatacatcaacacccacacgttgggtgagtttcaaactggtgaacaggctgagcttgccacgattacttttgccaaagctccagacctcacctctaattcagtcaacgtgactggcgatgtggcattgactgctgatggtgtggaagttttcggtggtttctacacggcaggggaggag

SEQ ID NO: 2758 - protein, 208 aa, Corynebacterium glutamicum
MNRFPSALLAASVAGAALAIPATSAHAAESICTFTGDVGWNVRDSFNSYLLGNIANGSAYKYKGGLDVRDGVQTDGNGKTPALTWPVDSVTSSKISTSGGAHWTGHNLYPGDDLAEVPNNFTLDLDFSNITVELSGSTGRLLVDYTSREYINTHTLGEFQTGEQAELATITFAKAPDLTSNSVNVTGDVALTADGVEVFGGFYTAGEE

SEQ ID NO: 2759 - DNA, 2691 bp, Corynebacterium glutamicum
  CDS (101)..(2668): RXA02495
aaggaggaaaattatcaccgtcttaaaaacggctaaggcttttctaaattcgccgctgcgcaccatcacgtggcgcagcgttgtggcgaataaactccgcatggcattaacagtgctttcggttgtgctaggaaccgcatttttgtgtggctccctcctcctcacacattcccttgaaagaacattttcctccatcgttgatgccggcgtggagggcgttgacgtgggcgttatcgcgcaacaaaacaaccccgacggcgtacctttctccgtcatcgccgaaattgagcagtatccggaagtccgcgccgtcaacatcatcggcgacggccccggcatgccctccggcaccaccatgaccggccaatccgcgctgatcctcaccgactccgacggcaatcccctgcaagcaggcagctccggcacgcacccgctagccatttatccgcagggcgagtgggtctcgcccgagccaacgcttatcgacggccacttccccacaaaacccgacgaggtagtagtcaacgcttcggccgccaaacgtggcgggctctccctcggtgatcacctaacgatcgtcacacccaccgaacgcatcgacgccaccctgtctggaaccttcgaatcaaacaccgacgtcgcaggctgggtcggagtcggattcaccccacagcgctacgtcgaactgctcaccaacggcaccgacgccagccaaatcaccatcgcagtcaacgacggcgccgaccccatggcagtccgcaaccgcatcggcaaaaaccaccgggacctgctgcccctgctgcccgagcaaatcatcgaccaaaccaccggcgacaccgaccgccaactggagttcatgacctacgtgctcctggcattcgccgcgatcgcactgattgttggctcgttcatcattgccaacaccttcgcgatgatcgtcgcccaacgcaccggcgaattcgccctcctccgttccattggtgtctccacgttccaaatcggattctccgtgattatggaagcagtattcgtcggacttatcggcggtttcatcggcatcgcagttggcttcggagtggtcaatgcacttgtccaagtgctcaaccaattcggcgacaccctctcctccatcgacatcacctacaacgccggatccttcatcttccctgtcctcttcgccgtcactgccaccgtactaagctccatatcgcctgctcaccgcgccggtaacctcccaccagtccaagcattcgaatcctccgatgcacgcagcgacgccctcggaaggatccgcttcctcgtcgccgccgtcatgctcacccttggaatcagcctgacgatcgcaggtgccgtggtatccgccatcaacggagatgaattcaaaacagaaacacgcctcgcattcatcggcgctggacttctcttagtgttcttctcactctccctgtccggtcccgcactgatggtggcgacctctcagactcttggcgtggcgataatgtcgccgttccgagccgtcggcaagctcgcacaacgcaacaccctgcgcaatccgcgacgctccgcaaccaccgcactggccgtcactttgagcgttggcctcgtcgcctgcgttggagtcatcggcgccaccacccgcgccagcgtcttcgggtccatggaatccaccatcaaatccccatatgtcctcgacagcatcggtggcaccatgatccctggacaacccgccggcggttcaaggtcactgtccatgtccgcagccgtcgcacaggaaatcgcacaaacccgcggagtcggcaaagtgggcaccctcatgaccggcagcgtccaagtcaacggatgggacaacgaaaacaccacaattttcgacggcgacctctctcagttcctcgacctcgcagtccgctccggcgacgccttcgacgacgaaacccccggcgtcatgatctccaccacctacgccgaccaatccgacctcgaagtaggcgacaccgtcaccgtcaacccctacggatccgacgacggcatccgcgtccccatcaccggcatctacgcagaaaccaacctcgtcggacacctcatggtcaacgcagccgccaccaaccgagtcctcacctccgcggacacctaccaccggtcccaaatcttcgtcaacggcgacggctccaccaccaacgaagaactccgcgacatcctcgtcgacgccgtagcccccttcctcatcgtccaagtgaaatccaaagatgaattccgcggaagcctcggcacccaaatcaaccaattgctcggcatcatctacggactgctcgccctggcagtgatcatcgcagtcctgggaatcgtcaacacactgttcctctccatcagcgaacgcacccgcgaaatcggaatcctccgcgccaccggcgtccaacgaggacaaatccgccgcatgattaccctcgaatccgtcatcctctccatccacggcgcaatccacggactcctcctaggtacatttatcggctgggcaatcgtcagttgtctccgcacccgaggcatggcacccgtcgaattcccctggacccaaatcggattaatgctcatctccgcaatcatcatcggaggcatagcagccctcatcccagccaaccgagcctcccgaatctcccctttggaagcaatcaactaacagtctgcatcggcaacctc

SEQ ID NO: 2760 - protein, 856 aa, Corynebacterium glutamicum
MALTVLSVVLGTAFLCGSLLLTHSLERTFSSIVDAGVEGVDVGVIAQQNNPDGVPFSVIAEIEQYPEVRAVNIIGDGPGMPSGTTMTGQSALILTDSDGNPLQAGSSGTHPLAIYPQGEWVSPEPTLIDGHFPTKPDEVVVNASAAKRGGLSLGDHLTIVTPTERIDATLSGTFESNTDVAGWVGVGFTPQRYVELLTNGTDASQITIAVNDGADPMAVRNRIGKNHRDLLPLLPEQIIDQTTGDTDRQLEFMTYVLLAFAAIALIVGSFIIANTFAMIVAQRTGEFALLRSIGVSTFQIGFSVIMEAVFVGLIGGFIGIAVGFGVVNALVQVLNQFGDTLSSIDITYNAGSFIFPVLFAVTATVLSSISPAHRAGNLPPVQAFESSDARSDALGRIRFLVAAVMLTLGISLTIAGAVVSAINGDEFKTETRLAFIGAGLLLVFFSLSLSGPALMVATSQTLGVAIMSPFRAVGKLAQRNTLRNPRRSATTALAVTLSVGLVACVGVIGATTRASVFGSMESTIKSPYVLDSIGGTMIPGQPAGGSRSLSMSAAVAQEIAQTRGVGKVGTLMTGSVQVNGWDNENTTIFDGDLSQFLDLAVRSGDAFDDETPGVMISTTYADQSDLEVGDTVTVNPYGSDDGIRVPITGIYAETNLVGHLMVNAAATNRVLTSADTYHRSQIFVNGDGSTTNEELRDILVDAVAPFLIVQVKSKDEFRGSLGTQINQLLGIIYGLLALAVIIAVLGIVNTLFLSISERTREIGILRATGVQRGQIRRMITLESVILSIHGAIHGLLLGTFIGWAIVSCLRTRGMAPVEFPWTQIGLMLISAIIIGGIAALIPANRASRISPLEAIN

SEQ ID NO: 2761 - DNA, 930 bp, Corynebacterium glutamicum
  CDS (101)..(907): RXA02496
cgggacgcgcgtctactgcaactaggtggacagtattgctgcccacatctaatacacctaatctcacacctaaaggttagacggtctagggtggcaaagtgtgaatcggtcaaattcttcttcggtatttttaggtttccccgagtcttcgccagcggcggcatcgattcgtgctggggaggaactccctcttgatttcccacgtgaatggtatgaattcacggatccaactgatattgagcatgtatttagcatcgatttaacgtggcttgagtctaattggaattgcacctttggtacccccgattgtttaggtattgattccgaaaacgccgacgtgggttgttgcggccacggtgcattcttagcagatgagacagatcgagatcagctttatgatgccgttgctcagatgcccgctaagtattggcagctacgccccgcctccacggactcgtttttagcatccgatgacggcaccgacattgagccgtggctgacatgggatgaattagatgatgaagacggcaatcccgagcccgctttgaagacaactgtggtcaacggcgcctgtatttttgccaacagggcgggttgggaaacaggcgcggggtgtgcgctgcatcagtggggcgtgaacgcaaatgaggatctaaccgtcgtcaagcctgaagtttgttggcagctcccgctgcgccgcctggaggcctgggaagagcgccccgacgggcaagaaatcttgcgcaccacaattactgaatacaaccggcgcggctggggcaacggcggcgaggatttcgactggtactgcaccacctctccgcgctgccacaccaatgccgaacccatgtggaaaacacaggaaacagaactccgtgcactcatgggaccaaactcctacgaggtgtgacgtaaatatttggaagcacg

SEQ ID NO: 2762 - protein, 269 aa, Corynebacterium glutamicum
VNRSNSSSVFLGFPESSPAAASIRAGEELPLDFPREWYEFTDPTDIEHVFSIDLTWLESNWNCTFGTPDCLGIDSENADVGCCGHGAFLADETDRDQLYDAVAQMPAKYWQLRPASTDSFLASDDGTDIEPWLTWDELDDEDGNPEPALKTTVVNGACIFANRAGWETGAGCALHQWGVNANEDLTVVKPEVCWQLPLRRLEAWEERPDGQEILRTTITEYNRRGWGNGGEDFDWYCTTSPRCHTNAEPMWKTQETELRALMGPNSYEV

SEQ ID NO: 2763 - DNA, 927 bp, Corynebacterium glutamicum
  CDS (101)..(904): RXA02498
caaggtagaaatttgtccgtgggcacttcgtgaaggtgtgatcctcaccaggatcgacaaaggactcgagtaacatttacccggaaaggagttggcgaaaatgagtgaagagaaactcacagtcgctgagctgatggcgcgtgccgcgaaagagggacgctccaccgatgctccccgacgacgcaggcgccgcagcatcgaagacggtggcgtatccgttgctgagctgaccggctccattcctgccgttaaggaaaagcccgcggagtccaagcactccagcgtgcccatcgatgcaccagcagaacctgaggttgttgaggcccccaagcctgagcccgccgaagaagtagaagtggcttcggtggagggcgacgtcgataagcaggaaacccctgagcgtccggcgccgagcaacgaagaaaccatggtgctgcgcatcgtggatgaaaaagatccaattagcttgacgacgggcgcgttccccgtggttccggcagttgccgccaagccggcgcccgtagtgcgcgcggagaaggacgccgatgtggagactgccgtaaaggcagatttcgcagaggtggaagtcgataacactgacaccacgcagatggctgtggtggaagaagttgacgaggagccagagcaagaaaacaaaatgtccgtattcgcgatcatcatgatggcgatcgtcggagttgttctcggtgtcgttgtattcctcggctttgaaatgctgtgggagcgcctgaacaagtggatcgtcgctgttctggcagtcggcgtgaccttgggaatggtgggcatcatccacgctttgcgcacctcacgtgatggtttcagcatggttctcgcaggaatcgtgggcctggtcatgacgttcgggccgctggcaatcgtcatgtaatttgtcgttttgggcccccg

SEQ ID NO: 2764 - protein, 268 aa, Corynebacterium glutamicum
MSEEKLTVAELMARAAKEGRSTDAPRRRRRRSIEDGGVSVAELTGSIPAVKEKPAESKHSSVPIDAPAEPEVVEAPKPEPAEEVEVASVEGDVDKQETPERPAPSNEETMVLRIVDEKDPISLTTGAFPVVPAVAAKPAPVVRAEKDADVETAVKADFAEVEVDNTDTTQMAVVEEVDEEPEQENKMSVFAIIMMAIVGVVLGVVVFLGFEMLWERLNKWIVAVLAVGVTLGMVGIIHALRTSRDGFSMVLAGIVGLVMTFGPLAIVM

SEQ ID NO: 2765 - DNA, 222 bp, Corynebacterium glutamicum
  CDS (101)..(199): RXA02500
acgcgggttagatttttgctcgcgatccgaaagtgcacttcggcaaaaagtgctggcaggttttgtacgtacaacatcgatttaagcgagggaaaccgtaatgggttctgtcatcaagaagcgccgcaagcgcatgtccaagaagaagcaccgcaagatgctgcgccgtactcgtgtccagcgtagaaaattgggcaagtaagccttcaattgagcttcaaa

SEQ ID NO: 2766 - protein, 33 aa, Corynebacterium glutamicum
MGSVIKKRRKRMSKKKHRKMLRRTRVQRRKLGK

SEQ ID NO: 2767 - DNA, 1005 bp, Corynebacterium glutamicum
  CDS (101)..(982): RXA02506
cctttccctgaactctaagcaattgtgatctatagtacaaatgcataaacattaaccgtgatatccatctcttgcataccggccgaaaggtttagcacacatgcacctcaatcagctcgaatttttcatcgcagtagcccaacacggacagatcaaccgcgccgccgaagaactcctcatttcccaacccgctctcagccgacagatctccgcacttgaaaaatccgtcggagctccactcttcgaacgccattcccgcggtgtctccctcacaaaggccggagaaatcctccacgaagaagccctccgaacgcttagcaggatgcaatcggtagtcgatgaaatccaatccggtgagcacctcatcaccagcatcaacatcggagttccccctggaatccccatcgactggttgcgctgccaactcatcgatttaggccccgagacccgcatttcactgatcgaatcccccaccgatgatcagctaaaacttcttaaacaacgcgaactcgacatcgccctttgtcgacgccaaagcgaggcctttgccaccacacttgtccacgaacaagaactgggaatcgtcgtccgaaaaaactccgaactgcaccaaaaagtcgcaggaaaagacaacgccacactcttcgatcttgaagggcttcgagtcctcgcacactcccgcggtgaagtaagaattcaggaagaaatcctcaaaaacgccatgctcgccgcaggagttaatgccacgtggatcttccgaaaatttgggcaatatagctcactgatcgcagaccttgtccaggccgatgtcgcactcacaacagaggaatccgcccgcaccaacttccccagctggcaatgggtccccatcgaaggcgaagacgcctccggaaatgaccttgttgttcgcacctggatcacctggaacccccaacccacccccgcggtgaaggccctgatccagaaatttattgacggaaactgagttctaaacagccgccatga

SEQ ID NO: 2768 - protein, 294 aa, Corynebacterium glutamicum
MHLNQLEFFIAVAQHGQINRAAEELLISQPALSRQISALEKSVGAPLFERHSRGVSLTKAGEILHEEALRTLSRMQSVVDEIQSGEHLITSINIGVPPGIPIDWLRCQLIDLGPETRISLIESPTDDQLKLLKQRELDIALCRRQSEAFATTLVHEQELGIVVRKNSELHQKVAGKDNATLFDLEGLRVLAHSRGEVRIQEEILKNAMLAAGVNATWIFRKFGQYSSLIADLVQADVALTTEESARTNFPSWQWVPIEGEDASGNDLVVRTWITWNPQPTPAVKALIQKFIDGN

SEQ ID NO: 2769 - DNA, 860 bp, Corynebacterium glutamicum
  CDS (1)..(837): RXA02514
aactcccacaacccaaccccagtaaccatcacggttactggcaagggtgaaggcgttacctctttcggcgcaatctccatcgaggttgaagcgggcgcagacgctatcgtcgcactgcagtacgtcggatccggcacccacgctgacaacgtcgaattcatcgttggcgacaacgcacgcctgaccgtcatcacggacacccactggaacgctgacgcagttcacctgagcaaccagcttgcacagctgggacgcgacgcaactctacgccacaccgtggcaaccttcggtggagaagtagtccgcatcgtcccacgcgtgcgtttcaccgcaccaggtggcgacgcagaaatgctcggcgtctacttcgcagatgatggacagtacttcgagcagcgcctgctggttgaccacgctgtaccaaactgtcgctccaacgtcttgtacaagggcgcacttcagggtgacaagaactctgacaagccagatgcccgtacctgctgggttggcgatgtgctcatccgctcaaacgcccacggcactgacacctacgaagctaaccgctcactcgtcctcaccgagggtgcacgcgcagacgctattccaaacctcgagattgaaaccggccagatcgttggcgcaggacacgcagcaaccgtcggtcgtttcgacgacgagcacgtgttctacctccaggcccgtggtattcctgcagaggaagcacgccgcctcatcgtccgcggtttcttcaacgaagtgatcaacaaggtcccagttgaatccatccgcggggaattggacaaccgagtcagctcggaactcgcagttcttggcatgtaattaagccaaagtaactaagc

SEQ ID NO: 2770 - protein, 279 aa, Corynebacterium glutamicum
NSHNPTPVTITVTGKGEGVTSFGAISIEVEAGADAIVALQYVGSGTHADNVEFIVGDNARLTVITDTHWNADAVHLSNQLAQLGRDATLRHTVATFGGEVVRIVPRVRFTAPGGDAEMLGVYFADDGQYFEQRLLVDHAVPNCRSNVLYKGALQGDKNSDKPDARTCWVGDVLIRSNAHGTDTYEANRSLVLTEGARADAIPNLEIETGQIVGAGHAATVGRFDDEHVFYLQARGIPAEEARRLIVRGFFNEVINKVPVESIRGELDNRVSSELAVLGM

SEQ ID NO: 2771 - DNA, 534 bp, Corynebacterium glutamicum
  CDS (101)..(511): RXA02518
cgcgtgaagtgcgcgctgcttgggtggaaggctttccaggcggcaaccgctgacgctgttgcgcacgcacattagcccgctgtattaattggaggaaaccatgagcgagcacaccgagaacacgacagaggttgaagaccagaacgcttccacctttgaagcacaaagctctgagcgcccagagcagtccgaggcagacctggctaaggccagcgatgttgaggagtacatgcgcgacgttattgaccctgaactgggcattaacgttgttgacctgggccttgtctacgatatttacatcatcaacggcaacgaagctcacatcgatatgactctgacttcaccagcttgcccgctgactgacgtcatcgaagatcaggcacgcaccgcaatcgtcggcaacggcattgcagagaagatgtccctgaactgggtatggatgccaccttggggtccacacatgattaccgaagagggccgcgctcagctgcaggccctaggattcgcggtttaaaaggctgcttatcgacgcca

SEQ ID NO: 2772 - protein, 137 aa, Corynebacterium glutamicum
MSEHTENTTEVEDQNASTFEAQSSERPEQSEADLAKASDVEEYMRDVIDPELGINVVDLGLVYDIYIINGNEAHIDMTLTSPACPLTDVIEDQARTAIVGNGIAEKMSLNWVWMPPWGPHMITEEGRAQLQALGFAV

SEQ ID NO: 2773 - DNA, 1566 bp, Corynebacterium glutamicum
  CDS (101)..(1543): RXA02521
gcacacgcaaccattggcaacaatcgcggacggccacggcatctgcacaacaaatattgcattgacacccatcaaacactcctgatgaaaggagcggatcatgacttcggcaacgacgaacccaggggttaacgagcccttgaccgatgaccagatcattgaatccatcggtccgtacaactatggttggcacgactccgacgacgctggtgcatccgcacagcgtggtctcagcgaggatgtcgtacgcgacatctctgcgaagaagagcgagccagaatggatgcttcagcagcgcctcaaggccctgagcatttttgataagaagccagttccaacctggggtgcagacctttcaggcattgacttcgacaacattaaatacttcgtccgctccactgagaagcaggcacagtcctgggaggatctcccagaagacatcaagaatacctacgacaagctgggtattcctgaggccgagaagcagcgcctcgttgcaggtgttgcagctcagtacgagtctgaggttgtctaccaccagatccgcgaggacctggaggaaaagggagttatcttccttgacaccgataccgcactgaaagagcaccctgagatcttccaggagtacttcggcaccgtcattccagcaggcgacaacaagttctccgcactgaactccgctgtctggtccggtggatctttcatctacgtgccaaagggtgtccacgtggacattcctctgcaggcttacttccgcatcaacaccgagaacatgggtcagttcgaacgcaccctgatcatcgttgatgaggatgcctacgttcactacgttgagggctgtaccgcacctatttacaagtccgactccctgcactccgcagtcgttgagatcatcgtgaagaagggtggacgctgccgctacaccaccattcagaactggtccaacaacgtctacaacctggtgaccaagcgcaccaaggttgaagagggcggcaccatggaatgggtcgatggcaacatcggctccaaggtcaccatgaagtacccagctgtctggatgactggcccacacgcaaagggcgaagttctctccgtcgctttcgcaggtgagggacagttccaggacaccggcgccaagatgacccacatggctccttacacttcctccaacatcgtgtccaagtctgtggcacgtggcggtggacgtgcggcttaccgtggtctggttcagatcaacgcaaacgctcaccactcaacctccaacgttgagtgtgacgcactgctggtcgatgacatctcccgttctgacacctacccatacaacgacatccgtaacgatcacgtgtcactcggccacgaggcaactgtttcccaggtttctgaagagcagctgttctacctcatgagccgcggacttgcggaagaagaagcaatggcaatgatcgttcgtggcttcgttgagccaatcgctaaggaactcccaatggagtacgcccttgagctcaaccgactgatcgaactgcagatggaaggatcggtgggctaagcccaatgactgaagtagca

SEQ ID NO: 2774 - protein, 481 aa, Corynebacterium glutamicum
MTSATTNPGVNEPLTDDQIIESIGPYNYGWHDSDDAGASAQRGLSEDVVRDISAKKSEPEWMLQQRLKALSIFDKKPVPTWGADLSGIDFDNIKYFVRSTEKQAQSWEDLPEDIKNTYDKLGIPEAEKQRLVAGVAAQYESEVVYHQIREDLEEKGVIFLDTDTALKEHPEIFQEYFGTVIPAGDNKFSALNSAVWSGGSFIYVPKGVHVDIPLQAYFRINTENMGQFERTLIIVDEDAYVHYVEGCTAPIYKSDSLHSAVVEIIVKKGGRCRYTTIQNWSNNVYNLVTKRTKVEEGGTMEWVDGNIGSKVTMKYPAVWMTGPHAKGEVLSVAFAGEGQFQDTGAKMTHMAPYTSSNIVSKSVARGGGRAAYRGLVQINANAHHSTSNVECDALLVDDISRSDTYPYNDIRNDHVSLGHEATVSQVSEEQLFYLMSRGLAEEEAMAMIVRGFVEPIAKELPMEYALELNRLIELQMEGSVG

SEQ ID NO: 2775 - DNA, 813 bp, Corynebacterium glutamicum
  CDS (101)..(790): RXA02524
gacgcgatcaggcgctcctacgcacccaggcaattaggcctgagcttatcgacgcatccctcctcgattccaccgacctcaaagtattgggactggacaaatgacagagaccacacctcaacccccaaagccagagcccgagctcccgaaatttctcagcaacccagaacgcgccgacatcattttgttcatcgcactcattgtgatgggcattttctccctctgcatgatcccactgcgcgcctggatgctcacccaacctctggcctacaccctcatcgtcggtggttacaccagtgcagtcgtgggcggcgcgaacgcttcggtagaaaacggcatctggtgggtctactggctctgcaccctgatcggcgcgctgaagttcatgcccgtctattggctgatgggtaagcgctggggcatggaatttatcgacatgtccctccaatacatgccccgcttccaccgcatgttcaaaaaatccgtcgactccgaatccacccgcctctacgcctggatcatcggcctcattccactcgcatacctcccaggaccagtgccgggaaccatccttaacgcagtggctgggctggtgaaaatccccttctggatcatcatggcctggaatgcgatctgcgtactatcggtcaacggactattcatgtggctgggatacaccttcggcgaacaagtcctcgacatcgtcaacgtggtcaaccgctacatgctttggataaccttaggattgctggcgctgatgtttttccgcgcacggaagcaatttgccaagtaaatggttgaaaggaatatgac

SEQ ID NO: 2776 - protein, 230 aa, Corynebacterium glutamicum
MTETTPQPPKPEPELPKFLSNPERADIILFIALIVMGIFSLCMIPLRAWMLTQPLAYTLIVGGYTSAVVGGANASVENGIWWVYWLCTLIGALKFMPVYWLMGKRWGMEFIDMSLQYMPRFHRMFKKSVDSESTRLYAWIIGLIPLAYLPGPVPGTILNAVAGLVKIPFWIIMAWNAICVLSVNGLFMWLGYTFGEQVLDIVNVVNRYMLWITLGLLALMFFRARKQFAK

SEQ ID NO: 2777 - DNA, 501 bp, Corynebacterium glutamicum
  CDS (101)..(478): RXA02525
cgtggtcaaccgctacatgctttggataaccttaggattgctggcgctgatgtttttccgcgcacggaagcaatttgccaagtaaatggttgaaaggaatatgaccaccatgcgagaagtttcaaccgacctcaacatcctcatcgtccccagcgaatgggaaaaagtactagaaaacctaccagcgacattgagtgagtccggattcgtagcctctgaaatccactcccagatcgtcgacctcacctgcgaacccgacaacatgcttgtcacccagttctcccagctagagggccacccaccaattgtggaagtgctccaccgcctagtaattaacggctcctccgacctggagcttaaagacctcaccaaaaaggtggtgggggcgttgcctcaggggacctactggtatggaacttcccttgaaggtgcgaccgaacctggcgttaacgcatcatgcgcgtggcagcatcggggctagttttccgcgtttagtcagtt

SEQ ID NO: 2778 - protein, 126 aa, Corynebacterium glutamicum
MTTMREVSTDLNILIVPSEWEKVLENLPATLSESGFVASEIHSQIVDLTCEPDNMLVTQFSQLEGHPPIVEVLHRLVINGSSDLELKDLTKKVVGALPQGTYWYGTSLEGATEPGVNASCAWQHRG

SEQ ID NO: 2779 - DNA, 561 bp, Corynebacterium glutamicum
  CDS (101)..(538): RXA02540
gcatatgctgaagcagaaactaattcaggttttgatccccgcgctaactgggcgggccagaaccgctagacgttctctttgagaaaggaggtgacgaaacatggcatccacaccgaaaaaatccaacgatgaaggtcagtttgaccgtgtcgattttcaaggggaagtcttcgttatctctgtcgcagccgagcttgccggcatgcatgcccaaactttgcgaacctacgatcgcatgggtttggtcaccccgatacgcactcgcggaggcggtcgccgttactcccgcgctgacgtggaattactccgagaaattcagcacctcagccaggaggaaggcgtaaacctcgccggaatcaaggcgatcatcgagctcggcgaagaaaaccgaaacctcaaagaatccctgcgtaaggtcacagctgagaatgagcagctcaaagatcaattacgcagcgggcgtccgcgtggcgagctggtgcacgtgccccgctccaccgcggtggtcatgtgggaacgccgcaaggggcgttccaagtaaaaacatgcttgtcgacgcca

SEQ ID NO: 2780 - protein, 146 aa, Corynebacterium glutamicum
MASTPKKSNDEGQFDRVDFQGEVFVISVAAELAGMHAQTLRTYDRMGLVTPIRTRGGGRRYSRADVELLREIQHLSQEEGVNLAGIKAIIELGEENRNLKESLRKVTAENEQLKDQLRSGRPRGELVHVPRSTAVVMWERRKGRSK

SEQ ID NO: 2781 - DNA, 1551 bp, Corynebacterium glutamicum
  CDS (101)..(1528): RXA02544
ccaatcagggaagataagagctgttttcaacaggtcccactcaactttgacaccaagtctcacgcaaaattaacagccataaactttagaaggacaccctgtgtcccacacctgtggcatagtgatttttgtgagcacagaatcaggaaacaccccaaaaagggatgatgcaaaaagcaccatccctccgaaagatttgcctgacaccgtcttagacgcgattgaaggcaattttgagccaccgctaaatacccagaagtcggcggttccccctaatgccgaagcaactgtcgaggctgattctgaaggaactaccgaccgctctgtcattttgggcagggacggccgctggctgtccggatgggcattgcgcttcatcgtgctggttatcgccggcgtcattgcacttcgtatgctgggcttcatctgggttggcatcctcccagtcgtcctcgcacttctagtctgcaccgtgctatggccaccagtgaaatggctgcgcgagcataagattcccacggcgctcgccgttgtcatcacaattttgggtttcttcgccctcatcggcggagtttttgcagccatcgcgccaagcgtgtcttcccagacaaagcaagtggtagaccaagcaactgttggtatcgaagatctaatggattgggttcagggcccaccttttaacttagatatctcacagtttgaaggcgcgctcaatgacctaacatccatgctgcaatcacagtcttccaccattgcttctggtgtgttctctggactgtcaacggcatcatccatcgttgtcacactagcagtgatgctggtgttgaccttcttcttcctcaaagacggtcctcgtttcctgccatggatgcgcggcttcactggtgaaaacgcaggttggcacctcacagaagtcctgacccgtacctggaataccttggccggattcatccgtgctcaggcattggtgtccatggttgacgcaatattcattggtatcggattgctgcttcttggcgtcccaatggccctcgcgctcgcggtcatcacattcttcgcgggcttcatccccatcgtcggtgcggtgtctgcaggcgccctggctgtcatcatcgcgctagttaccaacggcgtgaccaatgcgcttttggtacttgtattgatcctggcggttcagcagatcgagggcaatatcttgtccccattcctgcagtccaaggctatgaacctgcacgcagcggttgttttgctatccgtcaccgtcggctccaccatgttcggcatcatcggcgcattcttggctgttccagtagccgcgacgttggctgtctgggtgcgctaccactctgaaatggttgctttgcgcgccggtgagatcaccagtgatgacattgagatcgccacgacgaaaggttccccaaccagcctcaatggccaagaaacccttgctgccattcgaagcagattcgccatccttggccgcaagaagccgacatctgccactgcagaaaaagcagactcagaaagctagccaataatgctcactcccga

SEQ ID NO: 2782 - protein, 476 aa, Corynebacterium glutamicum
VSHTCGIVIFVSTESGNTPKRDDAKSTIPPKDLPDTVLDAIEGNFEPPLNTQKSAVPPNAEATVEADSEGTTDRSVILGRDGRWLSGWALRFIVLVIAGVIALRMLGFIWVGILPVVLALLVCTVLWPPVKWLREHKIPTALAVVITILGFFALIGGVFAAIAPSVSSQTKQVVDQATVGIEDLMDWVQGPPFNLDISQFEGALNDLTSMLQSQSSTIASGVFSGLSTASSIVVTLAVMLVLTFFFLKDGPRFLPWMRGFTGENAGWHLTEVLTRTWNTLAGFIRAQALVSMVDAIFIGIGLLLLGVPMALALAVITFFAGFIPIVGAVSAGALAVIIALVTNGVTNALLVLVLILAVQQIEGNILSPFLQSKAMNLHAAVVLLSVTVGSTMFGIIGAFLAVPVAATLAVWVRYHSEMVALRAGEITSDDIEIATTKGSPTSLNGQETLAAIRSRFAILGRKKPTSATAEKADSES

SEQ ID NO: 2783 - DNA, 681 bp, Corynebacterium glutamicum
  CDS (101)..(658): RXA02545
aagaaatcgagaaagtaattcgtgggtgaagttgtttcagagttgttttttattaaacaactcagcctgtaacctcttggtcgttctatgcttggtcaccatgactgagactctttttgtatccgccacaactgaggaagcggtgtatcttccagatggaatcgacttgctggtgactggcatcggaacgaccgcagcaacgatgattttgactaaggagttggctactcgggaggtgcttcctgcccgaattgtcaatattggtacggcgggagctttggtggatggattggctggcgtatacgagatcgaatacgttctgcagcatgatttcagtagcgagttaatcgctgaaatgacaggaaagccatgctcaaatggttcaactttggccacgagtgggcacttcccagtagcgagtttggcaacaggaaactcatttattgcagattcagaaacccgcaaccacctggccacccgggcctccctctgcgatatggagggcgcggcgctggtgggcgtcgcaaagcattttggtgttccgattacgctgctgaagcaggttagtgacagcgcggatgaggaggcttcggggtcgtggtttgatgcggtcgatgcgggcgcacgacagttggcggaggctgtgaaggagtttaaataacaaaaacccgatgcctggcg

SEQ ID NO: 2784 - protein, 186 aa, Corynebacterium glutamicum
MTETLFVSATTEEAVYLPDGIDLLVTGIGTTAATMILTKELATREVLPARIVNIGTAGALVDGLAGVYEIEYVLQHDFSSELIAEMTGKPCSNGSTLATSGHFPVASLATGNSFIADSETRNHLATRASLCDMEGAALVGVAKHFGVPITLLKQVSDSADEEASGSWFDAVDAGARQLAEAVKEFK

SEQ ID NO: 2785 - DNA, 1227 bp, Corynebacterium glutamicum
  CDS (101)..(1204): RXA02546
gattatgtcggctccaccatcgtggtcagctacaccgaaaaaccaaacgcccagggcgcaattcagggcaattccagtttctctaggatcgagaaataacatgccattgtttatcgacgacgccctccaccgcagcaaaaaatacttccacgcgcacttaagcgagctgctcctcggcgaatttgcaggcctcagcctgcccctgcacccaccgacggcagctaaagccgccgccgatattgatgccacgagggaatttatccgccaatgggaggggcgtgatgatgtggaatatgccattcgaaactggtctcctgtgggcttaggtaaaactgaagtacccgttaggctgacgttgaacacgactgaggaattagttgtgtttgcgcaggtagaggatgaatggtcttcacttcacgagaggttttcacagctgtctggttttacagcggaggtggtggcgaaacatgtgtcgctgtggcgttcgctgtctaacgatgatctctctaaggcagtgttagttgtggattggtttttgaaacaccctaactctggcctgctgaaacgcgccgtcgcagttgaaggcgtgcataccaaatggctcgaaaaccaccgcgtactcattgaaacgttagtggccgacaaacgtggtgaacctggtcgtgccgatcttggacttggtgacgccgaagctcgcgtccggctccgcttccattccgtagatgctcccgctgggctcacagacattgaagtaccgctttccaacctgtgtgaattacaagaaccgcaagtaattctgatggtggaaaacctcgattcatttctcgctttacccacttggccgggcgtaacaattgcttggggtgcgggctaccgtgcagtagacattgttcgaggaccctacttttctaatggtcggttgctgtactggggtgaccttgacctggacggtttcaaaattctcgacggcgtccgcagccatgttcctcacaccgaatccgtgctgatgaactctgaaaccgtctcccgctggcgctaccttggcgttgccgaccgagaattcaaggcagagagctttgacaaccttcatgattttgaatctgacgcacttgacctactcattacagacggtgagctccgcattgaacaagaacgcatccgcctcgatgttgctgttgaagaaatcgagaaagtaattcgtgggtgaagttgtttcagagttgtttt

SEQ ID NO: 2786 - protein, 368 aa, Corynebacterium glutamicum
MPLFIDDALHRSKKYFHAHLSELLLGEFAGLSLPLHPPTAAKAAADIDATREFIRQWEGRDDVEYAIRNWSPVGLGKTEVPVRLTLNTTEELVVFAQVEDEWSSLHERFSQLSGFTAEVVAKHVSLWRSLSNDDLSKAVLVVDWFLKHPNSGLLKRAVAVEGVHTKWLENHRVLIETLVADKRGEPGRADLGLGDAEARVRLRFHSVDAPAGLTDIEVPLSNLCELQEPQVILMVENLDSFLALPTWPGVTIAWGAGYRAVDIVRGPYFSNGRLLYWGDLDLDGFKILDGVRSHVPHTESVLMNSETVSRWRYLGVADREFKAESFDNLHDFESDALDLLITDGELRIEQERIRLDVAVEEIEKVIRG

SEQ ID NO: 2787 - DNA, 1326 bp, Corynebacterium glutamicum
  CDS (1)..(1326): RXA02549
accctcactgcaatctcctccgaaacttggcctatcatgctcgcgccatgggtatgtctgcctctgctttcgcgaaatgtggatgcacgggccatcgcgttgtccttacttcccgcggcatgcatgggtgcagttaatgccaccgccacgatggcagcactcatcccggcagcgctgatcttgctgtatagagggctcttcttaaggctgcttctgtggggaatgggcgttctcgctgttaattcatggtggatcggacctttgttggtgcttggcaaatacgccccgcccttcaccgaattcatcgaaagttcctccgtcaccacttcctggctcaacccagtagaaatactccgcggaaccaccagttggacacccttcgtagacactgaacgacaagccggatatctcctggtcaacgatgctctctttgtcaccctcagcgttctcgtcgcagccctcggcttgatcggcctcaccttgatgaaacaccgtggactgtgggcattcatgctggccatcggactcctcatcctcggcagcgcccacctaacggctgttcaagaattcctcgacggcccaggcgcagcacttcgaaacatccacaaatttgatctattagtccgcatgccgttgatggtgggcgttgccgcattggggtcgcatatcagtctgcccttgcttgggacgactgcattgaccagcggacaaggcaaacaccacaccatcccgctgcctctccaaaaacgccaagccgcaggactcctcgtggtgatcatcgctgtcggtgctcttgctcccgcatggtcggcacggctgctacctcagggaacgtgggatgaagtgcctgactactggtacgaagccacagaattcctcaaccaaaacgccacaggcacccgcacgttgatttggcctagctcgccgtttgcccgccaggactggggatggactcgggatgaaccagctcaaccacttcttgatgttccgtgggctgtccgcgatgccattcctttggttcccccggaggcgattcgcggattagatggtctcgacgacctaggcactctaggcaccggtctaaacgacgaggctttaaaacgtctaggcatcggcgcagtactggtgaggcatgatctggaagccgacccagatattgaggtggatctgcctggggaaaagcacacttttggctcccaaggccaagtagacgtctacctcaccgaccccgaccgcaatatgtggatcacttccggcacatccaagcagctgcccaccgtcgctggcggcggcgaaatcctctcgctcctagacaccatcaacggc

SEQ ID NO: 2788 - protein, 442 aa, Corynebacterium glutamicum
TLTAISSETWPIMLAPWVCLPLLSRNVDARAIALSLLPAACMGAVNATATMAALIPAALILLYRGLFLRLLLWGMGVLAVNSWWIGPLLVLGKYAPPFTEFIESSSVTTSWLNPVEILRGTTSWTPFVDTERQAGYLLVNDALFVTLSVLVAALGLIGLTLMKHRGLWAFMLAIGLLILGSAHLTAVQEFLDGPGAALRNIHKFDLLVRMPLMVGVAALGSHISLPLLGTTALTSGQGKHHTIPLPLQKRQAAGLLVVIIAVGALAPAWSARLLPQGTWDEVPDYWYEATEFLNQNATGTRTLIWPSSPFARQDWGWTRDEPAQPLLDVPWAVRDAIPLVPPEAIRGLDGLDDLGTLGTGLNDEALKRLGIGAVLVRHDLEADPDIEVDLPGEKHTFGSQGQVDVYLTDPDRNMWITSGTSKQLPTVAGGGEILSLLDTING

SEQ ID NO: 2789 - DNA, 918 bp, Corynebacterium glutamicum
  CDS (101)..(895): RXA02552
tccttaaatacccactgtcctctattctgggttaggcttcactgggtaaaagtgcctgcctatgcctgaaacttgagcatggcaacagcaaggagacaccgtgggaaaacatgcagctgaaacatcggaaccgaagaaaaattcaccgtggcgcattggtttgttgacgtttttgatttcttcagttgtcgtgacgctggtgggcatggtgatgctgtggccggattctgatgatgtggtgttggcggataacttttcgcagacgtttgcgggaaatcatgagcaggtggatggaacgatcacgctcgttgataattctgcgtgtaattcgccagacaccggccgagtttttgcggaaagccccacgatttctgcggagccggcaacgttggagtgcgtgcgtgcactcgtagacatcacatcgggtgccaatgaggggcagaaaactcagctgatcacttacgcgcaacctggtgatccggagttttccgagggcgacaagatccgcatggtggaaacaccggatacaaatggcgagatcatctacacctttgctgattaccagcgcggaccggcgttgatcatttggggtgtggttctcattgtggcgatgggagctttcgcggcgtggcgaggtgtgcgtgcgctggttggtttggtcgtcaccttgggaattgttggtattttcttgctgccaggattggccagcgggcacgatgcgatgtggttggcgctggtgtgtggcgcggcgatcttgttgattgtggtgccgatggttcacggaatcaactggaaatcggcagctgcgttggcgggcacgctggtggcattgttgttgtcggcggtgttgtcgtgggcgtcgatcgtcaccactgaatttgcgcggactgggcgatgagaatcatctgaagatcatca

SEQ ID NO: 2790 - protein, 265 aa, Corynebacterium glutamicum
VGKHAAETSEPKKNSPWRIGLLTFLISSVVVTLVGMVMLWPDSDDVVLADNFSQTFAGNHEQVDGTITLVDNSACNSPDTGRVFAESPTISAEPATLECVRALVDITSGANEGQKTQLITYAQPGDPEFSEGDKIRMVETPDTNGEIIYTFADYQRGPALIIWGVVLIVAMGAFAAWRGVRALVGLVVTLGIVGIFLLPGLASGHDAMWLALVCGAAILLIVVPMVHGINWKSAAALAGTLVALLLSAVLSWASIVTTEFARTGR

SEQ ID NO: 2791 - DNA, 747 bp, Corynebacterium glutamicum
  CDS (101)..(724): RXA02554
gcttttgaagtgtgtcgcgtgtgcggactgaaatagtttccgcttcaacttggttgctaaggataggctccataaaaataaccaaaggcggaaaatttcaatgtcacacactaagccatccattgccatcctcggtgctggccgagtgggttcttcacttgccaggtcagcggtcgccgcaggctatgaggtaaaggttgctggttcaggtgctgtggacaaaatcgctcttaccgctgagatccttatgcccggcgcggttccaagcactgctgaccaggctgtaaaggatgcagatattgtgttcttggctgttcccctgcataaattccgcagtgtcaatccagccactttagagggcaagatcgttattgacacgatgaaccactgggttccggtcaatggtgagttggaggaaattgatcaggatccgcgcagcacttcggagattattgcggagtttttcgcgggatcaaccatggtgaagtcttttaaccacattggttatcacgagattgagcaggatgcgggtaccgggcgtgcgattgcgtatgccacggatgatgtggatgcaggtgcccaggttgcacagctaattaagagttttgggtttgttcctttaaatattggcgcattggaaaacggccgtattctggaacctggccaagaagctttcggcgcgcaccttaataaagattcgcgcctagaacttgttaatcagcggtagtacctcgatcttcagccaac

SEQ ID NO: 2792 - protein, 208 aa, Corynebacterium glutamicum
MSHTKPSIAILGAGRVGSSLARSAVAAGYEVKVAGSGAVDKIALTAEILMPGAVPSTADQAVKDADIVFLAVPLHKFRSVNPATLEGKIVIDTMNHWVPVNGELEEIDQDPRSTSEIIAEFFAGSTMVKSFNHIGYHEIEQDAGTGRAIAYATDDVDAGAQVAQLIKSFGFVPLNIGALENGRILEPGQEAFGAHLNKDSRLELVNQR

SEQ ID NO: 2793 - DNA, 854 bp, Corynebacterium glutamicum
  CDS (82)..(831): RXA02569
aatcttcaaatcgttcccgcaagcaaaaggtgacatactgctggcttgtttttgcattcgacgatctgcatggggattactatgtcacgctcatctaaaatttcggtcgcgtttggtggcctactcatcgctgctacctggctgtatttggtcttggtcaggcctaccgattgggaatcagtgggtggttccacggaagcgttgatcacgttggtgggctatgttgccggcacgatcgcgttgttggttggtgtgctgcctacgcttccagccaggaccattgcgatcattcctgtggctttggtgctcaatattttgttaggccaagtcactggttcttttgtcattccgctgtatttagatgcggtgggcacagtgctggtcgcagctcttgctggtcctagtgctggtttggcaacaggtgctttaagttctgtggtgtgggcgttgttcaatccgctggctttgccgtttgctgcaggttccgcgctgactggttggttgaccggtgtggtgattaaaaagggtgcgtttaagaatatcttcgccaccatcatctctggtgcggtcattggtttgatcacgggtgctgtcgctgccccggttgcggcgtttgtttatggcggaaccgccggtgtgggaactggtgcggtggttagcctcttccgcgaaatgggtaactctttgctcgcatcggtaacctggcagtcgtttatttccgatcctttggataaggccattgttatgctcattgtgtttgtggtggtcaagtcgctacccaagcgcaccactagggcattggttccgcagcgggttccggaggacgtcgcttaaacatgaatcctttgacatgg

SEQ ID NO: 2794 - protein, 250 aa, Corynebacterium glutamicum
MSRSSKISVAFGGLLIAATWLYLVLVRPTDWESVGGSTEALITLVGYVAGTIALLVGVLPTLPARTIAIIPVALVLNILLGQVTGSFVIPLYLDAVGTVLVAALAGPSAGLATGALSSVVWALFNPLALPFAAGSALTGWLTGVVIKKGAFKNIFATIISGAVIGLITGAVAAPVAAFVYGGTAGVGTGAVVSLFREMGNSLLASVTWQSFISDPLDKAIVMLIVFVVVKSLPKRTTRALVPQRVPEDVA

SEQ ID NO: 2795 - DNA, 765 bp, Corynebacterium glutamicum
  CDS (101)..(742): RXA02570
ccattgttatgctcattgtgtttgtggtggtcaagtcgctacccaagcgcaccactagggcattggttccgcagcgggttccggaggacgtcgcttaaacatgaatcctttgacatggatcattggcgcattcagcatgtggatcgtggtgctgggcgttaataagcttggtttaagcatcgcagtgatcatcatcgcgcaggtcgtggcgatgattcgggtgcgcaatgtatctgtgttggcttcaacagcattgttatcggttcctgcattggcctcgatggcgctgattcacatgccgtattcttccgacggctggttgattgctcttaccttgacggctcgttttagtgcgttgatgtctattttcctccttgcagcaacagcgattactattcctgagctggtgaaatccctatatcgttggcccaagctggcgtatatcgtgggttctgcattgcagatgattccgcagggtaaacagaccttggcgttggttcgtgatgccaatgctttgcgcgggcgcagcgttaaaggtcccgtgcgcgcggtgaaatatgtgggtttgcccctgattacacatttacttagtgcaggtgccgcgcgagcgattcccttggaggtcgcaggcctggacaggccggggccgcgtacggtgttggttgaggtggtggaggggcgcgtcgaaaagcattgtcgctggttgttgccgcttttggcagtcgggatggcgtggtggctctaactcaaatcgtcggaccgtcc

SEQ ID NO: 2796 - protein, 214 aa, Corynebacterium glutamicum
MNPLTWIIGAFSMWIVVLGVNKLGLSIAVIIIAQVVAMIRVRNVSVLASTALLSVPALASMALIHMPYSSDGWLIALTLTARFSALMSIFLLAATAITIPELVKSLYRWPKLAYIVGSALQMIPQGKQTLALVRDANALRGRSVKGPVRAVKYVGLPLITHLLSAGAARAIPLEVAGLDRPGPRTVLVEVVEGRVEKHCRWLLPLLAVGMAWWL

SEQ ID NO: 2797 - DNA, 567 bp, Corynebacterium glutamicum
  CDS (101)..(544): RXA02573
cttccacacggctctaactataggaaaagacggcagcaaagcattaatcgtcggtaggctgaagtgaagtactttccgaaagattcacagggagcatgcaatgacgaacaaaaccatgctggttgcttttgatggctcaccggaatcccggcgcgctttggaatatgcggcgaaattgttgcagccgcgcaccgtggaaattttaactgcgtgggagccattgcatcggcaagctgcgcgctcggtttcgttgatcaccttgggggtggaacccgaagaccccgcccattccgctgcactaaaaacctgccaggaaggcgtagagctagcccaatctctaggtctggaagcgcgagcccacatggtggaatccgcaacggccgtgtggagcgccatcgttgatgctgctgacgagctccgccccgacgtgattgtcaccggcacccgcgggatctccggatggaaatccctgtggcaatcctccacctcagacagcgtgctccaccacgccgacgtaccagtttttgtcgttccacccctggactaaaaccgagacgagaaccaaga

SEQ ID NO: 2798 - protein, 148 aa, Corynebacterium glutamicum
MTNKTMLVAFDGSPESRRALEYAAKLLQPRTVEILTAWEPLHRQAARSVSLITLGVEPEDPAHSAALKTCQEGVELAQSLGLEARAHMVESATAVWSAIVDAADELRPDVIVTGTRGISGWKSLWQSSTSDSVLHHADVPVFVVPPLD

SEQ ID NO: 2799 - DNA, 1258 bp, Corynebacterium glutamicum
  CDS (101)..(1258): RXA02575
ccaattgctctacatcacacgtctcgaacaaaagtgaagttaccagtccgtaaccccttctgagtaggaatttcgcatcagtgcaactagcctttcaggtgtgaagaactctgggaaaaattcggcaaagaatcggaccaaagggatcctaatcggggttctcgttggtctgattgccatttttgcaggcatctatgcggtcgatgttttcctcaacaaggacaacatccctcgtggaacaaccgtcggtggcgtcagtatttccaacctcagtgcacaagaagcccgcacaaagttggaaaccgaactggccaatgatgtggtgcagcccgtcaccgtgacggcaggggagcagagcaccacttttgatccagttgcctccggcgtcggcatcgattgggacgcaaccatcgaaggcaccggcgagcagtcttggaaccccattacccgcttcgtggcgctgttcaaagaatccgaatctcccatcgtgagcaccgtcgatcccgcagccttcggcccgacccttgatcgcatggtcggcgaactctatcgagatcccatttccggaaacctgcatatcgacgccggcaccctcgtggtcaacgacaccatcgacggacaagccgtagaccgcaccattttggaacaagcagtcacagaaaactggctcaacccagagggcgtaaaagccgagccatacgttgttcccgctgcgatcagccaagacaccatcgataaacttgcagaaggcgccggagctaaagcagtatctagccctttcgtcgtccgaggcgatgacggaattgaaggcaccatccccgtcgagcgcatgggtgaagtggtgagtttcccagaagaaaacggcaccatccgcgtcgacatcaatgcagaagcagcaacagcaatgctggccgaaggtctcaaagaaacagagatcgagcccaccaacgctcaaatcagtttctcctcaggctcccgcgtagtcaccccagaagtcaccggacacggaatcaactgggaagaaaccctggccgatctgcccaacaacctcaccggcgatggcccccgcaccatcgacgcaatctacgaggacaccccagcaacattcaccgccaccgacgcccaaaacgctaccttcaatgaggtcatgggcgagttcaccaccggcggcttctctgctgcctccggaacaaacatccgcctcaccgcgcaaatggtcgacggcgcagtcgtttcacctggcgatacattctccctc

SEQ ID NO: 2800 - protein, 386 aa, Corynebacterium glutamicum
VKNSGKNSAKNRTKGILIGVLVGLIAIFAGIYAVDVFLNKDNIPRGTTVGGVSISNLSAQEARTKLETELANDVVQPVTVTAGEQSTTFDPVASGVGIDWDATIEGTGEQSWNPITRFVALFKESESPIVSTVDPAAFGPTLDRMVGELYRDPISGNLHIDAGTLVVNDTIDGQAVDRTILEQAVTENWLNPEGVKAEPYVVPAAISQDTIDKLAEGAGAKAVSSPFVVRGDDGIEGTIPVERMGEVVSFPEENGTIRVDINAEAATAMLAEGLKETEIEPTNAQISFSSGSRVVTPEVTGHGINWEETLADLPNNLTGDGPRTIDAIYEDTPATFTATDAQNATFNEVMGEFTTGGFSAASGTNIRLTAQMVDGAVVSPGDTFSL

SEQ ID NO: 2801 - DNA, 1545 bp, Corynebacterium glutamicum
  CDS (101)..(1522): RXA02576
cttaggcctgtcgttgcttgcgattggtgtgttcctcacgggaattttcaagcgcggccagctgatgagcactgtgaataaactcaggagttaaatccttatgaccccgacccgccgtatcctgctgtgggcatggacgactgtgcttttgggttctttgctgtggccgttggctgcgcctggcgagttgttgttgcgggatatgtcggtggtggaccatcctgcgttgtcgttgaatgcgttgggttttggtgatttgccgtcgcggaacgccccgcaggatggtgtgctggcgttgcttggctttttgccggtgagttggatcgttcgaaccatgctgcttgtggcgggtttcgcgggcgcgtggggtgcgatgcgccttgggccttccaagtttttggccgttaccgtggcgatttacaatcccttcgtggtggagcgtctgctgcagggccattggtcgttggtgatggcggtgtggctgttcccgctggttgtggcgctgcgcaggcatccgcgttggcaggttgtggcgatctgggcggcgtcgttgacgcccacgggtgcggtggttgcggcggtcacgggcgtggcgagttctaaaagaaaacgctttacgacgctatgttccttcctttcgtggcttccttggctaatacctgcgcttcttgccacccccacttcgggaggtgcgctgaccttcgccattcgttctgaaacatatgcaggaacgttgggaactgcgctgggcctgggtggaatttggaacgcgggggccgtgccggcctcacgcgaactgggtttcgcggttgctggaattttgttatttgcgattctgctggcgggtttcaaaaactgtccgtgggttctcgcactgctggcggtcgtaggttttatgggggcgatcggtccgtggctgatgccgaatctgttcacgtggaccatcgcatatgttccaggcgccgcgctgtttagggattctcaaaaactcctcatgctggctatccctgcctatgtgtgtttggccgccggggtgaaaagcccactgtcgtgggtggctaccggtttggcgttgctccagattcctgatgcaccacgtgaggtttccgtgatacgcccaagttcagcgcatgtggaatcagtggaagcactggcagaaatcgctgatggccgcgacatcttaatcatcggccaaggccccttggtgacccgcgaggatgggatcccggttgtcgatcccaaaaccaaagccctctccgtggtggaatccggcgaactgcgtgtggacggaatcatcaccgacgcgccctcacagcggtggaccgaagcaacgcaggcatgggcggccggggatatcgagcgccttgaagaacttggcgttggtgtcgtggtggatggagatacgatcacagaaactggcgcaccaccgcagcatggctggaaatactacctcggtgtgggcctgaccgtgctgtggatggcgttgccgctgggactactttttcgacgcaagaccaagaagtagttcctcgaactgcgctcccg

SEQ ID NO: 2802 - protein, 474 aa, Corynebacterium glutamicum
MTPTRRILLWAWTTVLLGSLLWPLAAPGELLLRDMSVVDHPALSLNALGFGDLPSRNAPQDGVLALLGFLPVSWIVRTMLLVAGFAGAWGAMRLGPSKFLAVTVAIYNPFVVERLLQGHWSLVMAVWLFPLVVALRRHPRWQVVAIWAASLTPTGAVVAAVTGVASSKRKRFTTLCSFLSWLPWLIPALLATPTSGGALTFAIRSETYAGTLGTALGLGGIWNAGAVPASRELGFAVAGILLFAILLAGFKNCPWVLALLAVVGFMGAIGPWLMPNLFTWTIAYVPGAALFRDSQKLLMLAIPAYVCLAAGVKSPLSWVATGLALLQIPDAPREVSVIRPSSAHVESVEALAEIADGRDILIIGQGPLVTREDGIPVVDPKTKALSVVESGELRVDGIITDAPSQRWTEATQAWAAGDIERLEELGVGVVVDGDTITETGAPPQHGWKYYLGVGLTVLWMALPLGLLFRRKTKK

SEQ ID NO: 2803 - DNA, 1008 bp, Corynebacterium glutamicum
  CDS (101)..(985): RXA02577
ggggtcgacggaggtttggaatgcaacgtgggtcgccaagactcccagggaggcgattgcgcgtagtccctcgagtgagctgatgaatccgcgatggcggatgggtgcatatgattgggtagacattatttcaacatgcgagtttagcggaaaggtgtgggctgtttttatgaagcgatctgcaacggtcctcattattgcgggcgtgctgttcctcatttttgccttcacggtaccgccgtatgtgactggtcaggcgcggacgattccgaaggatttggatctgacgttggtgagcgaaagtccgcaggggtttgtgcgcactgaacatattgtgactgctccgacggaaaaggtcgatgagatcgcgacgcatgtggatcagacagttacggatgtgcaggggaaaactgttgcggaaatttcggatgatgtggtgttgattggacactctcgttatccggtgattaagccgactgccaccatttcgggttcgccggcggatagtagcaatgtggtgcgggaggggttgcattacttcttcccggctaatacgttgcggaattcttatccctattatgacatcgtattgggtgaggattccccggtggattatgtctcgcgcgagggcaatacttataccttctaccagcatcttcgttatgttccattggatgattctcacacctattcggtggagcggaccctgaaagtggatcgtttttccggcatcattgtggctaaagatgaggcgatgacgtttcatggcccagacggcgatgacacagtagaattcacttatactgcggatacgttgaagcttctgcaggatcatgcgcatgatattgatcagcggttgtcgtgggctaaggggtttgatttcttttctaaattcttaggcctgtcgttgcttgcgattggtgtgttcctcacgggaattttcaagcgcggccagctgatgagcactgtgaataaactcaggagttaaatccttatgaccccgacccg

SEQ ID NO: 2804 - protein, 295 aa, Corynebacterium glutamicum
MGAYDWVDIISTCEFSGKVWAVFMKRSATVLIIAGVLFLIFAFTVPPYVTGQARTIPKDLDLTLVSESPQGFVRTEHIVTAPTEKVDEIATHVDQTVTDVQGKTVAEISDDVVLIGHSRYPVIKPTATISGSPADSSNVVREGLHYFFPANTLRNSYPYYDIVLGEDSPVDYVSREGNTYTFYQHLRYVPLDDSHTYSVERTLKVDRFSGIIVAKDEAMTFHGPDGDDTVEFTYTADTLKLLQDHAHDIDQRLSWAKGFDFFSKFLGLSLLAIGVFLTGIFKRGQLMSTVNKLRS

SEQ ID NO: 2805 - DNA, 474 bp, Corynebacterium glutamicum
  CDS (101)..(451): RXA02584
gactcaaggccaatgaatccctggatgtggaacaggatacgattaactcagactctaaccgacagtccgcaattgaaaggccagatacgtgaaccgctggatgtccttgctgtgtgattccatcgccatcggtctcttcgcactcttcgcccgcgtcgcccaccaaagcgccgacatgccactaaatgtgcagggctggtttttcacatggctgccattcctcgcaggtgtgttcatcgcctacctggtggcaatcctccctgcgaagcttcccagcgaacgcatccgccccgctggcctgaccgtgtggatactcgcggtaattgtgggacttgtgatttggggcttcaacaatggtggggttccacactggtccttcatgattgtcgcaacgaccgcctccgccattttggttctcggctggcgagcgttgtttaaggtgacaatgcgctaagtgcttttaaaaaatgggag

SEQ ID NO: 2806 - protein, 117 aa, Corynebacterium glutamicum
MSLLCDSIAIGLFALFARVAHQSADMPLNVQGWFFTWLPFLAGVFIAYLVAILPAKLPSERIRPAGLTVWILAVIVGLVIWGFNNGGVPHWSFMIVATTASAILVLGWRALFKVTMR

SEQ ID NO: 2807 - DNA, 1104 bp, Corynebacterium glutamicum
  CDS (101)..(1081): RXA02585
gcgaggatttttcagcaacccctggattcgttgggctttgtccctggcgtttctaggggtgatcctatttttcctgagggatcagctggatttcctcaaaatgggcatccaacaaatccgccacgtcagccccgtaggcgttgccctcaccatggtggcgttggtgttgtcattcgttgcgatggccagagtcatgcagatcatgttgaaagccggaggtagtcctgcgactctcaaagccaccacggctttaacttttgcggctaactcctggtccgcgacccttcctggcggcccggcgttttccgcgattctcacctataaagtgcagcgcagctggggtgccagcgccgtgctgtgttcgtggtttttcctgctctccagtgccctatcgaccgtctggttggttgctctcggtgtcatcgccgtgttttatatgggcgcatcgctgaacttatggtcactgatcgccacattcatcgccatggtcgggctgtctggcgccgtttattgggcagccaacaaccccgactccttggctcggtgggtgcgaaaattgacgaaaaacagggagtggggcttcgtcgaaaagcttcttggaagcattgagcagctgcgctcggtctcgctcaccgggccgcaattcgcggccagcaccgcgtggtctttaggcaataggcttttcgacgccatctccctctggatttgcatctgggcggtcaccggcactgccccgatgtttgaaccagaacccaacaacaccaccatcgcaggcgtactgttggcgtacaccaccgcaaaaatcgcaggctcaatccaagccaccccaggcggaatcggccccatcgaagccgcctacatcgcagccctcgtagccaccggtatgaccgcagtggaagccgccggagctgtcataatctaccgtttatgctcatttatcatcatggcgattgtcggatgggtcatctattttatctatttcaccccccagggactcaaggccaatgaatccctggatgtggaacaggatacgattaactcagactctaaccgacagtccgcaattgaaaggccagatacgtgaaccgctggatgtccttgctg

SEQ ID NO: 2808 - protein, 327 aa, Corynebacterium glutamicum
MGIQQIRHVSPVGVALTMVALVLSFVAMARVMQIMLKAGGSPATLKATTALTFAANSWSATLPGGPAFSAILTYKVQRSWGASAVLCSWFFLLSSALSTVWLVALGVIAVFYMGASLNLWSLIATFIAMVGLSGAVYWAANNPDSLARWVRKLTKNREWGFVEKLLGSIEQLRSVSLTGPQFAASTAWSLGNRLFDAISLWICIWAVTGTAPMFEPEPNNTTIAGVLLAYTTAKIAGSIQATPGGIGPIEAAYIAALVATGMTAVEAAGAVIIYRLCSFIIMAIVGWVIYFIYFTPQGLKANESLDVEQDTINSDSNRQSAIERPDT

SEQ ID NO: 2809 - DNA, 807 bp, Corynebacterium glutamicum
  CDS (101)..(784): RXA02588
ctcagctgactgaccgtcaggtcatcaccaagtttgaaggcaaaggcttggaaaaagatcacgtgatcaatgagtacttgtggcagaaggtgcaaaactaatgtctgatgtgcatgaggtcattcatagctacaatcccactgacaaagaaggccctgaaagtgtccttctagtgtgggacgctcccaacctagatatgggtttgggcgctattttgggtggtcgcccaaccgctgcgtaccgacctcgctttgatgccatcggtcggtggttgcttgctcgcgcaggtcgcagggcacatgagttgggccgccacattgagcctgaggcaacggtgtttgccaacatcaccccaggtggctctgatgttgttcgaccttgggtggaagcgctgcgtaacgttggtttcgcggtcttcgctaagcctaagatcggcgaggattccgatgtcgatccggacatgattgatcacattcgcaggcgctatgaagaaggcgtgctgcggggtgtcatcgtggccagtgcagatggtcagaacttccgtgagactctcgaggagctcgttgcagagggcattcctgccacggtcattggtttccacgagcacgcgtcatgggctgtagctcatgacaccatcgagtttgttgatctggaggaaatccccggcgtcttccgtgagccgcttcctcgcgtcagcctggataacctgccagacggtggcgcatggctgcagccgttccgccctctgactgccttgttatccaaccgccacaattcccaggagtaatccacccgtgttttctaaat

SEQ ID NO: 2810 - protein, 228 aa, Corynebacterium glutamicum
MSDVHEVIHSYNPTDKEGPESVLLVWDAPNLDMGLGAILGGRPTAAYRPRFDAIGRWLLARAGRRAHELGRHIEPEATVFANITPGGSDVVRPWVEALRNVGFAVFAKPKIGEDSDVDPDMIDHIRRRYEEGVLRGVIVASADGQNFRETLEELVAEGIPATVIGFHEHASWAVAHDTIEFVDLEEIPGVFREPLPRVSLDNLPDGGAWLQPFRPLTALLSNRHNSQE

SEQ ID NO: 2811 - DNA, 1953 bp, Corynebacterium glutamicum
  CDS (101)..(1930): RXA02591
atgtgtccgttgtctcacctaaagttttaactagttctgtatctgaaagctacgctagggggcgagaactctgtcgaatgacacaaaatctggagaagtaatgactactgctgcaatcaggggccttcagggcgaggcgccgaccaagaataaggaactgctgaactggatcgcagacgccgtcgagctcttccagcctgaggctgttgtgttcgttgatggatcccaggctgagtgggatcgcatggcggaggatcttgttgaagccggtaccctcatcaagctcaacgaggaaaagcgtccgaacagctacctagctcgttccaacccatctgacgttgcgcgcgttgagtcccgcaccttcatctgctccgagaaggaagaagatgctggcccaaccaacaactgggctccaccacaggcaatgaaggacgaaatgtccaagcattacgctggttccatgaaggggcgcaccatgtacgtcgtgcctttctgcatgggtccaatcagcgatccggaccctaagcttggtgtgcagctcactgactccgagtacgttgtcatgtccatgcgcatcatgacccgcatgggtattgaagcgctggacaagatcggcgcgaacggcagcttcgtcaggtgcctccactccgttggtgctcctttggagccaggccaggaagacgttgcatggccttgcaacgacaccaagtacatcacccagttcccagagaccaaggaaatttggtcctacggttccggctacggcggaaacgcaatcctggcaaagaagtgctacgcactgcgtatcgcatctgtcatggctcgcgaagaaggatggatggctgagcacatgctcatcctgaagctgatcaacccagagggcaaggcgtaccacatcgcagcagcattcccatctgcttgtggcaagaccaacctcgccatgatcactccaaccatcccaggctggaccgctcaggttgttggcgacgacatcgcttggctgaagctgcgcgaggacggcctctacgcagttaacccagaaaatggtttcttcggtgttgctccaggcaccaactacgcatccaacccaatcgcgatgaagaccatggaaccaggcaacaccctgttcaccaacgtggcactcaccgacgacggcgacatctggtgggaaggcatggacggcgacgccccagctcacctcattgactggatgggcaacgactggaccccagagtccgacgaaaacgctgctcaccctaactcccgttactgcgtagcaatcgaccagtccccagcagcagcacctgagttcaacgactgggaaggcgtcaagatcgacgcaatcctcttcggtggacgtcgcgcagacaccgtcccactggttacccagacctacgactgggagcacggcaccatggttggtgcactgctcgcatccggtcagaccgcagcttccgcagaagcaaaggtcggcacactccgccacgacccaatggcaatgctcccattcattggctacaacgctggtgaatacctgcagaactggattgacatgggtaacaagggtggcgacaagatgccatccatcttcctggtcaactggttccgccgtggcgaagatggacgcttcctgtggcctggcttcggcgacaactctcgcgttctgaagtgggtcatcgaccgcatcgaaggccacgttggcgcagacgagaccgttgttggacacaccgctaaggccgaagacctcgacctcgacggcctcgacaccccaattgaggatgtcaaggaagcactgaccgctcctgcagagcagtgggcaaacgacgttgaagacaacgccgagtacctcactttcctcggaccacgtgttcctgcagaggttcacagccagttcgatgctctgaaggcccgcatttcagcagctcacgcttaaagttcacgcttaagaactgc

SEQ ID NO: 2812 - protein, 610 aa, Corynebacterium glutamicum
MTTAAIRGLQGEAPTKNKELLNWIADAVELFQPEAVVFVDGSQAEWDRMAEDLVEAGTLIKLNEEKRPNSYLARSNPSDVARVESRTFICSEKEEDAGPTNNWAPPQAMKDEMSKHYAGSMKGRTMYVVPFCMGPISDPDPKLGVQLTDSEYVVMSMRIMTRMGIEALDKIGANGSFVRCLHSVGAPLEPGQEDVAWPCNDTKYITQFPETKEIWSYGSGYGGNAILAKKCYALRIASVMAREEGWMAEHMLILKLINPEGKAYHIAAAFPSACGKTNLAMITPTIPGWTAQVVGDDIAWLKLREDGLYAVNPENGFFGVAPGTNYASNPIAMKTMEPGNTLFTNVALTDDGDIWWEGMDGDAPAHLIDWMGNDWTPESDENAAHPNSRYCVAIDQSPAAAPEFNDWEGVKIDAILFGGRRADTVPLVTQTYDWEHGTMVGALLASGQTAASAEAKVGTLRHDPMAMLPFIGYNAGEYLQNWIDMGNKGGDKMPSIFLVNWFRRGEDGRFLWPGFGDNSRVLKWVIDRIEGHVGADETVVGHTAKAEDLDLDGLDTPIEDVKEALTAPAEQWANDVEDNAEYLTFLGPRVPAEVHSQFDALKARISAAHA

SEQ ID NO: 2813 - DNA, 714 bp, Corynebacterium glutamicum
  CDS (101)..(691): RXA02598
ctttgggaaagtaccccctatgacggaaaactggatggatcctgtggttgaaccacagtcaacgggagaggggaaatcggacactatatggttggagatcgtgacaactgaccaaaacaaaagaagtctcagtgagcttgcggccagaatcgttagtgaaatctgtgcaccgtgggtactcaacatcggatttttcctcatcctgggcggcgtaacaggcgcctggacgctaggaattgtggcggcaatcggaaccggaatcgttccgatgatcttaattttgggcttgatgaagctcggcagggtaggaaaccaccatgtgacgacccgaaatcagcgcggccttgtgtttgtgggcatcattgtttgtgtcatcattttgatttttatcctcagagcccttgaagcacctcagctgatttgggatggcatgttctcagcactgattttcttagttctgtttgcacaagtgacgttgaaaattaaagcctcagttcatgttgggctgtgggtgtgtttagtgatgttcctcggtctgacggtttcttcgtggtggttactcgggttgctgtttaccccagtcaccgcgtgggcacgtatgcggatcaagcatcatacgatgtcggagattgtggcgggcgttgttacaggagcagttgcaaccggcatttgttatgcactcctacttgcgtaaaggagaattatggatcagct

SEQ ID NO: 2814 - protein, 197 aa, Corynebacterium glutamicum
VTTDQNKRSLSELAARIVSEICAPWVLNIGFFLILGGVTGAWTLGIVAAIGTGIVPMILILGLMKLGRVGNHHVTTRNQRGLVFVGIIVCVIILIFILRALEAPQLIWDGMFSALIFLVLFAQVTLKIKASVHVGLWVCLVMFLGLTVSSWWLLGLLFTPVTAWARMRIKHHTMSEIVAGVVTGAVATGICYALLLA

SEQ ID NO: 2815 - DNA, 1521 bp, Corynebacterium glutamicum
  CDS (101)..(1498): RXA02600
gattttgcttttcgacgcaccgttcggccgttatctagatctggtcacaatgtcggtttttcatggattcatgtcctttatcggacgtactgtggggagtatgcaaccttttccactgtccttaaccaacagctccgtcgctggtattgcagcgggagcgttgctgtttctctccgtccctttcgcatcgcctgttcacgcgcaaaccatactgcaagacacccttgaagtgactgtgttggataatgccgacgagctcgctccagaggatgaggatttcctcagcacggaaacacccaagattgatttccctgactcagttaccgcagtccggtacatcacgctcacggacaacactgacaaaatcaatgatgacgttgaaaattacctgcgcgccgaacaccccgagtggatccaaacaaactctttcgcccctggtgaagtgatcatcgcagtcggtttcgaccccaacaccatgggtgcctacgcgggtaacgatgtggccgcagagactgggatcgcagaacaagaccgcatcgacggcaccaccgatgcgatgcgcccattactccaagacggtcgcattgccctaggcatgttggagggtgcaaaatcggttgctgatacctctgtcgttcgggaaagctcagctccaagtggtggagtaatcgccgctattttgggtggcatcgctgctctcgtggcaattattgtcgcgtgggctacgagttacgcgaataagaagaaggcagaaaaggctcgtgagcagtttgattatgcatcacgccattatggtgaggtcgcccagcaactcgacggtatcaacgtgcgagcgcactcgctaacttccccactggctgatgatgagctccgcaggcaatgggacgatgtaaattctcgttttcttgaagtcaatgatatttttggcaggctcgaaggtttgacctcgacctcagaaaacaaggcatttcgaaaagccttgccagatattgaaaaagctcatactgccgtgactcaaatggagatcgcacagaaaaacattgacacgctctacgatatggagcacggccatgaagacacccgtcgcagggaattaactaggctgcgtgccgatatgcaggaagcccgtcaagatatcaacgataaagatgcagttgttgacgatattctccgcacgctgatccagcgcacggaaactatcgcaccgtccgcacctgatttcatggaccaatacgcccgcttgatccgtgattatgccgtggcgcttcaaggtgtggaaaagaacctcgagcaggttaaacagaccaccgagcgcaatgctccagccatctacgacgacaattggcgcgtgggcactggctacaactcgtgggtcccgtactacatgatcagttcttggcacgcagctgatgtcagtgctgcatcgtcagcttcttccagttcagcaaataccactttcagcagtggtttcagcggcgctggaggaggttccagctggtaaacaccaccactgaagtcaac

SEQ ID NO: 2816 - protein, 466 aa, Corynebacterium glutamicum
MQPFPLSLTNSSVAGIAAGALLFLSVPFASPVHAQTILQDTLEVTVLDNADELAPEDEDFLSTETPKIDFPDSVTAVRYITLTDNTDKINDDVENYLRAEHPEWIQTNSFAPGEVIIAVGFDPNTMGAYAGNDVAAETGIAEQDRIDGTTDAMRPLLQDGRIALGMLEGAKSVADTSVVRESSAPSGGVIAAILGGIAALVAIIVAWATSYANKKKAEKAREQFDYASRHYGEVAQQLDGINVRAHSLTSPLADDELRRQWDDVNSRFLEVNDIFGRLEGLTSTSENKAFRKALPDIEKAHTAVTQMEIAQKNIDTLYDMEHGHEDTRRRELTRLRADMQEARQDINDKDAVVDDILRTLIQRTETIAPSAPDFMDQYARLIRDYAVALQGVEKNLEQVKQTTERNAPAIYDDNWRVGTGYNSWVPYYMISSWHAADVSAASSASSSSANTTFSSGFSGAGGGSSW

SEQ ID NO: 2817 - DNA, 2112 bp, Corynebacterium glutamicum
  CDS (101)..(2089): RXA02601
ctcatacaattgccaggatcttccatggcggatacggcgcgtaagttctgtgaatgcggggtccggatactacgcttaggcaagataaattgtgagttcaatgaagggtgaagatacgtcaatgagcgcaacaaacctggcggttgagcagctacagcgagtgctcctgccgaggcgcggcgagccagcagatgtcaggtcgttgtacctgttggaagcagaaagtaataaggaacgcctggaatgggaagatcgttttagcgtttccgtccccgctggcgccgaggtgtcttttcagacctacttcaatgcatttcctgcaagctactggcgtcgctggtcacagctagattctgtcgtactgaaactgaaagtttccggcgaagcgcgcgtcgacctctaccgatccaagatcgatggagcacgcatcggaattaccggttccgtagtcaaagatgacttcatcgaatttgaagtttcattagccccattcgaagacggcggctggatctggttcgacctcaccgctgaaaccgacgcaaccgtcgaagaagcaggctggtacgctccacacgcgccaaaagcccagatcatgccagatggatctgaagtcggcccatttgaagcccgtgcaaccgtcggaatcccgaccttcaaccgcccagctgatgcagttgcagcactggaagcacttgcctccgacccagcagttgacgccgtcattgataccgtcatcatgcctgatcaaggcaacaagcaccctgccgacgagccaggttacaaggcagctgttgagcacttcggcgaccgcttcttcgaattccgccagggcaacctcggcggatccggcggttactcccgcatcatgttcgaagcccttggcggagtcgacggcaagggcgaagcaggcgctgccaagagcccatacatcctgtacatggatgacgacattgctattgagccagactcagtgctgcgtgcgcttcaggtagcccgctacgcaaaatcccccatcctcgttggcggacaaatgctcaacctgcaagagcgcagccaccttcacaccatgggcgaagtagttggcggacacgacttcatgtggaccgccgcaccacacgtgcactacgaccacgacttctctgcacacccactacatgatcgcggtaaattcgacgacaagccagacgcaccaaactcccgcgacctgcaccgccgcatcgacgttgacttcaacggctggtggatgtgcatgatcccacgcgttgtcgccgaacagatcggccaaccactcccactctttatcaagtgggacgacgccgaatacggtctacgcgcacgcaaagctggattccccacagcaacctggccaggaatcgcaatctggcacatggcctggtccgacaaagacgacgccatcgactggcaggcctacttccacctccgcaaccgcctcgtggttgccgcgatgtaccaccaaggcagcgtcgacggcattgtccgatcgatgcaaaaagccaccttcaagcacctgctgtgcctggaatactccaccgtggcaatccaaaacgaagcaatgaaggacttccttgcaggaccagatcagctcttctcgatcctggacacctcactacctcgaattgcagcgattcgcaaaacctatccagacgccgttgtgctgccaagcgccaccgaactgccacgagcaaccggcgcgccgggtgtcccaaccaaggacatcggtggacgcctggccccaatcaagaaggcaatgtggctggctaagggcctgaagcactccctgtctaaggaagatgcctcccaccacgaggtgccacaggccaacttcgcaccaatcgaagcacgttggttcagcctgtcccgagtcgatggcgcaacagttaccaccgcggatggccgcggcgtggtctaccgcaagcgcgaccgcgacaaagctaaagaacttggcaaagaagcacgcgcactgcaaaagcaagtagcagagcgtttcgacgaactcagtcgcgcctaccgcaacgctcatcctgagcttgtgagccgtgaagcctggggaaaggtcttcgatgagcaataaggaagtacagattctggtag

SEQ ID NO: 2818 - protein, 663 aa, Corynebacterium glutamicum
MKGEDTSMSATNLAVEQLQRVLLPRRGEPADVRSLYLLEAESNKERLEWEDRFSVSVPAGAEVSFQTYFNAFPASYWRRWSQLDSVVLKLKVSGEARVDLYRSKIDGARIGITGSVVKDDFIEFEVSLAPFEDGGWIWFDLTAETDATVEEAGWYAPHAPKAQIMPDGSEVGPFEARATVGIPTFNRPADAVAALEALASDPAVDAVIDTVIMPDQGNKHPADEPGYKAAVEHFGDRFFEFRQGNLGGSGGYSRIMFEALGGVDGKGEAGAAKSPYILYMDDDIAIEPDSVLRALQVARYAKSPILVGGQMLNLQERSHLHTMGEVVGGHDFMWTAAPHVHYDHDFSAHPLHDRGKFDDKPDAPNSRDLHRRIDVDFNGWWMCMIPRVVAEQIGQPLPLFIKWDDAEYGLRARKAGFPTATWPGIAIWHMAWSDKDDAIDWQAYFHLRNRLVVAAMYHQGSVDGIVRSMQKATFKHLLCLEYSTVAIQNEAMKDFLAGPDQLFSILDTSLPRIAAIRKTYPDAVVLPSATELPRATGAPGVPTKDIGGRLAPIKKAMWLAKGLKHSLSKEDASHHEVPQANFAPIEARWFSLSRVDGATVTTADGRGVVYRKRDRDKAKELGKEARALQKQVAERFDELSRAYRNAHPELVSREAWGKVFDEQ

SEQ ID NO: 2819 - DNA, 627 bp, Corynebacterium glutamicum
  CDS (101)..(604): RXA02602
ctgcaaaagcaagtagcagagcgtttcgacgaactcagtcgcgcctaccgcaacgctcatcctgagcttgtgagccgtgaagcctggggaaaggtcttcgatgagcaataaggaagtacagattctggtagcaatccaggatcaactcatggatgccccaggagtactgcccaccgcacgaggactcagcctgctcggcgaacatgctgcaggctggctggcactcggcgctggcggtgctgttgtggacaaaaaacgtcgccgctcctgggctggactcttcatcgctgcactgggaagccacgcagcatcagtgatcatcaaacgagttgtccgccgcgctcggccacatgacccagccatcaggattggtgtgggcaccccctcaaagctaagctttccttcttcacatgcgacctcgacaaccgcaactatggtttatcttgcgcgcatcaccaagtcaccagtgccactgctaggaatccccatcatggtgctatcacgcatggtgcttggcgtgcattacccaaccgatgtgctagccggcgcgttgttgggagcagcgaccgcagaggccgtccataagatcgaaagggctacgaagtgagcgaacacgccgctgaacat

SEQ ID NO: 2820 - protein, 168 aa, Corynebacterium glutamicum
MSNKEVQILVAIQDQLMDAPGVLPTARGLSLLGEHAAGWLALGAGGAVVDKKRRRSWAGLFIAALGSHAASVIIKRVVRRARPHDPAIRIGVGTPSKLSFPSSHATSTTATMVYLARITKSPVPLLGIPIMVLSRMVLGVHYPTDVLAGALLGAATAEAVHKIERATK

SEQ ID NO: 2821 - DNA, 2199 bp, Corynebacterium glutamicum
  CDS (101)..(2176): RXA02604
tctgcatcgtgatggctgtgtacatcatgccgatgttttgaatatttaccaatgaacatgctctgaccagcatgtccattaacgtttgaggccacatgcggtgctagcatgtggcctcatgacgtttagcccccagcgtccggagtttgagaccggtaagcagccagatccagaaactgaacacgcaggtgacttctttgaagaaacctcaagcagtgctcctcgcgccgcatctaacggttcttctggtccgaactacaccctcattacaacgtttctagcggcccttactgctggcatctttgctttctgggcaggctggacccgcaaatggatcagcgacgacggactgatcgtcctacgcaccgtccgaaacctcctggctggaaacgggccagtattcaacgctggcgaacgcgtcgaagccaacacatctactctgtggcaatactgcatctatctggttgccttagtaactgactatcgcctcgaagatattgctctgtggcttgcgctgctgttcaccaccgcagcgtccatcatcggtgtcctgggtaccgcgcatctccaccgcaaacgcattgccgtattgcttcctgcaggcgtgatcggctacttcagcctttccccggcgcgagactttgccacttccggattggagtggggcctatctttgatgtggatttccatccaatggctgctgctggtgttgtgggcgacttcgggcaagacctcgggcaagaaggcttcgggcgcaaaaacttcaaatcctatcgttaatgccggtgcaataacctatgctttggccttttggtcaggcttgagctggctggttcgcccagaactggcgatgtatggcggtttgactggagtgttgctgctgcttactgcgccacgatggcgggtagttttggggatcctggtggcggctttgcctcttccagctgcgtaccaaatcttccgcatgggttattacgggctgatggtgccgcacacggctgtagcgaaatcagcctcagatgcggtgtgggggactggttgggaatatgttgaggatttcacggggccttacaacctgtggctcggtttggccttgctgttggccgcaggcgcgttgacagtgtggaaaactgacaagcacttagcgataccgaaggggcggctggggctgcgcactccgggtatggctatagcgttgctggttatctgtgcgctcgtccacttcctttacgttatccgtgttggtggcgacttcatgcatggacgcatgctgctccttccactttttgccattctgctgcctgtttctgtcattccggtcaatgttgttgatcgaggttggcaggatttggttgcgctggttctcgttttctctacgtgggtgtggtccactgtggtttttgtgcaggggcaccaatgggaaaataccggccagcatgtggttgatgagcgtgatttttggattgatttcaccaaccgagatgaagatcatcctccgctttatgcagaggatttcctcactgttgattccatgaatgattacgcagaggttatgcgcgatcagacgttggttaatccaacaggccagcaactcaatattctggccagcagtgacccgaccacttattcgtggatcaccacacctcgcgtggagggggttgaagccggtgatttggctaacctctcgccaactgttttccatgtgaacctcggcatgacctccatgaacgcaccgctcaacgtgcgtgtgacagacctgattggtttggcaacgccactggcagcccgccagccacgcattgaaggtggtcgaatcggccacgataaattgatggacttggaatggcaggtcgcggaatccgccactccgctggcgtacacaccgggttggttggatactcaaaagacttatgaggcccgccaggcgctacgccacccagaattggttcaccttttccagacttaccgtgagccaatgtcctaccaccggtttgtggacaatattaaatacgcactcactaccggaagaacactggaaatttcagataatcctgaagatcttttgaaagaatttaacccgacccctgcagagattcaggacgggttagaaactattgcttggcctggggaaattaaacttgatgaacctcgcggagaacctttatatagctctcagtaaacacttattcgcaaatcatt

SEQ ID NO: 2822 - protein, 692 aa, Corynebacterium glutamicum
VLACGLMTFSPQRPEFETGKQPDPETEHAGDFFEETSSSAPRAASNGSSGPNYTLITTFLAALTAGIFAFWAGWTRKWISDDGLIVLRTVRNLLAGNGPVFNAGERVEANTSTLWQYCIYLVALVTDYRLEDIALWLALLFTTAASIIGVLGTAHLHRKRIAVLLPAGVIGYFSLSPARDFATSGLEWGLSLMWISIQWLLLVLWATSGKTSGKKASGAKTSNPIVNAGAITYALAFWSGLSWLVRPELAMYGGLTGVLLLLTAPRWRVVLGILVAALPLPAAYQIFRMGYYGLMVPHTAVAKSASDAVWGTGWEYVEDFTGPYNLWLGLALLLAAGALTVWKTDKHLAIPKGRLGLRTPGMAIALLVICALVHFLYVIRVGGDFMHGRMLLLPLFAILLPVSVIPVNVVDRGWQDLVALVLVFSTWVWSTVVFVQGHQWENTGQHVVDERDFWIDFTNRDEDHPPLYAEDFLTVDSMNDYAEVMRDQTLVNPTGQQLNILASSDPTTYSWITTPRVEGVEAGDLANLSPTVFHVNLGMTSMNAPLNVRVTDLIGLATPLAARQPRIEGGRIGHDKLMDLEWQVAESATPLAYTPGWLDTQKTYEARQALRHPELVHLFQTYREPMSYHRFVDNIKYALTTGRTLEISDNPEDLLKEFNPTPAEIQDGLETIAWPGEIKLDEPRGEPLYSSQ

SEQ ID NO: 2823 - DNA, 372 bp, Corynebacterium glutamicum
  CDS (101)..(349): RXA02609
gaccgaacgcagcagtcaggcgtcgcaaagcaatggaagcggcggaagcacagcccgggacggggcagccgaggaaatcgacggcctgcccgaggtgaccgtggaacgcagcgctgaggcgcaagcgttcctggatgcgctgaaagatgaaaaaatcgacatctccggcgtggaggaccagttgattgcgactgcgcgaaattactgcagttcggaaaacaaggaccaaaacgtcactgtcgatgcggttgcaggccagctcatcgtgcagggacgcaccagcgtgaaggaagatcaagcagcggaaatttctacgctgctgaaggaatctgcggatcggacgtattgttaaccgatgaggaaaaccatcac

SEQ ID NO: 2824 - protein, 83 aa, Corynebacterium glutamicum
VERSAEAQAFLDALKDEKIDISGVEDQLIATARNYCSSENKDQNVTVDAVAGQLIVQGRTSVKEDQAAEISTLLKESADRTYC

SEQ ID NO: 2825 - DNA, 630 bp, Corynebacterium glutamicum
  CDS (101)..(607): RXA02617
ctctttaattaacttttgggcgaccctttacggtcgtcctcttgcgttcccaaaacatacccagtaagttactgggtatccaactcttgattggggaacaatgtccataaaacatgcactcttggtgctcatgctcgacgaaccaacctcggcaagtcagctgcaaaccaagtttgaagaaacaatggggatctggcagctcaatatcggccaagtcacccaaaccatccagcggctacagcgcgacggcctggcggaaaccgcaggcaccaccgtcagttccaacggccgcaccgtagatactttccagcccacggacttaggtcgcgaacttgtcgcgcagtggttcgaaagtcccgtcaccgtcacactgtccgaacgcgatgaattagtcaccaaaatcgccatcgcagaatcacgtggcctcaatttgattccacttttagacattcaacgcaacacagtcatggcggaactacgcgcactcaacaaatccagccgcgatctcgccgaaaccagaaacacccagcggctcctcgtcgaaaagcgaatctttgaactagaagcccaggcacgttggctcgaccgaattgaagcattggagcagtaaatgacaaacacgcctttccc

SEQ ID NO: 2826 - protein, 169 aa, Corynebacterium glutamicum
MSIKHALLVLMLDEPTSASQLQTKFEETMGIWQLNIGQVTQTIQRLQRDGLAETAGTTVSSNGRTVDTFQPTDLGRELVAQWFESPVTVTLSERDELVTKIAIAESRGLNLIPLLDIQRNTVMAELRALNKSSRDLAETRNTQRLLVEKRIFELEAQARWLDRIEALEQ

SEQ ID NO: 2827 - DNA, 1023 bp, Corynebacterium glutamicum
  CDS (101)..(1000): RXA02619
agcgacttctcaaagaaccaccccactcatttcgagtgcgggtggttttttctatgcctaattctatgcctaattctatgtctgattctattggtgtcgcatgcgcagtgtagttttagaactactagagaactggaaggaatcactcgtgcttcacccctcattgactgagctagcggatgctgccccacttgcacaggattttgccaccgtccgcggtgtgctgaaggaatcgctggatttgttgggcaatgcactgaaccacggtgaagagcccgcggagcttgcagggtggctgtcacaagttattactgatgttttgcactcccctggcttggatgcccacgtggtgctcaccggccccgtggggcgtggagacgcactgcctacctcgcccgtgaggtggctggcggtcgtcgatagccaagaagatccgaatgaaaagatttcagcgctgttaactgaggtgggcttcattgcggagccgatcggtgcggcaactcgtgaggagtgggagcagcgtgcgcgcgctggtgaggatccagaggtctatttggatgctggcacgtgggtcgcggcgatcgctgaagtagatgacaaagcactgttgcaggatgcgttgtcatctaggccgcctgcggtggaaacttatgagggtcttccttcgttggacatggtggtaaacattcgtgagaacctcatgattcccacggtgaagatcgctcgctgggcagcacacaaggctggttctttggcgcctacgactgcgcagcgcctcgtggatgcccgtggtgtgctcaccaatgatgaagtcgacgcgctgacacaggtgtggacttccgcactgagcttgcagtcgaaacgttggatggatcacatccatgatcaagaaaccaccgcttgggagcttcccgcgctgcaacgtgccacttttggcgcatcggctcggttgctttctgaggtgttgcggtccgttgaagcccgtgaaatcgataccaaataggaactctgcacaattactgg

SEQ ID NO: 2828 - protein, 300 aa, Corynebacterium glutamicum
MRSVVLELLENWKESLVLHPSLTELADAAPLAQDFATVRGVLKESLDLLGNALNHGEEPAELAGWLSQVITDVLHSPGLDAHVVLTGPVGRGDALPTSPVRWLAVVDSQEDPNEKISALLTEVGFIAEPIGAATREEWEQRARAGEDPEVYLDAGTWVAAIAEVDDKALLQDALSSRPPAVETYEGLPSLDMVVNIRENLMIPTVKIARWAAHKAGSLAPTTAQRLVDARGVLTNDEVDALTQVWTSALSLQSKRWMDHIHDQETTAWELPALQRATFGASARLLSEVLRSVEAREIDTK

SEQ ID NO: 2829 - DNA, 777 bp, Corynebacterium glutamicum
  CDS (101)..(754): RXA02620
atcgataccaaataggaactctgcacaattactggctacaatctcttgagatcaataggccaaaactttaaggaagtagaattacgctatggcaggagcagtgggacgcccccggagatcagctccgcgacgggcaggcaagaatcctcgcgaggagattcttgacgcctctgctgagcttttcacccgtcaaggcttcgcaacaacctccacgcatcaaatcgctgatgccgtgggaatccgccaagcctcgctgtattatcacttcccgtccaagacggaaatcttcctcaccctgctgaaatctactgtcgagccgtccactgtgctcgccgaagacttaagcaccctggacgccggacctgagatgcgcctctgggcaatcgttgcctccgaagtgcgtctgctgctgtccaccaagtggaacgtcggtcgcctgtaccaactccccatcgttggttctgaagagttcgccgagtaccacagccagcgcgaagccctcaccaacgtcttccgcgacctcgccaccgaaatcgtcggtgacgacccccgcgcagaactccccttccacatcaccatgtcggtgatcgaaatgcgtcgcaacgacggcaagattccaagcccgctttccgcagacagcctcccggagaccgcaattatgcttgccgacgcctccctcgccgtcctcggcgcgccgctgcccgccgaccgggtcgaaaaaacgcttgaactaatcaagcaggctgacgcgaaataaccatccgcgcctgcgaaatc

SEQ ID NO: 2830 - protein, 218 aa, Corynebacterium glutamicum
VGRPRRSAPRRAGKNPREEILDASAELFTRQGFATTSTHQIADAVGIRQASLYYHFPSKTEIFLTLLKSTVEPSTVLAEDLSTLDAGPEMRLWAIVASEVRLLLSTKWNVGRLYQLPIVGSEEFAEYHSQREALTNVFRDLATEIVGDDPRAELPFHITMSVIEMRRNDGKIPSPLSADSLPETAIMLADASLAVLGAPLPADRVEKTLELIKQADAK

SEQ ID NO: 2831 - DNA, 957 bp, Corynebacterium glutamicum
  CDS (101)..(934): RXA02639
cgaaaatgttggaaatcgccgaacgggaacgtcgacaagcaaaacgcgcggcaaaggtcgccaagaaacgcaccacctttataaggaaaatctttaaaaaatgattgcactgggttcagcgcccaagctggttgcctccgatgttgatggcaccctcatcaatagttctgagcgcgtgccgcaacgcctgcgcgatgtgatcacgcggatgaccaatcagggcgtgaccctggcgctgtccacgggccgcccgccgcgctggattcattatgtgctggatcagctgagcgtgaagccgatttgcgtctgcgcgaatggcgcggtgctgtacgattccgctgccgatgagattcttgcagctcagacgcttagtccggaggttatggcgagtgccgtcatggctgcgcgtgccgctttggaagagcatggcggggtcagtattgctgtcgagcgcgctggaaaatccgcttacgatccagccgatgagctgtttttggtcaccccggaatacagccacgcgtggccctcaaatgatcacggcaccttcgaggaagccgaagtgctttccgaaccagccaccaaattgttgatgcgcagcgattacctcgattccaagcagctttttgatatcgtccgcgcctccgttcccgaggatcaagtccacgtcaccttctccatgtccggcggactcattgagatcgcagcgcccggcgtgaccaaggcactgggcgtatcgatgctggcagagcgcctaaagattgcgcaaaaggacgttataacgttcggcgacatgcccaacgatattgaaatgctccagtgggccggccggggagtggcgatgggcaacgcccgaccagaggtcaaagccgtgtcagaccacatcacccgcaccaacgacgacgccggtgtagcagatgtattggagtggtggttctaataggtggtgttaaaacactg

SEQ ID NO: 2832 - protein, 278 aa, Corynebacterium glutamicum
MIALGSAPKLVASDVDGTLINSSERVPQRLRDVITRMTNQGVTLALSTGRPPRWIHYVLDQLSVKPICVCANGAVLYDSAADEILAAQTLSPEVMASAVMAARAALEEHGGVSIAVERAGKSAYDPADELFLVTPEYSHAWPSNDHGTFEEAEVLSEPATKLLMRSDYLDSKQLFDIVRASVPEDQVHVTFSMSGGLIEIAAPGVTKALGVSMLAERLKIAQKDVITFGDMPNDIEMLQWAGRGVAMGNARPEVKAVSDHITRTNDDAGVADVLEWWF

SEQ ID NO: 2833 - DNA, 585 bp, Corynebacterium glutamicum
  CDS (101)..(562): RXA02647
atcttctatcttgtttccatagtaaatccgcatatttattgccaggagaaaagttttgtctttgcgtcgaagtactttgacccttgttacagcaagcgctgtggcattgtccgtgttcactccagttgcccaggctcagtcctctgacgcactgacacagctctcagacaacatcacctcatcacagatccttgatgatgatggaaatccagtcgatggaaacgaaacctggccaggcagctctgaaggcagctcaatgctcagcaatggcgacattcctgcggccccaagcttgagctcctccggcaaagacaccagcgatgatgacgatgaaatcagcgaagagcagcaagcactgatcgatcggttgtccgaaatgccagtgattggttccattgtctccccaccagaatggcttgccattccttttgcggtactgcagggattgctcgcaatcaccactcttgcttccaccgcagcatccttcatggtgaccgtcgacccatcgttcaagcagactctgcgtgacatgctcacccagtttggcatcaacgtcgacgcttaaaagcacactgacataaaatg

SEQ ID NO: 2834 - protein, 154 aa, Corynebacterium glutamicum
VALSVFTPVAQAQSSDALTQLSDNITSSQILDDDGNPVDGNETWPGSSEGSSMLSNGDIPAAPSLSSSGKDTSDDDDEISEEQQALIDRLSEMPVIGSIVSPPEWLAIPFAVLQGLLAITTLASTAASFMVTVDPSFKQTLRDMLTQFGINVDA

SEQ ID NO: 2835 - DNA, 1125 bp, Corynebacterium glutamicum
  CDS (101)..(1102): RXA02649
ttttacacagttgcagcaaaaattcggccattccgattgcttttgacagctaaactttgcatttgttctttttggcgccgatgccgataggtttaaaggcgtgctaaaacgattctctcaccactccagcccgcaagttctttcacggaaagttgtcgcgtccgcattagctttaacaaccgcgctggctttagccgcgtgtagttcctcagccgagccggactcccctgaagttgagcaggcggtgggtcttgcggtggatacgccacgtgtggtggttgtggatccaggcactggcgatttgcagcgcttgcaatacaaagacatcgcccctgatgccacacaggaacagaccatcaatattgctgaaggttttgcccaatcggtggtgaatgcggacagcgtggatccgcaggcaccagccggtggcgatgtcaccacattccaccttcctgttaaagccaccaccgaggaagcggagttcagcgatcaggaaatggtgagcgcgactcgcgatatctctctacttttcggtaaacctacctacaccgatctttcccaagttgaagatgtgaattccaccgagggattcacgctgggaatccgcgcaacagatagtggacagcacaccaccttaagtttcgcagcccctgttgattccactgaaactggtcgcatgctcatggagcaatacttactcacgtttacgtcccttcccattgtgttcccctctgacgatattggcgtgggcgcgaagtggactgtggatagccgtgtgacaggcgaatcaacgctgctacaaaccgtgacctacacgatcacagggatcgacggcgacaaagtaaacctcgatgtggaagtctctcagcgccccagcatgggtgcgttggagatcaccgatgaagaatcggacgagaccaccgggcagctcactgtccttaattccaacaccacctccgtgggcaccttggaagtcgatctgactcagcctttacccacgtcaggacaggtttcttggaccactcgcgtgatttacggcggttccaatgagcaggtgcgtgtggtgcaggattccacctcttcggtgagcttcggagaccagtaatttaccaattagggttgcca

SEQ ID NO: 2836 - protein, 334 aa, Corynebacterium glutamicum
VLKRFSHHSSPQVLSRKVVASALALTTALALAACSSSAEPDSPEVEQAVGLAVDTPRVVVVDPGTGDLQRLQYKDIAPDATQEQTINIAEGFAQSVVNADSVDPQAPAGGDVTTFHLPVKATTEEAEFSDQEMVSATRDISLLFGKPTYTDLSQVEDVNSTEGFTLGIRATDSGQHTTLSFAAPVDSTETGRMLMEQYLLTFTSLPIVFPSDDIGVGAKWTVDSRVTGESTLLQTVTYTITGIDGDKVNLDVEVSQRPSMGALEITDEESDETTGQLTVLNSNTTSVGTLEVDLTQPLPTSGQVSWTTRVIYGGSNEQVRVVQDSTSSVSFGDQ

SEQ ID NO: 2837 - DNA, 702 bp, Corynebacterium glutamicum
  CDS (101)..(679): RXA02652
cgcttggattcaaccacccagcagatggccgatggatggaaatcgtctccccatatccaactgatctccaacacgctttagacgttctccgcgagcaataatggatggtgtcgataaagggcgacgcatcgtcgccctcctagcaattctcgcattggttgtcgtggttgcgatcttgagtttcagcgaccgcaccgcgaaacccatgcagctcaacggtgacatgctcggccaagacaacacggaaacttccgtcgagtaccgtcagcgggcatcggaatcattggaaaatgccgcggtcggcgaagaagcctattcactggtgacgttcacacagccgctttcgccttccgaggcctctaaccttcttaaaggagtcggtcgcgtcaatgccatggttatgctctcggctcctgccatggatctacccgaacccatcgcaggcgagacccgtgaagatgtttttaaccgtcaaataaagcttgtcgacgcccagttatccggtatcggcaacgtccgcgcgccgggcgaactcaacggggtagtggtttgggatattcctcagaaagttcgtgtgttgtccgagagctcgctggtttatagtgtcgaaaccctgccacctgacgcggcgtggggcagtttcggtattcgaccagtcgatacttcgggtactaatttttagaagaaaattccagatgcccc

SEQ ID NO: 2838 - protein, 193 aa, Corynebacterium glutamicum
MDGVDKGRRIVALLAILALVVVVAILSFSDRTAKPMQLNGDMLGQDNTETSVEYRQRASESLENAAVGEEAYSLVTFTQPLSPSEASNLLKGVGRVNAMVMLSAPAMDLPEPIAGETREDVFNRQIKLVDAQLSGIGNVRAPGELNGVVVWDIPQKVRVLSESSLVYSVETLPPDAAWGSFGIRPVDTSGTNF

SEQ ID NO: 2839 - DNA, 1107 bp, Corynebacterium glutamicum
  CDS (101)..(1084): RXA02655
aattcgatggagaagaaaaagtcatgggggtcaggctaggagaaaatgatctcatgatggctttggaacggtacctcgctcacgagtttggtgaaattagatgagtccagaagccaaagaagcccaagattctaggcgcaacgagatgcccgagaaaaagcgagcggtgctacgtaaagcgattaagttggaatgggcaacgatcgcatgggttcttttttcgatcgttttggtaggtgttgtcgctggtcaatcgcaggccatgcgtagtgcatggattgaagacatgctttctttggtaccacctatcgcttttcttttagcctcccgaatcagcaaagctgtggcaaccagaaaacatccatacggcaagcaccggtcgattgctatcgggcaccaagctgcagcactggccctgcttatcatgggaagccttttaatttatgaagcggtatctgcactgatcaagggagaaaggcctccgataggtttagctattttatttggccatgacgtgtggtcaggttggttaatgatcggggttatgatttcagtgtcgatcccgatggtgattgtagggcgagtaaaaataaacttagctaaagatctccacgataaactcctctatgcagacgcggatatggccaaggctgactggggcacagcagtcgctagcacagtaggcgtgctcggaataggactgggtttttggtgggcggatgcagttgcagctctagtaatatcagcttcaattctcagagatggcgtgataaatatgaaagctgctatatctgacttaggtgatggacgagccatgacttatgacaattccgcccctcacccattaaatgatgatgtggaaaaggctgccctagagatgcattgggtcaaacacgcccgcgctaggatacgcgaccaaggccgctgtttccacacagagttatttgtcgaaccagtagaaggatacacacctgctccggaagaaataacttctctagttaagcgaatccaaaaccttgactggaagctgcaagatgtcgtagcttccgtcgtcgaaaaaatcgaccggtttcaggccccttcgtaaaacttaactgagaaagtgat

SEQ ID NO: 2840 - protein, 328 aa, Corynebacterium glutamicum
MSPEAKEAQDSRRNEMPEKKRAVLRKAIKLEWATIAWVLFSIVLVGVVAGQSQAMRSAWIEDMLSLVPPIAFLLASRISKAVATRKHPYGKHRSIAIGHQAAALALLIMGSLLIYEAVSALIKGERPPIGLAILFGHDVWSGWLMIGVMISVSIPMVIVGRVKINLAKDLHDKLLYADADMAKADWGTAVASTVGVLGIGLGFWWADAVAALVISASILRDGVINMKAAISDLGDGRAMTYDNSAPHPLNDDVEKAALEMHWVKHARARIRDQGRCFHTELFVEPVEGYTPAPEEITSLVKRIQNLDWKLQDVVASVVEKIDRFQAPS

SEQ ID NO: 2841 - DNA, 387 bp, Corynebacterium glutamicum
  CDS (101)..(364): RXA02662
ccaaggtgtcaccctcaccgttgccatcgccttcatcatcgtcaatatcgccgtggacctgctctacgtcctggtcaatccacgtattaggagcatctagatgcgccgtaaactaaccaccacattagaaaacaagcccggtgcacgacttggtggcttccgcgcacttgcaccaacttcaaaaatcgcgctggttttccttctcctgatcttcctcctcgcgatctttgccccactgattgctaaatacgatccactggcctccggaactccagtccagcctccaagcggtgagcactggtttggtaccgacgccatcggccgcgatattttctcccgcgtagccacggcgccagagcctccctgatcattggtcttttcgctacg

SEQ ID NO: 2842 - protein, 88 aa, Corynebacterium glutamicum
MRRKLTTTLENKPGARLGGFRALAPTSKIALVFLLLIFLLAIFAPLIAKYDPLASGTPVQPPSGEHWFGTDAIGRDIFSRVATAPEPP

SEQ ID NO: 2843 - DNA, 603 bp, Corynebacterium glutamicum
  CDS (101)..(580): RXA02665
caaggcgacccaatggcgtttaaagtaacaacccccattgatatgatgctggcacaacgcatcaccgacgaagccgaacccacaatatttgaggtaccaggtgactaacccaatcatcccccgcgtaggaatcgccacagacgcccaccaaatcgaagcgggaaaaccctgctggatcgcctgcctcctctttgaaggcgtcgacggctgcgaaggccactccgacggtgatgttgtagctcatgcaattgtggatgctctcctttctgcctctggtctgggggatttgggctctttcgttggtgtggggagacctgaatacgatggtgtttctggtacacagttgttgaaggaagttcgggagctgctttcggcacacgggtacgtcattggaaatgtcgccgcccaactggttggccaaacccccaaatttggaccccgccgcgaagaagcacaacaagtcatctccgaaatcatcggcgcaccatgctcactgtctgccaccaccactgatcacatgggattcactggtcgcagcgagggtcgtgcatcggtagcaacggcagtggtgtggaaggcttaagttttctgtagggattgggc

SEQ ID NO: 2844 - protein, 160 aa, Corynebacterium glutamicum
VTNPIIPRVGIATDAHQIEAGKPCWIACLLFEGVDGCEGHSDGDVVAHAIVDALLSASGLGDLGSFVGVGRPEYDGVSGTQLLKEVRELLSAHGYVIGNVAAQLVGQTPKFGPRREEAQQVISEIIGAPCSLSATTTDHMGFTGRSEGRASVATAVVWKA

SEQ ID NO: 2845 - DNA, 705 bp, Corynebacterium glutamicum
  CDS (101)..(682): RXA02670
ccgtttaatcaaccgactgtgtgaatgcgcttaaacggactagggttgtgagcagcatatccagatttttctggataaatcctggaatttcttaaaaccaatggaggacgaatccgtgaagtccctgaacttggctgcccgtcgtggcgcgctcgtgaccgtggctgctgcgtcagctcttgcgcttgcatcctgcagtgccggacagatcacccagacctcaagccaggttgcagcagttgatggcaaccaggcaggctccgcgaacgacccagttctggtgcgtgatgtaaccgtgcacctcaccaccgacggcgaagctggagtaaagttcaccgccatcaaccaggacacctctcacacttctcacacccttgagtccgtcaccgttgacggcgaagaggttgagcttgatgatgcagagccaatcgagcgcaactgctccctcgttgcagacatccagtccgaactggatctgatcgaggagccagaagttggctgcatccagcacgtagcaacttctctggagaacccaggtttcgcatacggcggagtcgtgccagttgagttcgtcttcgacaccggtgcgatcaccatcgatgccaccgtttccgcacctgtcctcgagtcaggcgtagaaaaccgcgaggtcggcggagacactgcagaggcaagccaccactaagcctctcaaagctgcttgaa

SEQ ID NO: 2846 - protein, 194 aa, Corynebacterium glutamicum
MEDESVKSLNLAARRGALVTVAAASALALASCSAGQITQTSSQVAAVDGNQAGSANDPVLVRDVTVHLTTDGEAGVKFTAINQDTSHTSHTLESVTVDGEEVELDDAEPIERNCSLVADIQSELDLIEEPEVGCIQHVATSLENPGFAYGGVVPVEFVFDTGAITIDATVSAPVLESGVENREVGGDTAEASHH

SEQ ID NO: 2847 - DNA, 1221 bp, Corynebacterium glutamicum
  CDS (101)..(1198): RXA02672
agcagtcatccccggaggctcaggcatcaaacaaacaagcctgagagtcatcgaagcttcaacacttgccgaagcacttgcagcagtaagcttataaagcatgacaccaacaaccactcctgtatcaaacccagatgccctttccactggaactcaggatgtgcacaccctcaaaggaacgttgcagcgcctcgccccaggcacaccacttcgcgatggcttagaccgcatcgtccgaggacacaccggcgcgttaatcgtcattggtgatgatgaaaacgtctcctcgatctgcgacggcggctttgaattcgacgtttcgtttgctgcaacccgactccgcgagctgtgcaagatggatggcgctgtcatcttgtcttccgaccttgagcgtatcaaacgcgccaatgttcagctgctgccttcaccaacctggccaacccaggagtccggcacccgccaccgttctgcagaacgcaccgcgcttcacaccggtgtgccagtgattgcggtatccgaatcacaaaacaccatcactctctacgtcgagggcaaatcccacatgttggagcagccagctgccctgcttaaccgcgccaaccaagctttgggaacaatggagcgctaccgcgatcgtctcgatcaggtcaataaccgccttcacctggctgaactccacagctatgtcaccgtgattgatgttgtttctgtcattcagcgcgaggaaatgctgcgccgagtgggtgaaatcattgatggcgatgttcttgaactaggcaaagacgccaaggagattcagatccagctcagcgaattacgtggcgataatgaccgagaacgtgaatcaatcattgctgattaccttgtcaccgacggtattcctgcagatgaggaaatccacgcagccctcgaagcgatctcacatttagatgataaggctctgctgaatcctgcgaacatcgcgcgtgttcttggactgccaccgaccgaggaagcacttgatgagccagtcactcctcgcggctaccgcacgctcaacagaattcctcgagtgcaaaaattcctcatggataaactcatcgtggaattcggcaacttggatgcactgctcaatgcgtcagtagaggatctaagtgcagtcgatggtgtgggctcactgtgggcacgccacatcaccgacggacttggccgtttaagttaggttaaaggtcaccgctggtg

SEQ ID NO: 2848 - protein, 366 aa, Corynebacterium glutamicum
MTPTTTPVSNPDALSTGTQDVHTLKGTLQRLAPGTPLRDGLDRIVRGHTGALIVIGDDENVSSICDGGFEFDVSFAATRLRELCKMDGAVILSSDLERIKRANVQLLPSPTWPTQESGTRHRSAERTALHTGVPVIAVSESQNTITLYVEGKSHMLEQPAALLNRANQALGTMERYRDRLDQVNNRLHLAELHSYVTVIDVVSVIQREEMLRRVGEIIDGDVLELGKDAKEIQIQLSELRGDNDRERESIIADYLVTDGIPADEEIHAALEAISHLDDKALLNPANIARVLGLPPTEEALDEPVTPRGYRTLNRIPRVQKFLMDKLIVEFGNLDALLNASVEDLSAVDGVGSLWARHITDGLGRLS

SEQ ID NO: 2849 - DNA, 1041 bp, Corynebacterium glutamicum
  CDS (101)..(1018): RXA02678
ctgtgggcgcgcgaacagggcgtcgacatgctcgccaccaattatccggaccgtgcggcggagcttttgaacgcacatcccaagcccgccatgtacgctaatgcgcatggcaaagaagactaagaagaatgaacagctgccggagggcatgagccgtcgtcaggcaaaacttgcagcccgcgcggctgaacgtgcagcacttgagcgtgaacctcgcccattcgagggcctggcaatggagtcacagctcgttgcactgcaggaattcattccatctgcaaccgcacccatcaccgttgcaggcaccgatcgcaagatcaccctctgtaccgtgcttccaggcgcagctgcggcacttgtccgcgaagaagcattcggcggcgaagcgtttgttgcaatgcagcaggccatccgctccaacaacccaagcaaggacctcgcgttcgcgctgaactgggtcatcaacgcaaaagccggcgagtcactggccaccgccacagcggacggcacccagccagagctaaagagcttgcttaacgacgccgacaccctcgaaatcaccactcaccaggacttcaactggtggctggcggaaaacgacaacctctccccagaagttgcgcagcacatgcaggcagccaatgactccatcctgccttcacacgaagtcgaagcagacgtcccaggcgctgtttggtgggtcaacccaggcggaaaagcgcacatccgttgggtccgcaccgaaaacgaaaccgcactgttcaacgctttggcacgcatcgcagcacgtggcgagctgaatctcggcgaagaaactaagttcgctggtgctttccgcacccacggcatcgtcgtcccagtgtgggatctcgatcctgagcgtccatccaccgattacgccgatgttttggttgcactcaacgagaagatcgtcgctgaactggataacgatgcacagctcaacgccgacgagcgccgtcagctggagaacatcaagtcccgccaggtgaccatccgctaaaatctcttaaaaacacttca

SEQ ID NO: 2850 - protein, 306 aa, Corynebacterium glutamicum
MRMAKKTKKNEQLPEGMSRRQAKLAARAAERAALEREPRPFEGLAMESQLVALQEFIPSATAPITVAGTDRKITLCTVLPGAAAALVREEAFGGEAFVAMQQAIRSNNPSKDLAFALNWVINAKAGESLATATADGTQPELKSLLNDADTLEITTHQDFNWWLAENDNLSPEVAQHMQAANDSILPSHEVEADVPGAVWWVNPGGKAHIRWVRTENETALFNALARIAARGELNLGEETKFAGAFRTHGIVVPVWDLDPERPSTDYADVLVALNEKIVAELDNDAQLNADERRQLENIKSRQVTIR

SEQ ID NO: 2851 - DNA, 801 bp, Corynebacterium glutamicum
  CDS (101)..(778): RXA02683
gacggtttcttctgtcatgacggaaactcctacttatacctcttcatctaggtcggtggaatctaccgcggggacgatcgctgcctcggaggaagccacgatgacgctactggagaatagttcgggggatccgggatctgattctgggggtgcacgctatagcctcaattcgctcaaagtttctgagcaggccgcggctaacgccgtcttaaaggccgtgcttaacgacgtctcctaccaagagttcgcagactcctcctacttagaaatcacaggaacgccctccgccgacggaacatggggcatctcatttggcggaccttccgaatcggcctccgtggaattctccgacggcagcatcagcttctcccctgttgacatgacagtgcccgcaacacgattgcctcagatgggcgcattttatgaaaccctgaccgaagaacaattaggcatgctggagactggcctcgcggtttccaccgtggattcgagccaacaggaaatgcttctggacttggtctccaactcgatcggcctggcagatactgaaaccactgcgactgcaattagtaaaatccgagcaacgctttccgagacctacctgttcggaacccccgacggattaaccttggcgcttagtggcccacacgttgatttcgaagtctcccaccagggcagcaccgcgaaaattacttaccgcgatccaagcaccgacaccttaaccgccgaagatcgggtagataccgcaagtgtggctgctgctccgccggaggttgtttaggcgtttgccgagaaattttc

SEQ ID NO: 2852 - protein, 226 aa, Corynebacterium glutamicum
MTLLENSSGDPGSDSGGARYSLNSLKVSEQAAANAVLKAVLNDVSYQEFADSSYLEITGTPSADGTWGISFGGPSESASVEFSDGSISFSPVDMTVPATRLPQMGAFYETLTEEQLGMLETGLAVSTVDSSQQEMLLDLVSNSIGLADTETTATAISKIRATLSETYLFGTPDGLTLALSGPHVDFEVSHQGSTAKITYRDPSTDTLTAEDRVDTASVAAAPPEVV

SEQ ID NO: 2853 - DNA, 780 bp, Corynebacterium glutamicum
  CDS (101)..(757): RXA02685
tagcagcatttgtggaaagagctgtggcatgagtagttcagtaatgtcaccgcgtcgaataaaggcggaaatacttatcgttttagccatcacctttggcatgagcggcctgcgatcaatcctgcgcctcatcgacgatctcctcgcaccggttgcgctcaacgaccagcaagttgcactgaatgcctcaatggcaaactccgcatggctggatctcaccttgcaattgtgttccgccggagtgctgttttcctggggagcactagcgatctacctgctaggtgaacgttttcagtggattaaacccaaagactgggcatggggtgcaggccttgcagcactcattggtattccagggttaatcttctacgccagtgctgttcatttggggctgtccaaacaggttgtgcccaccacgttggaaacctggtgggaaatcccagtacttcttatctggtcagctgccaacgcctttggtgaagagatcgtggtagtcatgtggtttttcaccaggctgcgccagctgaagtggagtgtgcctgcagttatcgtgacatcttcagtactacgcggttcctatcacctctaccagggaatctctgcaggcttgggcaacatcatcatgggagtagcgttcgcgtacttctatcaccgcacgggcaaaatctggccactggtaatcgctcacttcttgattgatgcggtggcttttgtgggctactccgcaattggcgggaatttaagttggttagggctttaaactgaagttcctattttatt

SEQ ID NO: 2854 - protein, 219 aa, Corynebacterium glutamicum
MSGLRSILRLIDDLLAPVALNDQQVALNASMANSAWLDLTLQLCSAGVLFSWGALAIYLLGERFQWIKPKDWAWGAGLAALIGIPGLIFYASAVHLGLSKQVVPTTLETWWEIPVLLIWSAANAFGEEIVVVMWFFTRLRQLKWSVPAVIVTSSVLRGSYHLYQGISAGLGNIIMGVAFAYFYHRTGKIWPLVIAHFLIDAVAFVGYSAIGGNLSWLGL

SEQ ID NO: 2855 - DNA, 792 bp, Corynebacterium glutamicum
  CDS (101)..(769): RXA02688
gtgcggaagacagcacgccccaaaccgaccaactagctaagctacacaaggcggacgaatgggttcgcgcagcaagcgaaggaaggaaacttaactagccatggccggccggattattttgctacgacacgggcagactcacaacaacgtcaaacacctcctggacacccgcccaccaggagctgaactcaccgacctgggccgtaaacaagcccttgaagttggccacgaactagccacctactccggtgagcgcctcgcccatgtgtacagctccatcgtgttgcgcgcccaacaaaccgccgtgcttgccacctctacctttgaaaaagctcgcgacatgcagtccggtgcgattccactcgacgttgtggaaggcattcaggaaatcaacgtcggcgactttgaaatgcgcggcgatgaagaagcccacatgaattactcccgcgcactcaacggctggcttcacggggatcctgccgctggtcttcccggcggtgagacctacaaagacgtgctgaaccgctaccagccgactcttgatcgaatcatggacagccacgaccttgacgacgaccgcgacgttgccgttgtcagccacggcgccgtcatccgcatcgtggcaacacacgcaactggtgtggatcccaactttgcgttcaacacctacctgggcaactgccgcttcgtggtgctggagccaaacggtaagaaattcagccaatgggatgttgtgcgctggactgacagcccactgccatggcaggagtaattgagaccaaaggctcggat

SEQ ID NO: 2856 - protein, 223 aa, Corynebacterium glutamicum
MAGRIILLRHGQTHNNVKHLLDTRPPGAELTDLGRKQALEVGHELATYSGERLAHVYSSIVLRAQQTAVLATSTFEKARDMQSGAIPLDVVEGIQEINVGDFEMRGDEEAHMNYSRALNGWLHGDPAAGLPGGETYKDVLNRYQPTLDRIMDSHDLDDDRDVAVVSHGAVIRIVATHATGVDPNFAFNTYLGNCRFVVLEPNGKKFSQWDVVRWTDSPLPWQE

SEQ ID NO: 2857 - DNA, 465 bp, Corynebacterium glutamicum
  CDS (101)..(442): RXA02689
gtgaagttcccccacctcagccagagcgcgatccgctccgtgacactgcaggaacgacagcatccgcggaggtcggagtacctgtagaggagaacgctccatgattgaagtcagcgacgaacgcttcgaggaactggtcgaactagccttcgaccaagttccccagcaattcctggatcatatgcgcaacgtggttttactcattgaggatttcaacccagattcgccttatatcttgggtttataccacggcgttgctctcacagagcgcacattcaaccacggtggcctgccggattccatcaccatttataaaggtgcgttgcaaaattactgcaattcagaggaacaactagtggagcaggtgcgggtgaccgtgctgcatgagattgggcattattttggcctcggcgaagaggacctgcacaggctcggatacgcctaaaacgcctcattaggtgcaca

SEQ ID NO: 2858 - protein, 114 aa, Corynebacterium glutamicum
MIEVSDERFEELVELAFDQVPQQFLDHMRNVVLLIEDFNPDSPYILGLYHGVALTERTFNHGGLPDSITIYKGALQNYCNSEEQLVEQVRVTVLHEIGHYFGLGEEDLHRLGYA

SEQ ID NO: 2859 - DNA, 1221 bp, Corynebacterium glutamicum
  CDS (101)..(1198): RXA02690
tttccttgtaccgaaccgaccgatattctttaaaaacattggttacacgctccgaagatctctgacgtgaacccattttggtggcatgatggtgtcaattatgagtacaaactttgacacttcgacgtctccagagggtgaaaccaagaagaactcttctttccgcactgcggcctctgtgcagaccatgcttgttgcagctttggcagcaacggctgctgttggcgtgtactcctacaacacggacaattcagcaaacggcggcgaatcccccacaggacctgagcaaagtacagtgtccaccaccgcaactattgcctcatttaccactgctgacgtgggccaatgtgcaacctgggatgttaacaatgaaggtctagtgtctggttttgaacaaaccagctgcgatcaagagcaccgctttgaaatttctgctcgggaaaacttggcaacttacccaagttcggaattcggtccggacgcagctccaccaaacctcacccgtcaggcgcagctgcgtgaagagctctgccaatctcctaccttggcgtatttgaataaccgtttcgatccatcggggcgctacaccatcgccccgatcctgccacctgcggaagcgtgggctgcgggagatcgcaccatgctctgtggacttcaggcaaccgacgcttcaggcactccacaactcaccgtcggaccgatagcagccaatgaccaggcacgcgtttttgaaaccggcgcctgcgtgaaggtggaatcctccgcagagttccgccaagttgattgcacggaagatcaccacctcgaatcaattttgacagtcaaccttggtgtccccttcccacagggcgcgcccagcacggatgagcagaacaatttcctcggaaacacctgcacccaagcatccattgattacctaggctccgaagaaaacgtctaccaatccaccctgcagaccttctggccaacgattacctccaactcctggttgggcggttcacacagcgtgaactgcttcctcatgtcaccatccaccgagggtgctgcaacatttaacaccctcaacggttcagcgactggcacattcaccatcaacggtgaagttcccccacctcagccagagcgcgatccgctccgtgacactgcaggaacgacagcatccgcggaggtcggagtacctgtagaggagaacgctccatgattgaagtcagcgacgaacgc

SEQ ID NO: 2860 - protein, 366 aa, Corynebacterium glutamicum
MSTNFDTSTSPEGETKKNSSFRTAASVQTMLVAALAATAAVGVYSYNTDNSANGGESPTGPEQSTVSTTATIASFTTADVGQCATWDVNNEGLVSGFEQTSCDQEHRFEISARENLATYPSSEFGPDAAPPNLTRQAQLREELCQSPTLAYLNNRFDPSGRYTIAPILPPAEAWAAGDRTMLCGLQATDASGTPQLTVGPIAANDQARVFETGACVKVESSAEFRQVDCTEDHHLESILTVNLGVPFPQGAPSTDEQNNFLGNTCTQASIDYLGSEENVYQSTLQTFWPTITSNSWLGGSHSVNCFLMSPSTEGAATFNTLNGSATGTFTINGEVPPPQPERDPLRDTAGTTASAEVGVPVEENAP

SEQ ID NO: 2861 - DNA, 1359 bp, Corynebacterium glutamicum
  CDS (101)..(1336): RXA02700
tgacaactgatgcggacgacaacgatcgaatttatagtcaaacccctcgtgcacgcagcgaagtctcggtagggggagaagttacagtaagggcgttttagtggttccctcgttgcagcaatggcgaaaacctgctctcatcctggccattttgacggtgctaggcgtactcctgacccattggttcgcctggccactcacctggccgctggggctgcgtcttcccgttgatgtagaggtgtactggcagggtgcgcgcgagttttggctcgccgatgatctctacgacatcaggtatgacaccactttcgacaacttgccgttcacctatccccctttcggtgcgttggtgttcaccccattgtggtggattcatgacctctttggtcttctcgtcaccgaacgtgtcttcgcgctaatcacgctgctcaccacctacgctgtggcagttttcctgctccgcctggccggcgtgcgcgatcgtgtgtgggaattcgtcgcattcgcagccctgctcgtgtccgcgccggtgtatttcacactcaatattgggcaaataaacgtcatgctcatggctttaacgcttttcgacgtcgccctcccccgcagcacgcgccattcaggcgtgctcaaatacgtgccactcggcgtactcaccggcattgccgctgcgatcaaactaaccccactagtgttcgggctgtatttcctcatcctgtgggtcgtgactaaatcaccacgcggactgtttggaatgattggtggcttcctcggggcatccgggcttgcaattattttccgaccatccattagcatccaatatttcaccgacgtgctgtttaccgcagaacgcatcggcgacctccacttcgcacgcaatgtctccatccgtgcggttttggaacgactccccgaacttggttccgcagcatctatcatgtggcttgttgctgtggcgctagtgatcatcgcagtcgcagttgctgcttaccgaatcctgcggacggatctctccgcgcacaatcgtctgctggctgtttccctcgtgtcgctcgttgcactgttgtgctcccccgtcagttggtaccaccactgggtgtggcttggtccgttaatcgtcgctctctggctaactcaacaccgctggctggctctatggggcgcattcgccgtgacattcggatcattccacaatttcctaccctcagaaaacaatatggagctcacctggccgtggtggatgcatgtcctcgcagcacattatttgatcttctccgcagtggttactgccgtatttagttgtgggaaaatgccccaaaaaacagagctttcccactaatcgatcaggagtatcacatc

SEQ ID NO: 2862 - protein, 412 aa, Corynebacterium glutamicum
VVPSLQQWRKPALILAILTVLGVLLTHWFAWPLTWPLGLRLPVDVEVYWQGAREFWLADDLYDIRYDTTFDNLPFTYPPFGALVFTPLWWIHDLFGLLVTERVFALITLLTTYAVAVFLLRLAGVRDRVWEFVAFAALLVSAPVYFTLNIGQINVMLMALTLFDVALPRSTRHSGVLKYVPLGVLTGIAAAIKLTPLVFGLYFLILWVVTKSPRGLFGMIGGFLGASGLAIIFRPSISIQYFTDVLFTAERIGDLHFARNVSIRAVLERLPELGSAASIMWLVAVALVIIAVAVAAYRILRTDLSAHNRLLAVSLVSLVALLCSPVSWYHHWVWLGPLIVALWLTQHRWLALWGAFAVTFGSFHNFLPSENNMELTWPWWMHVLAAHYLIFSAVVTAVFSCGKMPQKTELSH

SEQ ID NO: 2863 - DNA, 1423 bp, Corynebacterium glutamicum
  CDS (101)..(1408): RXA02701
cccactaatcgatcaggagtatcacatctccatgatttaagattaaaactttgtctaaacacgaacggtgttttcatgtttaagaaaaggactcctggttttgacgaacccccagacagcacatgctgccgcgtctgactccgcatcccagaaggaggctcctaatccttcactctccatcactgtaggtattaaagatctgctggggctgctttcagttcttggcattgcagcggggctgatagccaacaagattctcatcgaacgctacaactggcgcatcgatgccgcagtttaccgcgaaggcgcgttagcgctggtcaacggggaatcactgtacgcgcagccgtttgatatgggtgatatttcactaccctttatctacccaccgattggtgccatcctgtttgcgccttgggggtactttgatttcatcacagttgaacttgcgggaaaccttgttgtcataggctcatccctgctgttattactgtgcctgtatcttgtcaccaacgctgttcttagcggtcgagacaagctgttggccttcaccatcgctgcgatttcctggccgatcgctctctttgcagagccagtgtttttgaacgctgacttgggccaaatcaacattttgatcatggctttggttgtcatggacctgcttccgattaagcgcagaatcccccgaggtgtcctgattggccttgcagccgccatcaaaatcactccgctggccatgctgttgtatttcctggtgaagaaggatttccgcggaatcatcaatgcggtgatctcactacttgccttcactgctatcggtgctgtgctcgcatgggaaaacaccaaagagttcttctcttcaacccttctcaacttaagtgctgaaggcgattcaggcgtagacaccacgttccaatccaacagctcgattcaggccatgctgtatcgctggtggacctcaaaggcagatgccgaagcatcctcactgcccaccatcttgtggatcgtactgtccctgattgctgtggcggccgttgcctacctaatgcaccaactcttctccagaggattgcacgttgaggcagtcatggttaacgccatgctcatgctacttatctcccccatctcatggtctcaccactgggtgtggctaccgctgtgggctgtggtgttcttcgttcgataccgccagcaccgctctcacccgaagttcttgttgtggagcggagttatcttgagcgtcatgctgctgatgctgccaccaaaatggtggtttggccgcgatggcgtcaacgtcttcgaactgaatttctgggagaaactactcatctctgactggacgtggctctccatcgggctcatgatcaccttgggtcttgggctgaaagcatttcccaaaatatccaaatagataaaggtgtgg

SEQ ID NO: 2864 - protein, 436 aa, Corynebacterium glutamicum
LTNPQTAHAAASDSASQKEAPNPSLSITVGIKDLLGLLSVLGIAAGLIANKILIERYNWRIDAAVYREGALALVNGESLYAQPFDMGDISLPFIYPPIGAILFAPWGYFDFITVELAGNLVVIGSSLLLLLCLYLVTNAVLSGRDKLLAFTIAAISWPIALFAEPVFLNADLGQINILIMALVVMDLLPIKRRIPRGVLIGLAAAIKITPLAMLLYFLVKKDFRGIINAVISLLAFTAIGAVLAWENTKEFFSSTLLNLSAEGDSGVDTTFQSNSSIQAMLYRWWTSKADAEASSLPTILWIVLSLIAVAAVAYLMHQLFSRGLHVEAVMVNAMLMLLISPISWSHHWVWLPLWAVVFFVRYRQHRSHPKFLLWSGVILSVMLLMLPPKWWFGRDGVNVFELNFWEKLLISDWTWLSIGLMITLGLGLKAFPKISK

SEQ ID NO: 2865 - DNA, 918 bp, Corynebacterium glutamicum
  CDS (101)..(895): RXA02712
ctgaaacggcttcggaagctgaaattgaagaaaacccacgtgccgcacctgtgaaggtgcgcgcaatcgaaagaatcggcaacaactcaggagacctctcatgaccatgacaaatggctcccgcacagagtcgggaaagattcgcgatcgacgtgtcgctgacgctgatccacggtatggccgtcgcgtctcggtgagtagggatttctccacagcggaagcttcggggaggggcgcgtcgataagcacgcaacctcgtcgtgacatggcgccggaaaggcgccacacaacccgggccctagtgaaccctggcgtgcaaccaacgcgtaagcgtttgatgcagcacaagctgggctctcagcaggttatgtcggtgcgtggtcgccgcgttgaggcaaaacgtgctgatcctaaggtgatccagctgtctgtgctggtggttatcctgctgtgcgttggtgttggcgcgaccatgggtctgtccggaacgtctacacagcagactttccagttgcaggaacttcaggcaactgaaacggatttgagcaatcgcattgagtcgctcaaccgagatgtggaagatgctcgctcagcagcaaccttggcagcgaatgctacggagatgggcttggtatccccagtggaacctggcgtgctcgcagtgcaggaaaacggtgatgttgtggaggagcgcgaagcaaatccagagacacgccctatagttgacatcaatggacaacagacccgaccaaatcgggcatcaagcaaccctgacgagactaacgcagtgactgaaaacctccaggcgattccacaagaagcagcagctccgccgtatcagaccaacactgttccttatgctgcaaccaccggacaagcaggtggcgcagggcagtgactttccccagcaatggcaga

SEQ ID NO: 2866 - protein, 265 aa, Corynebacterium glutamicum
MTMTNGSRTESGKIRDRRVADADPRYGRRVSVSRDFSTAEASGRGASISTQPRRDMAPERRHTTRALVNPGVQPTRKRLMQHKLGSQQVMSVRGRRVEAKRADPKVIQLSVLVVILLCVGVGATMGLSGTSTQQTFQLQELQATETDLSNRIESLNRDVEDARSAATLAANATEMGLVSPVEPGVLAVQENGDVVEEREANPETRPIVDINGQQTRPNRASSNPDETNAVTENLQAIPQEAAAPPYQTNTVPYAATTGQAGGAGQ

SEQ ID NO: 2867 - DNA, 552 bp, Corynebacterium glutamicum
  CDS (101)..(529): RXA02714
cgcggtggtcttgcatgagaggccactacgcaccctcagagacaaactgaatggttggttctgtttatgccactgagttgctgggaaggggacttcaaggatgttccttggtacctataccccgaaactcgatgacaaaggcaggctgactcttccagcaaagttccgtgaggaccttgcggggggattgatggtcactaaaggtcaagaccacagtctcgcggtttatccgaaggaagaatttgcagcaagggctcgcaaggcagctgcagtttctaggacaaaccctgaggctcgtgcgtttatccgaaaccttgcagcaagcgcggatgaacaacgacccgacggccaggggcgcatcaccctttcggcagcgcaccgcacatatgcggggctgacaaaagagtgtgtcgttatcggttcggtggattttctggagatttgggacgctcaagcctgggccgcgtatcaggaagagacggaggctgccttctcagcagctgaagatgacgtccttggaggattgctctgatagttgggcaatgcttcgaa

SEQ ID NO: 2868 - protein, 143 aa, Corynebacterium glutamicum
MFLGTYTPKLDDKGRLTLPAKFREDLAGGLMVTKGQDHSLAVYPKEEFAARARKAAAVSRTNPEARAFIRNLAASADEQRPDGQGRITLSAAHRTYAGLTKECVVIGSVDFLEIWDAQAWAAYQEETEAAFSAAEDDVLGGLL

SEQ ID NO: 2869 - DNA, 513 bp, Corynebacterium glutamicum
  CDS (101)..(490): RXA02715
gtttttgtcgttattggcataacggggaacattctggatattctgggcgttaataaggcatagaagaaaaaatgtctctactaaccaccgggaggacatcgtgtcgctttcagagcaggagcaacgcgcactgcgcgaaattgagcaagcgctcatggcagatgatccgaaatttggaaaagcggttgcaagtaacaatggcctagcaggcggtgggtttacccttcggggaatcgcacttttcgtactcggacttgtccttcttgttgccggcgtcgcattaagccagcaaacattgtggttcgttgcgctcggaattatcggattcttagtcatgttcggatcgggagtgtggatgctgcgcgggggcggctccaacaaaatctccgtcacatcccgcacttccaatgcgaagaatcgccaacagggcaattccaccattggggacaaaatggaagaaaacttccgtcgacgattcgagggcaataagtaagaagtaactgaataagtctt

SEQ ID NO: 2870 - protein, 130 aa, Corynebacterium glutamicum
VSLSEQEQRALREIEQALMADDPKFGKAVASNNGLAGGGFTLRGIALFVLGLVLLVAGVALSQQTLWFVALGIIGFLVMFGSGVWMLRGGGSNKISVTSRTSNAKNRQQGNSTIGDKMEENFRRRFEGNK

SEQ ID NO: 2871 - DNA, 861 bp, Corynebacterium glutamicum
  CDS (101)..(838): RXA02721
ccgtgatgatcgtcgtgacgatcgccgcgatgaccgcggagacgacctggatgtacccagcttcctccagtaattaagaaggagaatagacttatccactatggatagtcttgacccccgcaaccgccccgtccgcaaggtcttcacgacccgtgccggcggggtttcgcagtccccgtatgcttccttcaaccttggtgatcacgtcggcgacgatcctcaagctgtggcatccaaccgcaatcgcttggctgacatcatcggtttgtccccagacaaggtggtgtacatggagcaaattcattccaataccgtcacagtcattgatgaagccccagcggatggccaggctgtagaggccaccgatgcgctagtgaccacgcaacgagggctagcgctggccgttttggttgctgattgcgtgccagtgctgctgtcagacaccgacgctggcgtgattgcggcagtgcatgcaggccgcatgggagcccgcaatggcatcgtagctaaaaccattgcgaagatggaggagctcggcgcgaaacccagccgcattcatgcgctcatgggtgcagcggcatcgggtgcgaactacgaggtcccagaggccatggcgcgcgatgtggaagccaaacttccaggttccattgcgcgtacgacaaaaggcaccacaggactggacatccgcgcagggctgctgcgtcaaatgctcagcctgggtgtgcaaatgattgattctgatccacgctgcaccatcgaagacgaagatctgttttcttaccgccgcgaaggcacgacaggccgccaggccggcgtggtgtggctgccaaaggaggcataaattggagcgccgcgaagagc

SEQ ID NO: 2872 - protein, 246 aa, Corynebacterium glutamicum
MDSLDPRNRPVRKVFTTRAGGVSQSPYASFNLGDHVGDDPQAVASNRNRLADIIGLSPDKVVYMEQIHSNTVTVIDEAPADGQAVEATDALVTTQRGLALAVLVADCVPVLLSDTDAGVIAAVHAGRMGARNGIVAKTIAKMEELGAKPSRIHALMGAAASGANYEVPEAMARDVEAKLPGSIARTTKGTTGLDIRAGLLRQMLSLGVQMIDSDPRCTIEDEDLFSYRREGTTGRQAGVVWLPKEA

SEQ ID NO: 2873 - DNA, 735 bp, Corynebacterium glutamicum
  CDS (101)..(712): RXA02725
gaaagcccgctgcacatcggtgtggcgggttttctcatgcccagatattgaccttgtcactgtgtcaaggcattgaataagtgccatgaacataagtgccatggacaacttcgaacattcaaatgcatctatccgtttacaagcagcgttggccgcaggaactgctgaggacaccactgcgatcgatattcttttgtaccgcagtggggtagaagaagacttctttgtgcgcgacatgataacgtgggcgctcacccgcatgccagttgatgacgtgtttacctcactggtcgctgatttggattctgaggtacctgatcgaccattcggtgcaagtcaagcactccacacactctccaagttaagggtcgcgcagtcgtggcaggaattgcaagcacggccttggcttttgcaccgggaggacaccgcccaaactgcgtggcgaacctttgtgggactggtcccagatgatcagaccgcatggttggcgcaccaattgctccaagaattggataaaggaacgcctgaaattcagcggagtttaagtcgggcgatggcggaattggaggggagggaggcgtcgataagcgtgcttctaggcgctttaacgagcgcgcacgcggtggccaccgccaagctcattgcggatccggactccgatttcatggctgatctggaggaagcgcggcgcgtggataatatgggtgcatgctgatcggtgaggtgtccaagctc

SEQ ID NO: 2874 - protein, 204 aa, Corynebacterium glutamicum
MDNFEHSNASIRLQAALAAGTAEDTTAIDILLYRSGVEEDFFVRDMITWALTRMPVDDVFTSLVADLDSEVPDRPFGASQALHTLSKLRVAQSWQELQARPWLLHREDTAQTAWRTFVGLVPDDQTAWLAHQLLQELDKGTPEIQRSLSRAMAELEGREASISVLLGALTSAHAVATAKLIADPDSDFMADLEEARRVDNMGAC

SEQ ID NO: 2875 - DNA, 1035 bp, Corynebacterium glutamicum
  CDS (101)..(1012): RXA02727
gatcagttcctagatctcgttgaggacgccctcgttcagttccaagaggaaaacgaagacctaaagcagcaggtcgaagagctagaggcgcaggttgccggtggtccttcttccgctgctagttcctcaactgcaggtgcagccacagttgcagcttccaagtctgttgacgaggcagcgctgcgcaaggaaatcaaagagaagctgcgctccgaatacggcatccaagctcgatgatgcctccaaggccgctcagaaggctcaaaacgatgcgaagtccgctcaagatcagctacagcgtgcacaagctgacgcaaaggcagctcgcgacgaagctgaaaaggccaaggctgaagctaagtcagcagcatcctccagcaccactaaggcagcagcggttggcgctgtcggcgctggcaccggagcagcagttgctacaggtgctgcaaatgtggacacccacatgcaggcagcgaaggttctgggactcgcacaggaaatggcagaccgcctgacctcagaggctcgctccgaatccaagtccatgctggacgaggctcgcgaagcagcagagaagcagatcgaggaagcaaacagcacctccaaccgcactctggaagatgctcgcgcaaacgctgagaagcagatcgctgaagcgcagaaccgcgctgacactctggtcaacgaagctgacgctaaggctaagaacctggtttccgaagccgagaagaagtccgcagccaccctggccgcatccacctctcgtgcagaagctcagatccgtcaagccgaggacaaggcaaacgccctccaggcagacgcagagcgcaagcacaccgaaaccatggctgcagtcaaggaacagcagaatgctctggagacccgcatcgcggaactgcagaccttcgagcgtgagtaccgcacccgtctgaagtccctcctcgagggccagctggaagaactccacgcacgtggctcctctgcaccaaccaacaacaagccatctggtgagtaaaaagaaagattagttatctt

SEQ ID NO: 2876 - protein, 304 aa, Corynebacterium glutamicum
VVLLPLLVPQLQVQPQLQLPSLLTRQRCARKSKRSCAPNTASKLDDASKAAQKAQNDAKSAQDQLQRAQADAKAARDEAEKAKAEAKSAASSSTTKAAAVGAVGAGTGAAVATGAANVDTHMQAAKVLGLAQEMADRLTSEARSESKSMLDEAREAAEKQIEEANSTSNRTLEDARANAEKQIAEAQNRADTLVNEADAKAKNLVSEAEKKSAATLAASTSRAEAQIRQAEDKANALQADAERKHTETMAAVKEQQNALETRIAELQTFEREYRTRLKSLLEGQLEELHARGSSAPTNNKPSGE

SEQ ID NO: 2877 - DNA, 828 bp, Corynebacterium glutamicum
  CDS (101)..(805): RXA02735
gaggagcttcgccacatggatccagatttgggctaccagcacgcactatccggcttgtccagcgtcaagctggaaaccgtctaaggagaaatacaacactatggttgatgtagtacgcgcacgcgatactgaagatttggttgcacaggctgcctccaaattcattgaggttgttgaagcagcaactgccaataatggcaccgcacaggtagtgctcaccggtggtggcgccggcatcaagttgctggaaaagctcagcgttgatgcggctgaccttgcctgggatcgcattcatgtgttcttcggcgatgagcgcaatgtccctgtcagtgattctgagtccaatgagggccaggctcgtgaggcactgttgtccaaggtttctatccctgaagccaacattcacggatatggtctcggcgacgtagatcttgcagaggcagcccgcgcttacgaagctgtgttggatgaattcgcaccaaacggctttgatcttcacctgctcggcatgggtggcgaaggccatatcaactccctgttccctcacaccgatgcagtcaaggaatcctccgcaaaggtcatcgcggtgtttgattcccctaagcctccttcagagcgtgcaactctaacccttcctgcggttcactccgcaaagcgcgtgtggttgctggtttctggtgcggagaaggctgaggcagctgcggcgatcgtcaacggtgagcctgctgttgagtggcctgctgctggagctaccggatctgaggaaacggtattgttcttggctgatgatgctgcaggaaatctctaagcagcgccagctctaacaag

SEQ ID NO: 2878 - protein, 235 aa, Corynebacterium glutamicum
MVDVVRARDTEDLVAQAASKFIEVVEAATANNGTAQVVLTGGGAGIKLLEKLSVDAADLAWDRIHVFFGDERNVPVSDSESNEGQAREALLSKVSIPEANIHGYGLGDVDLAEAARAYEAVLDEFAPNGFDLHLLGMGGEGHINSLFPHTDAVKESSAKVIAVFDSPKPPSERATLTLPAVHSAKRVWLLVSGAEKAEAAAAIVNGEPAVEWPAAGATGSEETVLFLADDAAGNL

SEQ ID NO: 2879 - DNA, 1080 bp, Corynebacterium glutamicum
  CDS (101)..(1057): RXA02736
cagaggattacccagcgggtacgtggggtccaaagagcgctgatgaaatgctttcccgcaacggtcacacctggcgcaggccataatttaggggcaaaaaatgatctttgaacttccggataccaccacccagcaaatttccaagaccctaactcgactgcgtgaatcgggcacccaggtcaccaccggccgagtgctcaccctcatcgtggtcactgactccgaaagcgatgtcgctgcagttaccgagtccaccaatgaagcctcgcgcgagcacccatctcgcgtgatcattttggtggttggcgataaaactgcagaaaacaaagttgacgcagaagtccgtatcggtggcgacgctggtgcttccgagatgatcatcatgcatctcaacggacctgtcgctgacaagctccagtatgtcgtcacaccactgttgcttcctgacacccccatcgttgcttggtggccaggtgaatcaccaaagaatccttcccaggacccaattggacgcatcgcacaacgacgcatcactgatgctttgtacgaccgtgatgacgcactagaagatcgtgttgagaactatcacccaggtgataccgacatgacgtgggcgcgccttacccagtggcggggacttgttgcctcctcattggatcacccaccacacagcgaaatcacttccgtgaggctgaccggtgcaagcggcagtacctcggtggatttggctgcaggctggttggcgcggaggctgaaagtgcctgtgatccgcgaggtgacagatgctcccaccgtgccaaccgatgagtttggtactccactgctggctatccagcgcctggagatcgttcgcaccaccggctcgatcatcatcaccatctatgacgctcatacccttcaggtagagatgccggaatccggcaatgccccatcgctggtggctattggtcgtcgaagtgagtccgactgcttgtctgaggagcttcgccacatggatccagatttgggctaccagcacgcactatccggcttgtccagcgtcaagctggaaaccgtctaaggagaaatacaacactatgg

SEQ ID NO: 2880 - protein, 319 aa, Corynebacterium glutamicum
MIFELPDTTTQQISKTLTRLRESGTQVTTGRVLTLIVVTDSESDVAAVTESTNEASREHPSRVIILVVGDKTAENKVDAEVRIGGDAGASEMIIMHLNGPVADKLQYVVTPLLLPDTPIVAWWPGESPKNPSQDPIGRIAQRRITDALYDRDDALEDRVENYHPGDTDMTWARLTQWRGLVASSLDHPPHSEITSVRLTGASGSTSVDLAAGWLARRLKVPVIREVTDAPTVPTDEFGTPLLAIQRLEIVRTTGSIIITIYDAHTLQVEMPESGNAPSLVAIGRRSESDCLSEELRHMDPDLGYQHALSGLSSVKLETV

SEQ ID NO: 2881 - DNA, 597 bp, Corynebacterium glutamicum
  CDS (101)..(574): RXA02751
ggtgtcttcttgtcaaataaccactgtttatagggcaattctttggcaatgtacccaactcattacccacctgctgattcaaagagtagatttaaatagtgtgcttccgattgcctccggtaacgatgaccggaatttaatccgttatgtcgacggtggtcgatttgatgaaatcatgctcaccggagacctcactggcctgagcagttttcttaccaacgctggcccgaacgcccgggatgattttgatctcacggtgctcatgcgcgctgccgaggcaggcaacctcatggttgttgcccgcttgttagatttaggtgccaatccccgactcaccaatcctcgtggtgtcacggccctacatatcgcagcgatcgccggggacgatggcattgtggaatgcctcattgatgcaggcgctgaagtcgatgctgtagatgatcaaggtcgcactcccctatggaacgcagcggctcatcatctgcctgattctgcggtggtggatgtgctgcttcgcgcaggtgcgaatgtgaatctgcgcgattgcaatggagtcagcccagaagacatgctgtagaagcattctttagcaggatt

SEQ ID NO: 2882 - protein, 158 aa, Corynebacterium glutamicum
VLPIASGNDDRNLIRYVDGGRFDEIMLTGDLTGLSSFLTNAGPNARDDFDLTVLMRAAEAGNLMVVARLLDLGANPRLTNPRGVTALHIAAIAGDDGIVECLIDAGAEVDAVDDQGRTPLWNAAAHHLPDSAVVDVLLRAGANVNLRDCNGVSPEDML

SEQ ID NO: 2883 - DNA, 1014 bp, Corynebacterium glutamicum
  CDS (101)..(991): RXA02756
cgtgacggttgttgcaattccataactaaacgagctttgattaacaagtccttgtattgtgtaaatcgcttattgcacacaattgaaaaaggacattgttatgacaagcccttatggatcccaatacccaggcgacgacaacaataattggaactcccagttcggcaacccttccggcgagcagaactacggtcagccctacggtgcgccatatggacagccttacgggcagccatttgatcaaggattcaacgcctacagttctcccatcccacctgaggtcccacagccttccatgcaggaggctcagtggcgctcctttgaccttggaactgtttttggtcaggcatggaagggctttaccgcaacgtggcaggcatgggtgctgtctgcactgatctacttcgcggtgttgcttgtgctgatgtttgcgtggatcctcccgatggttagtgtgctcgcagcgacctcatctggttctgattccgcagctattgcagcgacgggtggcaccagcttcttcgggttcatgctgatgatcgtcctggcattcatcagttttgtgtactcccttaactgctaccgcaacgcggctcgagttgtgcgcggtgagcagatcaccattcagagtttcttcaagatgaagggtcttggtaaggcgctcggtatttacatcttgatcaatatcgtcatcttcatcggaatgatcttgctgctcattcctggaattatcgctgccgtggtgctgatctttgctgttcctgtggcattccagctgcgcgacgcctcgatcggtgatgcgttttccgcaagctggaaggcagtgtccaaaaacgttggtcaggtcattctcttagaactggctatcttcgcgttgagcttcttgggcagcgcagtgatcatcggtatgttggtgaccactccgcttacattcctgctgtatgcctacgcattccagaccgccagcggtggtcccatcatgcagcgtcagtagcagttagttttacttagtca

SEQ ID NO: 2884 - protein, 297 aa, Corynebacterium glutamicum
MTSPYGSQYPGDDNNNWNSQFGNPSGEQNYGQPYGAPYGQPYGQPFDQGFNAYSSPIPPEVPQPSMQEAQWRSFDLGTVFGQAWKGFTATWQAWVLSALIYFAVLLVLMFAWILPMVSVLAATSSGSDSAAIAATGGTSFFGFMLMIVLAFISFVYSLNCYRNAARVVRGEQITIQSFFKMKGLGKALGIYILINIVIFIGMILLLIPGIIAAVVLIFAVPVAFQLRDASIGDAFSASWKAVSKNVGQVILLELAIFALSFLGSAVIIGMLVTTPLTFLLYAYAFQTASGGPIMQRQ

SEQ ID NO: 2885 - DNA, 669 bp, Corynebacterium glutamicum
  CDS (101)..(646): RXA02757
ttcggatccttcgaccgttcaggcaatgcagatcgcgttgcacattccgaaacagaatccgccccggcggacagatgtgttggaagcggcggcgaggagtgtggtcaagctttgcctcgacgaacgagtatccaccgatcctgattttcgggcggccttggaacgttggtacggacacttgattcggaaggtgtcacgtcgcgctcgtaatgcggcgtgggatcgggtgcaagatttacccggcgtgactgtggaagatgatgctgcaaaggttcgggcatttttgcccagcgcagtggtggatgtgcctgcagatatcaaaaagctgcagatttccggtacggaattgcctctcgatgagccgaatccgatcaacgatgaataccccgttatctacattgatgaatcgttgaagatgacgctgggaaaggccgctgcgcaggtaggacacgcatccatgttgcttgccgcgcaccaaccgtttgagtgggtggagcagtgggaagcagcggattttgcgctgcacgtcagggagattccctcggaggagttcctgcgccttatcgagtctcctggtgctgttccagttcgcgatggcggctttactgaggttgcccccaacaccgtgacggttgttgcaattccataactaaacgagctttgattaac

SEQ ID NO: 2886 - protein, 182 aa, Corynebacterium glutamicum
VVKLCLDERVSTDPDFRAALERWYGHLIRKVSRRARNAAWDRVQDLPGVTVEDDAAKVRAFLPSAVVDVPADIKKLQISGTELPLDEPNPINDEYPVIYIDESLKMTLGKAAAQVGHASMLLAAHQPFEWVEQWEAADFALHVREIPSEEFLRLIESPGAVPVRDGGFTEVAPNTVTVVAIP

SEQ ID NO: 2887 - DNA, 882 bp, Corynebacterium glutamicum
  CDS (101)..(859): RXA02765
tctgaacttttccgcatcgacccagatgaggtttaccccgacgacgacgccacctgcgaattcaacccatggccgtatcctcgcggattttaggagataaatgtctaatcaattacccgatcacgtccgcgacgccttccaagtaggtgcgggacctgccgaacaactcggtcaagcttgggacttcggattccgcgtcggcaacactgtgttcgccaaagtgacggcgccggaagtgtcgggctggtcgtcgaaaacccgcgaaaccctgaaaccagaaggcgtgcgcgtcgtacgaccgatccgctccaccgacggccgatttgtggttgcggggtggcgcgcatcggtgttctctacgggaacgatcagcaagcgagtcgatgagacggtcgttgcgggtcttcgtttggcagatgcattagtggatacgcatgcaccggaacctgtggacaatgtgtttaaccgtgctgatgtgcaggcctgggaagagcagcccggtcgaatcggtgaattgttggagccgattaatcgcgtgaaccaggttggtcatgcggatatgttggcgacaacgctgtatgcgggaactcagccacctgcagtgacggatttggtgccagtgctgcgtccgcatggtttcactgcggcattggtgatcgttgatgggttgctgctgggtgcggttgatgagggaattctgcggaggttttcgcatttgccggaaattgagcagctggttttgagggcatttttgttccgtcgaaacttgcaggagttctctgagaacaacgatccgaatgttatttcgaacctaaacagggtggaatcgacactcgtgtcgtatgtttctgacaagatttgaggtatgtcggaatacaaacc

SEQ ID NO: 2888 - protein, 253 aa, Corynebacterium glutamicum
MSNQLPDHVRDAFQVGAGPAEQLGQAWDFGFRVGNTVFAKVTAPEVSGWSSKTRETLKPEGVRVVRPIRSTDGRFVVAGWRASVFSTGTISKRVDETVVAGLRLADALVDTHAPEPVDNVFNRADVQAWEEQPGRIGELLEPINRVNQVGHADMLATTLYAGTQPPAVTDLVPVLRPHGFTAALVIVDGLLLGAVDEGILRRFSHLPEIEQLVLRAFLFRRNLQEFSENNDPNVISNLNRVESTLVSYVSDKI

SEQ ID NO: 2889 - DNA, 516 bp, Corynebacterium glutamicum
  CDS (101)..(493): RXA02766
atttctcgccgcgccgcacggtgacgccggccatgttgagtgctagttcgcgcatgggtaacaccttactggcgtaaggccagggcttagactggtacccatgacaacctcagaaaatttttatgattctgtgggcggcgaggaaacgttttccctcatcgtccaccgtttttatgaacaggtccccaacgacgatattttaggcccgatgtatccgccggatgattttgagggcgccgagcagcgtctaaagatgttcctcagccagtactggggcggcccgaaggattatcaggagcagcgtggacaccctcgtctgcgcatgcgtcacgtcaattaccccatcggcgtcaccgcagcggagcgttggctgcagctcatgtccaatgcactcgacggcgtggatttgaccgcggagcagcgtgaagcgatttgggagcatatggtgcgcgcggccgatatgctgatcaattccaaccccgatccgcacgcttaacttctgccaaaaagtcgttt

SEQ ID NO: 2890 - protein, 131 aa, Corynebacterium glutamicum
MTTSENFYDSVGGEETFSLIVHRFYEQVPNDDILGPMYPPDDFEGAEQRLKMFLSQYWGGPKDYQEQRGHPRLRMRHVNYPIGVTAAERWLQLMSNALDGVDLTAEQREAIWEHMVRAADMLINSNPDPHA

SEQ ID NO: 2891 - DNA, 494 bp, Corynebacterium glutamicum
  CDS (1)..(471): RXA02774
ccctgcccaccaacacagaagctgctctatgcacagatgcgtgaaattgcagccgaacttacagcctgtgacgctactcgcggactccatgccgaagtggctgccgaatggcttagtgacgccataaccggcgaacccacctctatcgagattgacccccaccgcaacctgttctacgcacttaatgttgagcacccgcgactccatgaactctttgccggttacgctacacgccttgatgaactcgaccgcgcaccgcagcagtgtgagtcgcgtcaatattttcttgattatgtctgtgctgacaacccttttggctcagacaaaccagagggcattatcgtgctgctcgctgatcacgtgctggcagcagatccagtgacaaacaagccggcactcaaatcagaggcattccctactgtcacagactattgccgcactcactctgctaaaccaacagacattctcatttaaggattttagtcaccatgacg

SEQ ID NO: 2892 - protein, 157 aa, Corynebacterium glutamicum
PCPPTQKLLYAQMREIAAELTACDATRGLHAEVAAEWLSDAITGEPTSIEIDPHRNLFYALNVEHPRLHELFAGYATRLDELDRAPQQCESRQYFLDYVCADNPFGSDKPEGIIVLLADHVLAADPVTNKPALKSEAFPTVTDYCRTHSAKPTDILI

SEQ ID NO: 2893 - DNA, 348 bp, Corynebacterium glutamicum
  CDS (101)..(325): RXA02775
gcccccaccatctttggcactgagattgtgttcgattaactaccactgctgcacacacacatacaacacctctcacacacaaacaagaaagggtcaccccatgaccaccgttcaagtatccacccgcactgtgcgcgaacaccgttttactgtgccagtggactacgctgtcggcgccaccatttcagaaatctatgctgcctgtgccatggccgaaaagaaagccaacaaccttgggcttaacactactaaggacgattgggcacgagtcactgtcactgataatgctgttgtgttcattgtcgagaatgttatcgggaatacttagaattgtgtgctccttaacgg

SEQ ID NO: 2894 - protein, 75 aa, Corynebacterium glutamicum
MTTVQVSTRTVREHRFTVPVDYAVGATISEIYAACAMAEKKANNLGLNTTKDDWARVTVTDNAVVFIVENVIGNT

SEQ ID NO: 2895 - DNA, 465 bp, Corynebacterium glutamicum
  CDS (101)..(442): RXA02776
gcagcacctagcaatgcagccgaggcagccccttcaggttttgagccaggtacggctattcaagttgtataatccttcattcgatgatcaaacaccttcggtgctctatcctgttgaagcaggaacggtgtctctcgttgatgtaaagaaagcggctagccgtgcctttgaacagtgggaaaagcacaacgagtccgctggtgatgtcggtgatgatctttcactgcagagtatcgtagatctcattgagcgtgacactttccccaccgacgatgagcaagagctcaataatgtggctttgcttatcggcgaactcctggtgagggaggccggtggagagtggacgtcgtacatctcaaagaaaaatgatgaagatgaatcgctggagattttcggggtttttggcaccggtggcactgaaggattatctgtagtgggtaattgagttcgcatggttagtgaaaa

SEQ ID NO: 2896 - protein, 114 aa, Corynebacterium glutamicum
VLYPVEAGTVSLVDVKKAASRAFEQWEKHNESAGDVGDDLSLQSIVDLIERDTFPTDDEQELNNVALLIGELLVREAGGEWTSYISKKNDEDESLEIFGVFGTGGTEGLSVVGN

SEQ ID NO: 2897 - DNA, 1230 bp, Corynebacterium glutamicum
  CDS (101)..(1207): RXA02777
ggtcgcaccacaccaactactgtttcttctgtaatttgcactgaaactatcgcctacactgtcactgctaccatcacaatcggttgctagtaggctacaaatgaaccgcccccttcaaagtcaaaatttttcaataaccagcgaatgggcaaatgccacgttcaacgatatcgaagactctttggaggggtcttttgacatcgaaccaggccaatacattggacgcggagaatacttcgtagctacttctggaacgggttccaaaaagtttatcaaggtggttttgggtgacggtatcgatagcgaactaaatcgtcgcatcgaaggtgaaattcttgcaagtagtctccatcttccatccacagacctaatctctcctgtcgtaattcagtatgtgaaagagtcttctaattttcccggtgacttctacatcgtgtccgacttcaaagacgacacagaaactttagagctatctaaggcttctctacccctcactgacttagccaagatcggagcgtttctctttcgtttggaatctgtaacagttccccctcaaaatcctgcaaggcgagcaatggatgttttggatggactttctcttcttgcaaataaaggcaacattgaaacaggcgcacaattaacaaaaggaactatacaagctcttgaaatcattaatcaagaagcgaccaacatcgagaatgcacttgaaaaagtaactaaagtaggatcacggaagtttttctcgcatggagatcttaaattttctcagttcttaattaatggtgaaaccggaaagattttcctatgtgactgggaagaatgcggtagtgcacatttcgcaaatgacctatgttttctcgcaggtgatttgttctatagcacaattcgggaactggtggataccaacatcaaaaacattaaaggctcctcgatcattcaggaagcctacgataatgcaacgcttgaggctgtatcaaaagtaaatgcaatattaactggctattcctcagagaggggttactctctcacctcggacgaaaaacgaatcattagtatcagaatcggattggctggtctatttcgactttacactgtgagcgctaaatctaatgagttacgcccgcgcgaattagccttagcctccatcggaatgcaaattactttaggtcaagcacccaatctggtgtttacagatagcaaggtggtttaagtgaggaatttgcacgaaac

SEQ ID NO: 2898 - protein, 369 aa, Corynebacterium glutamicum
MNRPLQSQNFSITSEWANATFNDIEDSLEGSFDIEPGQYIGRGEYFVATSGTGSKKFIKVVLGDGIDSELNRRIEGEILASSLHLPSTDLISPVVIQYVKESSNFPGDFYIVSDFKDDTETLELSKASLPLTDLAKIGAFLFRLESVTVPPQNPARRAMDVLDGLSLLANKGNIETGAQLTKGTIQALEIINQEATNIENALEKVTKVGSRKFFSHGDLKFSQFLINGETGKIFLCDWEECGSAHFANDLCFLAGDLFYSTIRELVDTNIKNIKGSSIIQEAYDNATLEAVSKVNAILTGYSSERGYSLTSDEKRIISIRIGLAGLFRLYTVSAKSNELRPRELALASIGMQITLGQAPNLVFTDSKVV

SEQ ID NO: 2899 - DNA, 348 bp, Corynebacterium glutamicum
  CDS (101)..(325): RXA02778
ctccgatttctgaggtcagtacgcgctcctgtctaacttctaccacccagcccaaccaatcgtttttcaagggttcaccgaagcaactgttgagcacctcatgcaggtcattgagacgcttgatcccgatcagcgcgcagcggtgctcgctgcagcgataccgcgcgaggctaagatcctggggcgaaaagtaactcttcgccctggttggggcaatatgcgcgtacacgtcgtgattgcagttatctttatcaagtttttgcaaccggatcttcgccaggcgctgctaacaacaggtgatgccgtacttgtcgaagatgatacctgaggcgccttctggggcgtcga

SEQ ID NO: 2900 - protein, 75 aa, Corynebacterium glutamicum
MQVIETLDPDQRAAVLAAAIPREAKILGRKVTLRPGWGNMRVHVVIAVIFIKFLQPDLRQALLTTGDAVLVEDDT

SEQ ID NO: 2901 - DNA, 402 bp, Corynebacterium glutamicum
  CDS (101)..(379): RXA02779
ctcaaaggagactgcacatcatgttcctcaccaaagatatgctcgcacgttttcctgcaagtttgaatttgccaatgcacagtgctcagaaccagaagaaatgggcgaatacttccaggtcgttcaaaacatcgccatgacactgggtgctggcgaaagcgttgatcttgttgtccgcgaatacatcaacgatgtggaaggcaacccgaccatctatcacggtatgccgctgcgtactgaataccgcgcattcatcgaccttgatcactgtgatccgtccgctggtgagcctgagcctcgcttattgggggttactccctactggcacccctccgtgatggagaaagctcttcgcctttgcttcaagcgatgttggtgctgaattcggtcacatcaacgatg

SEQ ID NO: 2902 - protein, 93 aa, Corynebacterium glutamicum
MGEYFQVVQNIAMTLGAGESVDLVVREYINDVEGNPTIYHGMPLRTEYRAFIDLDHCDPSAGEPEPRLLGVTPYWHPSVMEKALRLCFKRCWC

SEQ ID NO: 2903 - DNA, 450 bp, Corynebacterium glutamicum
  CDS (101)..(427): RXA02780
atggagaaagctcttcgcctttgcttcaagcgatgttggtgctgaattcggtcacatcaacgatgattaccgcacctaccgtgcccacaaagacagcctcatgtccaagttccatacacaccgtgatgatgtcatttcacgtatcactgcactactaccccagcttcgtgcacaagagctgcaaggtcaatggtctgtggacatcatgaaaaacggggaggatttctacctcattgacatggctctcatgtgcgagtccgcactgtctgaactactcactgttacagatgagtacgccacagtcgagccgagtgtcatcaatgacttcgccaaccagctggtcattgattatgacgagcacgatatgggctttgatcgagactttccagcaggtgtgtataacacccgacaagcaagtgctatcaactaaaaaatacacacatccacacc

SEQ ID NO: 2904 - protein, 109 aa, Corynebacterium glutamicum
MSKFHTHRDDVISRITALLPQLRAQELQGQWSVDIMKNGEDFYLIDMALMCESALSELLTVTDEYATVEPSVINDFANQLVIDYDEHDMGFDRDFPAGVYNTRQASAIN

SEQ ID NO: 2905 - DNA, 672 bp, Corynebacterium glutamicum
  CDS (101)..(649): RXA02783
acaagcttcatgcaacccataacctcagtgctgttttgcctaccgaaactactgactcacgtgtggcaaccaccgctttcgccgtacactcacactgtcggtggtctctggttcacgcgctgctgcattcttgaacagcaaccatattcagggtgctgtctcggccactaagcactttgccctgtgcgacaacaacgacgatattcgagcactcctgtcggtgcgctcaccaaaaaacaatgcccgcatgtatcgcaaaaaaggcacatgggaaatccagcgctatgcgacactcggtaacgtccctggcggttttactaggctgctgaagtttgccgagcacacactcaacgaacacagcacagtactcaagcaatggatctcattttctgctgctgatgtctctgacggcagcctgtatcgaactgccggttttaccgccgagcaacagcttgcaccggattatcgctatgtcggtggcgcaacaggttggcgccgaacacccaaagaaagcttccagcgcaaacgctttagagacgacccagcgttgctatggaacgaatcttggacagagcacgaagcagcgctcaacaacgagctctacagaatctacgatgccggcaaaacccggtgggttaaaaatgttgcttgattctgcagattagttactga

SEQ ID NO: 2906 - protein, 183 aa, Corynebacterium glutamicum
VVSGSRAAAFLNSNHIQGAVSATKHFALCDNNDDIRALLSVRSPKNNARMYRKKGTWEIQRYATLGNVPGGFTRLLKFAEHTLNEHSTVLKQWISFSAADVSDGSLYRTAGFTAEQQLAPDYRYVGGATGWRRTPKESFQRKRFRDDPALLWNESWTEHEAALNNELYRIYDAGKTRWVKNVA

SEQ ID NO: 2907 - DNA, 309 bp, Corynebacterium glutamicum
  CDS (101)..(286): RXA02784
agctgcaactcaggtagaagaaacaacagtcgcccgagttgaacacgatacttacgacactattgctaaccagctacaagatgccggtgtctatgacgatgtggcctttgccgaaggctactaccaggaaatggctgaggttgtatgtgaagcacgcgaagagggtatcacccacgaggacaccctgcatatgctcaatgacatgatggcaatgaaacgatctggcgaagtactcaatacgctcgctgatgttctctatgcaaatgaatgccctgaatatcgaatctaaattgttggtcactctgcata

SEQ ID NO: 2908 - protein, 62 aa, Corynebacterium glutamicum
VAFAEGYYQEMAEVVCEAREEGITHEDTLHMLNDMMAMKRSGEVLNTLADVLYANECPEYRI

SEQ ID NO: 2909 - DNA, 830 bp, Corynebacterium glutamicum
  CDS (1)..(807): RXA02786
atcctgcgcaacctcggccaatcgctgggcagcctgcacgccgccaccgcagaccgcgaagaagacttcaacattctgctcaaccgtatgctggccaaatacccagccacagctgagatgcagaaaaaccgcgataggttgctgcccgcagcaattgaggtgggtaaaaagatacttgtcgacgccggggtcaccgttccagaagtcgtcgaggagtttgcccgcgtagctcggcgacgcctgatttccggacgccaccgtgccttcacaccttttgacttgtcacccgacaacatcatcgtggctgaacgcacccacttcctggactacgaagttgccggtttcagggatgccacctttgatgttgcttgtgtgatcgcaggtttcccgcaattcgtgttcagccgccccatctctgatgatgaggtagacgaactcattgaatcctgggtccaagaagtccgtggaatctggcccaatgtgaacaatgaagagcgcctccaagcacgtatcgtgaccgctctcatcggctgggcactatcgagtgttgccttcatgaagctcggctccatcagcggcatgcttaacctgctgcacgtcaccgaagatggaaacaccactttggatgtctccaaccttgatgaactgttgattccacgatctgccgaagatgacgagctggtccagcaagacctccacgacacgttctccgcgcttcagcgatttgcagcgcgcgggctggattccaggttccctgaggtggcacgattcgcagacgacgtggtgcgtttgttcctcaaaaatgactagctgaagagcaccggttgctt

SEQ ID NO: 2910 - protein, 269 aa, Corynebacterium glutamicum
ILRNLGQSLGSLHAATADREEDFNILLNRMLAKYPATAEMQKNRDRLLPAAIEVGKKILVDAGVTVPEVVEEFARVARRRLISGRHRAFTPFDLSPDNIIVAERTHFLDYEVAGFRDATFDVACVIAGFPQFVFSRPISDDEVDELIESWVQEVRGIWPNVNNEERLQARIVTALIGWALSSVAFMKLGSISGMLNLLHVTEDGNTTLDVSNLDELLIPRSAEDDELVQQDLHDTFSALQRFAARGLDSRFPEVARFADDVVRLFLKND

SEQ ID NO: 2911 - DNA, 669 bp, Corynebacterium glutamicum
  CDS (101)..(646): RXA02789
ttcttccgtacggctatgcttaaaagctaaatttgtctttgtgccttgcaacacattaatttcttaacactaaacaatggaaaggtaagcgggtttttctatgaaggtttccgccgatacacccggtcacgatgatccaggcccaggccggcgccttggcttagatgtcggcaccgtgcgcatcggagtggcagcctctgaccgcgatgccaagcttgccatgcctgtggaaaccgttccgcgggaaactggattcaaagggccagacctggccgatattgatcggttggtcgccatcgttgaggaatacaacgccgtggaagtcattgttggtctacccacagatctgcagggaaatggctccgccagtgtgaagcatgcaaaggaaattgctttccgcgtccgtcggcgcctcaccaatgctggaaagaacattccggtacggcttggcgacgaacgcctcaccaccgtcgtggccacccaagccttgcgggcctcaggagtcagcgaaaaagcgggacgtaaagttattgatcaagctgccgcagtagaaatccttcaaacctggttggatgctcgcacccgagcccttgaaccacaatccacagacacccaagatttcgacgagaagggaaatttcccaggatgaaccaaatccgaaaccgccgg

SEQ ID NO: 2912 - protein, 182 aa, Corynebacterium glutamicum
MKVSADTPGHDDPGPGRRLGLDVGTVRIGVAASDRDAKLAMPVETVPRETGFKGPDLADIDRLVAIVEEYNAVEVIVGLPTDLQGNGSASVKHAKEIAFRVRRRLTNAGKNIPVRLGDERLTTVVATQALRASGVSEKAGRKVIDQAAAVEILQTWLDARTRALEPQSTDTQDFDEKGNFPG

SEQ ID NO: 2913 - DNA, 825 bp, Corynebacterium glutamicum
  CDS (101)..(802): RXA02793
tgcatgctcctctagtgatgtggtggaaagtcaagggataaccgttgaaaactgtggctcggtggtgaattttgatagtccaccatcacacatcgccttgatgaaaagcgccgccgtacccacgcttgatgctttaggtgttttggatcgcgtggtgaccaaagctggtgccttcccagctgggtattacgacgccgatttatcggaaagagtcacggacatcccaacgctgtccaacaagatcgacgccagcggacacgtgttgatctcgaaagaagtcgttgttgccgccaacccagacattgttttcggcgaaactgacaccatcaaccgcgcatccatggcatcctcgaacatcccggtcgtggaggaaccagcattctgtggcagcatcgacggcgacgtgagttttgatgatgtctggtcacaaatctccacctatggcaccatttttgatcgctcgacagaagcagacgcatacattgcaacgttgaaggaacgtgtttctgaagtatcctcgcgggttactgactccggaaaaactgtggcggtgctctaccccaccatcggcggcggagtcacctacgcatacggccgcggatccatggccaacccacttgttgccgaagcaggcctgaccaacgttttcgcagaccaatccgaacgcgtctttgaggtcacggcagaagaactgatctccgaaaccccgactcatcatcgttttacacagcgacggttccccttcagacatcgtcgcagaggtgggcaatctccaagggtccagcgcactcactgctctgagtgagaacaaagtgctgcccatac

SEQ ID NO: 2914 - protein, 234 aa, Corynebacterium glutamicum
MKSAAVPTLDALGVLDRVVTKAGAFPAGYYDADLSERVTDIPTLSNKIDASGHVLISKEVVVAANPDIVFGETDTINRASMASSNIPVVEEPAFCGSIDGDVSFDDVWSQISTYGTIFDRSTEADAYIATLKERVSEVSSRVTDSGKTVAVLYPTIGGGVTYAYGRGSMANPLVAEAGLTNVFADQSERVFEVTAEELISETPTHHRFTQRRFPFRHRRRGGQSPRVQRTHCSE

SEQ ID NO: 2915 - DNA, 672 bp, Corynebacterium glutamicum
  CDS (101)..(649): RXA02796
gattattcatggaacatccttagcggagttatgcaaacgttttcataaggggttattccattctacgtcgatctttgtagaaggtggttattatggcttcatgagactgttcgcgtctatcactccgccgattgaagtcaccgagcatctgatcaacgcgcttcgtccctacaaggatgatctgcggtggtctgatccagacaattggcacatcacgttggcgttctatggagaattacctgatggggcagtcgaagatctcattgagcatctgacaagtgcagcccgaatcaatgaagaattcaccatcagaatcaaaggcgcaggctcatttaatcggaagaatttgtggatgggtgttggtggtgacaccaaagatctgcggcgactgatggctgattgtctgattgatcctgaggaacgccgacgccagcgtgcacacctgaccgtggcgaaaccaacgcagcgacagcgcagccgcgattgggatcctgtcatccccgatctggtccacgctctctctatatacgaaggccccgaatggccagtcgatgagattgaactggtgtcttctgaacctggaaaaggcagaagcggtgggccactgtatacaaccgtggccaccattgcgttgtcatctgcgctggtttaaaggctcaaccgcggaacggc

SEQ ID NO: 2916 - protein, 183 aa, Corynebacterium glutamicum
MRLFASITPPIEVTEHLINALRPYKDDLRWSDPDNWHITLAFYGELPDGAVEDLIEHLTSAARINEEFTIRIKGAGSFNRKNLWMGVGGDTKDLRRLMADCLIDPEERRRQRAHLTVAKPTQRQRSRDWDPVIPDLVHALSIYEGPEWPVDEIELVSSEPGKGRSGGPLYTTVATIALSSALV

SEQ ID NO: 2917 - DNA, 1548 bp, Corynebacterium glutamicum
  CDS (101)..(1525): RXA02798
gcatcaaaatcatgtgcattcatcattgctgatcatcatagacctgttggcaaatgaattcaccaattctttaaagctctcaccctctttagggaactgaatgcggtctgtactcgactactggatcatgactcttgcaccttccaccaatgcggtttcgcagcaaacaagaaggaacccttcccaagcgccgcgacttcttcatcgacttcacttctttgccggcattatctgcgcaccgttgattttcatcgctgcgctcaccggactggtgtatgcgttctcccccaccattgaaagcatctctaatcaggaaatgctcacggtctccaagtcggctagcgacacagctcttccggtgcgtgaacaagtgagcatcgcccaagaactccaccccgatttagatctctcaggtgtccggcttggcgatgattcctccaccacccgcgtcctcttcgccgacgagacgcttgctgaatccacagtccgcgccgtgtttgttgatccctacaccggcgagatcaccggtgataccacccaatacggaagctcagctgcactgccgtttcggcaatgggtctcgcaaggtcaccgcatgttgtggcttggtgaacctggacgtatttattccgaacttgcggcaagttggctcggagttttagccgtaggcggtttcgcattattgtggttgcgcaacaaaaagcccggccgcttgagaaagatggtgcgaactggtggccgtggtcgagtgaaaacgtatcgccgacatgcagcattgggcaccgtagcgggcttgggttttgtgttcctcacctttactggcctgacctggtcaacttatgcgggatccaacatcacggatttacgcacccaactcaattggacgcagccttccgttaacgcttctctaacagctgccccacaagtggacatgcatgatgaacacgcaggtcatcacatgcatatggagtcggcaacctcaggctcaggttctatagatctggtagcggccacggctatctccgaattacgcactcccctcaccattactcccccagcacaagatggcctcgcgtggactgccacagaaaaccgcgacgcctaccgattcaccactgacaccatcgctgttgatggcgacaccggaatgctgaccaaccgtttgaattccactgattggccattagctgctcaagcgagtgcatggctcatccagcttcacatgggcaccctgtttggccttcccaaccaggttgtacttgggctgttggctgcctcaataatcgtgatgatcggccttgggtattggatgctgtggcagcatcggccacgggaaggttggcctagcgctcccaagcgtgcaggatttgaaaaacccacctggggaactatcgcgttgggtgttgtggtgatcgcgtatgggcttctcgcgccactttttgcagtttcactgctcgtgtttattggattaagccttggagtgcggtttatttctcgtatgtccgggcgcgcggacacgtccaactaagaacaccaaaccacaccgcc

SEQ ID NO: 2918 - protein, 475 aa, Corynebacterium glutamicum
MRSVLDYWIMTLAPSTNAVSQQTRRNPSQAPRLLHRLHFFAGIICAPLIFIAALTGLVYAFSPTIESISNQEMLTVSKSASDTALPVREQVSIAQELHPDLDLSGVRLGDDSSTTRVLFADETLAESTVRAVFVDPYTGEITGDTTQYGSSAALPFRQWVSQGHRMLWLGEPGRIYSELAASWLGVLAVGGFALLWLRNKKPGRLRKMVRTGGRGRVKTYRRHAALGTVAGLGFVFLTFTGLTWSTYAGSNITDLRTQLNWTQPSVNASLTAAPQVDMHDEHAGHHMHMESATSGSGSIDLVAATAISELRTPLTITPPAQDGLAWTATENRDAYRFTTDTIAVDGDTGMLTNRLNSTDWPLAAQASAWLIQLHMGTLFGLPNQVVLGLLAASIIVMIGLGYWMLWQHRPREGWPSAPKRAGFEKPTWGTIALGVVVIAYGLLAPLFAVSLLVFIGLSLGVRFISRMSGRADTSN

SEQ ID NO: 2919 - DNA, 396 bp, Corynebacterium glutamicum
  CDS (101)..(373): RXA02799
tcgcgcgcaagtgttcagtaatatggactcccagtaacgggttttcatgacgcgttaaattttttagttgatcacagatacaccaatcaggagtagcgcagtggcacgcaacattgaagacatccagcgcgatattgagcgcacccgccgtcagttggcttccaccctcgacgagctggcagaccgcagcaagccttccaacttggtcgatgacgccaagaaccaggcaaccgcgaagctgcaggaatcaaacgtacagaaggtgctcctgggcgtcgctgctgtcgtcgtcggtgctgttgtattcagcgttgtgcgtggccgtaagaaggcaaacgatctgaaggaaatccagcgcctgctctccgagcgttaaattgcttttcgacggggcgt

SEQ ID NO: 2920 - protein, 91 aa, Corynebacterium glutamicum
VARNIEDIQRDIERTRRQLASTLDELADRSKPSNLVDDAKNQATAKLQESNVQKVLLGVAAVVVGAVVFSVVRGRKKANDLKEIQRLLSER

SEQ ID NO: 2921 - DNA, 552 bp, Corynebacterium glutamicum
  CDS (1)..(552): RXA02815
tggctgcgcagtaccaaagagttcgaagaccagcccgtgattccggcattcgaagtaatcgcaacggttgcctctgaattcgcaggcgacgacggcaactactccaacgaattccccgtggaagatctagtcggatacgttgacgccatcaccgaagccggcggatacgcagtcctggatcttcaacccggacgcgccaacttcctcgaccaagccaaaatgtatgaagaactcctcaaacgaccaaacgttggattggcgctagatcccgagtggaaaatcggacccgatgagcaacccatgacacgagtgggctctgcagatgccgccgaaatcaacgaagtatcccagtggctcgccgacctgaccgccgagaacgatcttccacaaaaggcatttgtactgcaccaattccaattggaaatgctcaccaatcgggatcaaatcaataccgatcacctggaactggctgtcgtgttgcacgcagatggacacggaaacgcaggggataagtacgcaacttggaacatgcttcgcgagggactgagcccg

SEQ ID NO: 2922 - protein, 184 aa, Corynebacterium glutamicum
WLRSTKEFEDQPVIPAFEVIATVASEFAGDDGNYSNEFPVEDLVGYVDAITEAGGYAVLDLQPGRANFLDQAKMYEELLKRPNVGLALDPEWKIGPDEQPMTRVGSADAAEINEVSQWLADLTAENDLPQKAFVLHQFQLEMLTNRDQINTDHLELAVVLHADGHGNAGDKYATWNMLREGLSP

SEQ ID NO: 2923 - DNA, 370 bp, Corynebacterium glutamicum
  CDS (101)..(370): RXA02823
  misc_feature (7, 9): n = a, t, c, or g
ttatgtntntaaacagccagttgggggtcatgggggagcgccccgtgactggttaatgccccgatctgggacgtacagtaacaacgacactggaggtgccatgactgttagaaatcccgaccgtgaggcaatccgtcacggaaaaattacgacggaggcgctgcgtgagcgtcccgcatacccgacctgggcaatgaagctgaccatggccatcactggcctaatgtttggtggcttcgttcttgttcacatgatcggaaacctgaaaatcttcatgccggactacgcagccgattctgcgcatccgggtgaagcacaagtagatgtctacggcgagttcctgcgtgagatcggatccccgatcctccca

SEQ ID NO: 2924 - protein, 90 aa, Corynebacterium glutamicum
MTVRNPDREAIRHGKITTEALRERPAYPTWAMKLTMAITGLMFGGFVLVHMIGNLKIFMPDYAADSAHPGEAQVDVYGEFLREIGSPILP

SEQ ID NO: 2925 - DNA, 523 bp, Corynebacterium glutamicum
  CDS (101)..(523): RXA02827
  misc_feature 309,344,347,363,406,505: n = a, t, c, or g
  VARIANT (70): Xaa = Phe, Ser, Tyr, or Cys
  VARIANT (82)..(83): Xaa = Ser, Pro, Thr, or Ala
  VARIANT (88): Xaa = Leu, Pro, His, or Arg
  VARIANT (102, 135): Xaa = His or Gln
cggtttacttttatttatcgaatgaatcatgtacatagaataataagcattaaagggggggcgggtaggaagaagcagccgtgtcgcatatgcttactttatgtatgagcagcagaagatccttaacgaagtcagtgaaaaacgtcttcaggcaatcaaagattttacagaactgggatctggattcaagattgcgatgcgggatctttccattcgcggtgcaggtaatctcttaggtgctcagcagcatggatttattgatgcagtcggtttcgatatgtattctcaaatgctaagcgaagctgtttntcgtaaacaaggaaagaatagtcaagtggagaagnccnctgttgagatcgaccncggtgtcgatgcgtatctacctgaaacatacgtggcagatcancggcagaaaatcgagatctataaacgaattcgtgaacttgattcgcaagaaatgctagatgaactagaagatgatctgctcgaccgttttggagaacanccagaagaagtagcacat

SEQ ID NO: 2926 - protein, 141 aa, Corynebacterium glutamicum
  VARIANT (70): Xaa = Phe, Ser, Tyr, or Cys
  VARIANT (82)..(83): Xaa = Ser, Pro, Thr, or Ala
  VARIANT (88): Xaa = Leu, Pro, His, or Arg
  VARIANT (102, 135): Xaa = His or Gln
MYEQQKILNEVSEKRLQAIKDFTELGSGFKIAMRDLSIRGAGNLLGAQQHGFIDAVGFDMYSQMLSEAVXRKQGKNSQVEKXXVEIDXGVDAYLPETYVADXRQKIEIYKRIRELDSQEMLDELEDDLLDRFGEXPEEVAH

SEQ ID NO: 2927 - DNA, 356 bp, Corynebacterium glutamicum
  CDS (1)..(342): RXA02842
  misc_feature (299): n = a, t, c, or g
  VARIANT (100): Xaa = Leu, Pro, His, or Arg
gatgcgggatttgtgtacttcggtgaaatcgatgatgctggccatattttcggcctggcaggcgacgaataccgaggggggattcgcagggtcgacacccacgtgaagaaagttctttctgaagtgtcacgacgctccgacgagctcggggaggactggctggtagtgatcacaactgatcatggtcaccttgatgagggcgggcacggcggcaccaccgatcgggagcgagaatcctggatcatcacgtggagcccgcaccgggaactgccacagtggcctgaagaaattgcgccgcntgagctggcagaactgatgcttgtggagcgccgaaccttgaggtgattgtcactaaa

SEQ ID NO: 2928 - protein, 114 aa, Corynebacterium glutamicum
  VARIANT (100): Xaa = Leu, Pro, His, or Arg
DAGFVYFGEIDDAGHIFGLAGDEYRGGIRRVDTHVKKVLSEVSRRSDELGEDWLVVITTDHGHLDEGGHGGTTDRERESWIITWSPHRELPQWPEEIAPXELAELMLVERRTLR

SEQ ID NO: 2929 - DNA, 615 bp, Corynebacterium glutamicum
  CDS (1)..(615): RXA02845
gaggatcacacctcaatgctcacccacttttccgcagctgtcggcatgcatgaccgcgatccggctcgcttcccaggccagggcgacggttcctacccggatcttttttggctgtacaaaaacgccctcaacctggtcattagctcagtgttgttcacccgtgagcagatggacaacatgctcgatcagatggatgaacacttcacgcgcgcgggtatcccgcgcatcgcgattaatattgagcgccgcgacgacgccctgatgaacggctccctcgagcgtgcgctagagctgcaagagcttatcgacgcctcccagcacgacgatcccttcgacgactgcccaacctgccaaattgcaggaaaagcggcactcgcaatggcagcagatgattacgacgaaacccaaaacctcgtctcccaaatcatcagctacggatccatcggctgcgtcatggaaccagagaccaccctcgctgcgttcatgctgcgtgtgcttaagtccggcgatgctgattatgcccgctacctgcaagatgtcagtgcgaaggcaaacccagaattccagtcccttgattccgttggacgccacctagaattcctcggcatcactgga

SEQ ID NO: 2930 - protein, 205 aa, Corynebacterium glutamicum
EDHTSMLTHFSAAVGMHDRDPARFPGQGDGSYPDLFWLYKNALNLVISSVLFTREQMDNMLDQMDEHFTRAGIPRIAINIERRDDALMNGSLERALELQELIDASQHDDPFDDCPTCQIAGKAALAMAADDYDETQNLVSQIISYGSIGCVMEPETTLAAFMLRVLKSGDADYARYLQDVSAKANPEFQSLDSVGRHLEFLGITG

SEQ ID NO: 2931 - DNA, 499 bp, Corynebacterium glutamicum
  CDS (101)..(499): RXA02848
agcaaggaccgcaacaactggggcaacctggatgagcgtctgtctcgcccgaacacgtttaaccccagcgcgtttcagaatgtgaatttcttctagttacatgcagatcgttctggcttcgcagtccccgtcccgccgaagaatcctcaattcggcgggcgtcgagcccctcatccacccagctgatgttgatgaggacgcgctccttcactccctcaacggctctgcgccggaggagatcgtccgccagcttgcgctggctaaagcacaggtggttgcgccgtcctatccgggcgacgtcgtcatcggtggcgattccatgctgcttatcgacgccaccctccaaggcaagccgcacacccgcgaagccaccatcgaaagatggaaacaacaacgcggcaacaaggccacactgatcaccggccacgccatcatctttggcgatgaagtgatcgtggagtcctcctccaccaacattcatttcgccgaggccagcgat

SEQ ID NO: 2932 - protein, 133 aa, Corynebacterium glutamicum
MQIVLASQSPSRRRILNSAGVEPLIHPADVDEDALLHSLNGSAPEEIVRQLALAKAQVVAPSYPGDVVIGGDSMLLIDATLQGKPHTREATIERWKQQRGNKATLITGHAIIFGDEVIVESSSTNIHFAEASD

SEQ ID NO: 2933 - DNA, 18 bp, Artificial Sequence
  Description of Artificial Sequence: primer
ggaaacagtatgaccatg

SEQ ID NO: 2934 - DNA, 17 bp, Artificial Sequence
  Description of Artificial Sequence: primer
gtaaaacgacggccagt

What is claimed:

1. An isolated nucleic acid molecule consisting of the nucleotide sequence set forth in SEQ ID NO: 1, or a full complement thereof.

2. An isolated nucleic acid molecule which encodes a polypeptide comprising the amino acid sequence set forth in SEQ ID NO:2, or a full complement thereof.

3. An isolated nucleic acid molecule which encodes a polypeptide consisting of the amino acid sequence set forth in SEQ ID NO:2, or a full complement thereof.

4. An isolated nucleic acid molecule consisting of a nucleotide sequence which is at least 90% identical to the nucleotide sequence of SEQ ID NO: 1, or a full complement thereof.

5. An isolated nucleic acid molecule which encodes a polypeptide consisting of an amino acid sequence at least 90% identical to the amino acid sequence of SEQ ID NO:2.

* * * * *